United States Patent 9,328,346 (POLYCOMB-ASSOCIATED NON-CODING RNAS) - sequence listing, part 121

SEQ ID NO: 191217 - RNA, 172876 nt, Homo sapiens
gggcgucuccgccgcagcucggcucccgcgcgcucagcaccgccagcggcggccagaugcaggcggagcgaggagcucggggaggccgugggcggcggccaggccgcggccggccuggcggagaucgccacagcgagcggcccggagccgcagcggcgguagccagaggcggcggcggaggcggcggcggggacggaggcggacgccggggccguggccguggccggggcuuccgcggcgcucgcggaggccgaggaggaggaggcgccccgcgaggcagccgccgggagccgggaggcuggggcgcaggggccagcgcgccgguaagaggcgacggcugguggggcugggaccgcguguaacuggggcaaguggggccgaggccgccagucaagagccgcaagagagcgugccaggcgcgcgccagacgggcggcggcgccggcgccugcgcgggacgggcggaugguggcgcgggggcgcgccugguggcgggggcgcgccuggguaugcgcuuggcccucguggccuccuggccgggcuggcgcgagacaguggggguaggagggcuucccagccugccccaggguccggguuaggaacccagaggccaaggccgugugucagggcugcaagucucggcggcccgugggccggcugggcugucuguacgaguaccacuaugggacggaggcgcggccacgacguggucccucggcagccuuuacgggcacgcuccuguuauuaggagggaaaggauuuuuuggucuguuuuguuaacugucugugcaaugccuaguacacaguaggcgcauaauaaaaaguuuguugagugaaagaaugaccccuacgacuggacucuaguauuugggggcgggaccagaugcauaguucuuuguaauagcguaguucucuuuuauuaugccuguauguguagaaaucagcgagcacugggcuuugucguuuugaauuuucaauuuauaaaugagcagucaaguucugaguuuuaauagcaauaucaucagucuuauugacacauucauagaaggaaguuuuuggagauuggagcaggggaugauauauaugggggcaaagcuaaccauaucucagcuaaaggaguuagaggacugucuuuuuaugaguuguucuguuaccuuaacaucuguaggacaagaccaucuuuauauucugcauucuuaugcacacugauuuaaaaaauucuuuuuugcaugaggcaaaauuugcucuuacugaaguauuuacaauaucuugagggcauagcagauaagauaucccuaaagagaguaguuguauacagcaauacagagcuggaaaaaaaaguauaaaacuuaaauuuaaauguaacaaacuuaaaucuuguuaggauuaagauagguaauaggcaaaacuugaaugagauauaaaaacauuuuuagggucaguuuaccucguguaaacugacagaaacuaagguaaaugacagaaacuaagaccaaccuagugcccacuauauaucacauuuuguucuuauaacucuauuauauauauauaauauauauguaauguagaauuauguaauauaauaguauguaauuauauauuaacuacaauguuauauauuauuuauauauccauauauagagaguaaucuuuauuuuuacagguuaacugacuugccuaagcuuucacagcuaguggcagagcugggauuuauaucaagcugcccuugagucaacaguauuuuaucucuuacuuuuucgugaaccaguuaccacuuuauugagaacaaaguagauauuccuuagcugcagggaucgugcuuuaagaguaauuguaguaaugguacauuugguguuaacuauggugucuggcgcacaggacuuuacuaauaagugucuuuaaguugaauugagugagugaaggugcuucuguuuuguuaaucucuguugaauuaaauugggugaaaugaugguauauauuuuuuuuuuuuuuuugagacggaguuuuacucuuguugcccaggcuggagugcaauggcaugaucuuggcuugcugcaaccuccgccucccggguucaagugauucuccugccucagccucccaaguagcugggauuacaggcaugagccaccuugcccggcuaauuuuguauuuuuaauagagaugggguuucaccauguuggucaggcuggucucgaacuccugaccucaggugauccacccgccucggccucccaaggugcugggauauggauuacaggugugacccacugcgccuggucaugaugguauaucauuaaaagaaagaauaauacaagacuuuaaaaaauuuaagauaguauuguaacacauucuguuaaaauuuuaggcuuuuucuuuugucgaguuggucuuaucccuucaucaucauguuuucagccaaagcuggagggagggauguugggcagauuguuccuuaauuuugguuuggauuggucaucucuaaguuccuuccauuucucagauucugaaguacuguuuguauuuagucuugcuaggacaccauuuuuggugcuuaaccauuacaugagacaagauugauugacuuuccugaagccuucuuguucucauaucccauggugcauuugugccccaaggagagaguaaccgaaaugaucaaaggaaaaaaaaaucauaauagacuccuagccauguaaagaccaguuguccaccuucagaaaccaauuuuguguacaccuuugcuuucuauuuuggaccacugcauacaaauggaaaacaaaaucaaucuaaccaacuucuacauagcuauguaauacuccaggguaacuuaguugaguacuaaguugaguacaucucuuagucucuugcucuuaaaucauuccuucuguaaauggucugagcucuaagcuuacugauuaugggugagcauaauuaucuucacggaauacucacuagaagcauuauuguacuagauacaaucauuaacuuuaaaaaaaaaacacaaaacuggcugggugugguggcucgcgcuuguaaucccagcacuuugggaggcugaggugggugggucacuugagucugggaguucgagaccagacugggcaacauaacgagacccccucucuauaaaaaaaauacaaaacugccgagcauggcggggugcaucuguagucccugcuacaagggaggcugaagcagccggauuguuuugagccccggagguggaggcugcagugagcugugauccugccacugcacuccagccugggcaauagagugagacucugucucaaauaacuaacuuacuaacuaaaugaauaaauaaucccccuaucacugcccccaauacuaggauuguuuaguauuuaucuuugugaugggcuguuagcagagaggaagacaaggccagcugguagucuuuggaauuuuuuuucuuuuuuccuuccucuaguaauaacaguaauucacauuugucgaguacuuaauauaagaugagacagcugaggcaccguuaaauaacucacaguuaggagaggugaaauaacuuuuuaauaucacucaaccagaaaauugcugagccuggauuccaccccagcauuuucacuccagagccuguucuuucgacugcugcucuaaacugcuccuggaaugacuuugagauuugaaaaagggguguguggaggacuguugagugauucuuucacaugccugauuauuuuuuuaacugauauguuaguaugguuauaagguuuuaagguaacauugguaccaucuucaguuauuguggguguuaccagaccuuugcuuucuugcuccauguuuauauugcagcuuuucauauuccuuuuaaaaugauuuauauucaauaaaagaugagacagcuguuuauaguuguacuaaaaaguagaaucuggaggcauuuaauucugaucaaacuuuugcuuuguaaacaaagccugaguaguaauuaauacccgauggcguugacauuuucauuucacuggguaaaaaggaaaucucuaauuuucuauucaaguuuagugugaaccuggagggaagaaauggugucagaucaguuacaggcaggugucuaaggacuugcuccuucauuguugcucagaguagccaccagccgcuugucagccagcuagagacugagagccuguuaaaagcucaaacugaaaugacagccucuagacuuuauuuuccuuuuuuuccagaaagccugaagcaaauuugguuagaaacugaaugugcuuaagugucccaacagaagauugcuuuaagauuaguucuugguaauccaugaaauugaccucuccuccugcugcaaaccauugcacacacacuguaauuauuuuggcauccuuauccuuguuaacauauucuguuuuuaaguugcuuuucucacugaccacuauuucacuuacauauuuucaauaucaacacagacaacugaacuuuuuugcuuguauucugccuaaaaaaauuuugggaaaccauguacaauguacuuuaaaguuuauaucuaacauuuuuaucaauggaucagagaauuucaaaauauaaaauuuccaacauauuguauauauugacuuuuuaaauaaaaacacaauuuuuauaaauugauuuuuucuuuuccuuuuuuuuuuuuuuuaaaaaagaaacugggucucacuuuguugcucacgcuggagugcaguagugugagcaaagcucacugcugccuucaacugcuguacucaagggauccucccaucucagccuccugaguaggugggaguacaggcgugaaccaccauacccaacuaauauuuuuauauuuuguagacauggucucacugucuugcccaggcuggucucaaacuccugggcucaagcaguccucccgccucagccacccaaagugcugggguuacagaugugagucaccacacuuggcucuggauggauuuuaaauacuagagugauuugauauuugccuuuagccauuuaaaaaucacauuaauaaauuauuuaggcugggcgcaguggcucaugccuguaaucccagcacuuugggaggcugaggugggcagaucacaaggucaagagauugagaccauccuggccaaaauggugaaaccccucucuacuaaagauacaaaaguuagcugggcaugguggcgcgcaccuguaaucccagcuacuugggaggcugaggcgggagaaucgcuuaaacuugggaggcggagguugcagugagccgaaauugcgccacugcucuuuacccuggagacagaaugagacuccaucucaaaacaaaaaacaaaaaacaaaacccaacucuuuaguagugugaagauuuccauuguuucuuauucuuuuuuacuuguauuuuaauuccccaucucccacagaaccuuauucaacagaauauauuucauacuugaaaguuuuuuagugguuaccauuucaugucuuccuguaauaaauguugacuuaaaaaauguuauauaacucuacaggcuugggugcuacuuuuucuuuuagauugaauuaagauuacauugauuaauauauacaguuauuuugauuugcaauuuuuuuuuuuuuuuugagacggagccucgcucuguuacccaggcuggagugcaguggcacgaucucggcucacugcaaucuccgccucuuggguucaagcaauucuccugccucagccuccugaguagcugggacuacaggugcacaccgccacacccggcuaauuuuuuguauuuuaguagagacgggauuucaccguguugcucaggcugguuuugaacuccugaggucaggcaguccgcccgcuucugccuccugacgugcuaggauuacagacaugagccaccgcgcccagccuugcaguuauuaaacauaaagguaaaacuucauugugaaugagucucauuuucccuagugaguuugaguauccguggaugaacauuacuuauugccugcacgagauaggauucagugucaauucuuuuccuaauuuuugauuuuauagauguaaggauugagaaacauuguucacauaaauagguagaugggaauguuggaguuuugccauaucaaugucacucaguucauuaaauaucucuacuuguaugccaaaaaguuauuuuuaaaguauuuuaagaaucugucaagugaugacuguauuagguucuccaucacuuugauugaaagcaaauaauuggaacuaccugauuugcaaaaggacauauuacauguucuuuagaguuacacauccucaacaucuauauuuaaaauuauccuauuguugaggcuuggggaauacagccagauugagaauggcugaaaagcaguugugcugucuucaggugccuucuaggguagacugcuuuugggaaagaccguggaucuugaauaucuggaaguugauucccugaaaaacauacugcucauauacuccuuggaaaaucuuucugaaccccuagguaugugcacacuccguuuugaggacagcuaagaucauagccccuuuguuucuuaguaagaugguucauugcaugaauucauucagagcuuuuuuguuuucuggcuauccaucauuugcagaauaugguuuccagguuuugucauucuuaauaguguuacucucuuuguuuuaaacugcugcuaggauggaaaauagcucgcucauaaaucgauaccacuggcauguguuuucuggaagaguagguacuaagucauuguugguuuucuuauuuuuuuuccagaaaaaguagugauuacuuuuuacagcacugggcaagugaccucuagagagguuacguaggucauuugauccuaaccacaccauagcaugacuuaacuagccuuuuucuagaaauuaggugguugcaaagguguuuucuauucagaugucacuauuucuugaugcacuuugaaguaucaaagggagcaauaaagaccauagugacacauaguaauuucuauuugauagaagcuacugacuaacuuauuacggcacuggauuaguucucuuugauuuuuuuuuucuuuuguuagaagcccugugugugugugugugugcgugugcgcgcguauguguguguugaggugccagaaauaaguacuuuaauacuuuuucucuuggauggaaauaauuaacagcuuuguuagucugaaaauuuucuacaaaggugucauggggcagugcauggauaaugguuauggagaauauuucacuuuugaguggguuuugucagaggaugcugaaaagaaauacaaacugauguguguguuuuaucuugaugcugcuaggaugcuguuguuauaaucugaccaaccugauuuuguaagccuuaaauugcuuaaaaggcaauuccugugaagaacaacacugccaaggaugcuguuuccuaccgcccauaucacaucauuggugugugugcaaacagcacaacaauccaaaaaaaaauaggagauuaauggaaugcauucccuguuguaaaaacuuaauucuaccuuugaguccucuugccauuaaggacugauacgaaucugucugauccauauuucuuuaguaccaagucaaacuuacauugagggauagcaaacauuuuaauauuaaccuaagcagucugggcaugguggcucaugcccguaaucccagcacuuugggaggcugaggcaggcagaucaccugaggucaggaguucgagaccagccugaccaacaugaugaaacccugucgcuauuagaaauauaaaaauuagccaggcaugguggcaugcgccuguaaucccagcuacucgggaggcugagacaggagaaucgcuugaacccgggaggcggagguugcagugagcugagaucgcgccauugcauuccagccugggcaacaagagcaaaacucagucucaaaaaaaaaaaaaaaaaaaaaaauuaaccuaagcaaagcauaauugggauaauaggcuguuacaaaaaaaaacucauauguauucuuuuggcuuauuaucaguguugugauuccucuauuuuuguauuuaacugugucaaguuacugacaccaagaguuuguuaauagauguauauucugugaaacgaacauagucaucuauuuuggauuucuguaauuucuggcuugaaaagaccauucacaguuacauuuggggaaaauuaaaaaauauuuaggccagguguaguggcucauaccuguaaucccagcacuuugggagggugagguggaaggacugcuuaaggccaggaguucaagaccagccugggcaacaaagcaagaucccugucaacaacaacaacaaaaaauuuagccaggcacgguggugcacgccuguauucccaccuacucaggaggccgaggcaggaagauuuuuaacccaggaguuggagguugcagugagcuaugaucacuccagccuggaugacagcccgagacucuuucucaacaaaaccccccaaaccaggcugggcgugguggcucacaccuguaaucccagcauuuugggaggcugaggcggguggaucacaaggucagccuaacacaaugaaacccugucucuacuaaaaauacaaaaaaauuagccgggcgagguggcaggcagcuguagucccagcuacuugagaggcugaggcaggagaauggcaugaaccugggaggcggagcuugcagugaagcgagauugcgccacugcacuccagccugggcgacagagcaagacuccgucucaaacaaaacaaaacaaaaaaccccccaaaaccuaguauucucaaaaaguuucaugcaaugugaauuuuauugacauaguggauuuggaauucauaguucuuuuuuugagaugaagucucacucacucugucacccaggcuggaaugcaguggugugaucucagcucccugcaaccucugccuucuggguucaagagauucuccugccucagccucccgaguagcugggauuacagacaugugccaccaugccuggcuaauuuuuguauuuuuaguagagauggggucgcaccauguuggccaggcugggcucgaacuccugaccucaagugauccgccugccucggccucccaaagugcugggauuacaagugugagucaccaugcucggcuuggaauuuauaguucuauugugaaucuagaguucacauucuagugagcuggauucaugauauugaggacuagaauguuucaacaucauuuuuuccuuuuacuacaaggcugauaauaaaauagagugucucuguucaauauuugggcuaauugaagauuagucuuauauuauuaaagaagucuuaaucccuauuacagauacauuacacuucaauuccuuccaaggaaguuaugauuuuucugggagcaaaccuugaugaaaaaaugaguauuauucugaagacaaagcuuggcuuccuauuuucccuugguguccuucacuccauucccaaguguuguguuuuguuuugcugcuucuuuucuuuuuaaagucaguaguacuaugaauauguaaacaacuccuaaaguuuuaaaaccauuuccuuuucaauuuuuuuuuuuuuuuuuuuuuuuuguagaaauagggucuaccuauguugcccaggcuggucuugaacuccuggacucaagugaucccccugccucggcuuaccaaagugcugggauuacaggcaugagccaccuugcccgguuccuaaaacuuuuuuuucccccucuuauucugguagucagccaagggaauuauugaauuaagauguggccagguguuauuuuaugagcacguauuuuacauaccuuggaaagaaaaauuaaacauacauguugaauuguuuuucauuuuuacaauauggaaguaaacuuaaaguagaggguuuuuagaguuggcaguggcgguggugggggugauggaggguucagguuugagccucagcuguuuucugucccuggauggagaggggaaggugcuguggaagccugagaaugaaugucuacucugguggguagcaugaacgucugcagaggggaaucucugaaaacuugaggauuagaggugaagaguuguggacaaauaguaauuguuauuucaagguaguaaauaaauuuauagacaaaugaauaacuaagauauaaccucucaaaaccaaguaaguguucugcuuuuugccuuacuuucucucccaauuuuuuuuuuucuggcaucuguguguuuuuccucuuucuuucaggugaagguacaaugugguggccgaugauggugguguguuuugcagucuaacagacugguuagaauccuaucuucucaccccccaugugcuaguuguaaaaucucaggaaaguuacugaaacuuccugagccucaguuuccucgccugugaaaggugauuaaggauaucuaccuuacacagcuguuguaaggacugacauuagaugaacacaauauauuuacuauauuuauagucacuuugccacuuugcuguccucucucauucagggucuucuuuuuuguuguuguuguuguuuguuuuaagacaagaucucacuuuguuacccaugcuggagugcccauggcaugaugauagcucaccaaagccuugaccuccuuggcuuaagugauccucccaccucagccuucugaauauggggaccaaauagaugugugccaccaugcuuggcuaauuuuuuuauuuuuauagagacgggauuuugccagguugcacaggcugcucucgaacuccugggcucaagugaaccaccugccuuggcuucccaaagugcugggacuacaggugugagccacugcaccuggccuucucuuguuacaguguguaggucagaugcaaacuauauacucauucauacauacacaugaacauauguguauagaauauuuagaaucuuauuauuuauggaauauguauuaucuuucuucauuaaaaaauuuuuuaaauggcuugaagcaugaagucucccagcuuuugcugagggggggucucucugugugugggguaugcuuaugcuuucagugcucugcuaggaaauuuacaccucugccuuaguguuuacuuccugccugugcagagccuuaagggcagccagaggugagauauuagggccuucucagaucuuuucugcgcaugaccacagccuuggacauguguauaucuuccagauucccaguaaugucaacguucuacaaugcccucuugaacaucuuguuccucaguuuuuuccuuuaagguuuuugucaguuuuuuuuuuuuuuuuugagccucaccugauccuugccucagguagcugugauuuuaaacccuuguugcugauuguuuuugacaaacucucugguaauaggacuguuugcacagagugaaaugagucugguggauaacgucaaggccugagaauggaguuuuucacagagcugucagggaggucaaauggugucagccuccugggaauggggcuuuuggcaaacuuuucugccccuuuuaguggauccaaggaugcugguuuucacaguuaccauaguugugaggcuguucguuuucuuucuuuuuuuuuuuuugagacagagucucucuuugucauccaggcuggagugcaguggugcaaucucagcucacugcaaccucugccuuccggguucaagcgauucuccugccucagccuccuguguagcugggauuacaggugcccaccaacacgccuggcuguuuuuuuauuuuuauuuuuuguauuuuuaguagagacagaguuucgccauguuggccaggcugguuuugaacuccugaccucaggugaucagccugccucagccucccaaagugcuaggauuacagguaugagccgaggcuguucauuuucaaagcaacugcagaccagaguagaguggaaugggaauggggcacguuacuguucauacugagauuuagcuguuuuaaauaaacacuccuuggacuuuugugagucuuuggcuacuuugcagaguuuugaaagaguauauguugacaauuuuugucaguguucuuguugcuuuuguaguagaguggguuugcagaggucuuuaucauucuggaaguacuucuauucuauuuuuugaagcagccauugccacucuugggcaucucuaauuguuagaaacuucuuccuuugggacaaaacacaucaugucacucuuuaauucuauuauacguaggccacaguucuagucuuuggaacaacagaguuuuuggcucagccaaagcacagaacucucuuaagguugaacaaaagaccgcaggggaaguuuuuaauauuuaaugugagcgacuuacuuuuucugaaacugucaauuuggaauugaucacauauccauaucaguguauuaagaaggcaaaaacuagugauuuaguuacuuagugaaaugugauagucuaucauuuuuuuuccucuuguccucagugauccuuguucugauugucuaucuuuucaugggccuguuuucaucauuccuuggaaaauuugaguaccugauuuauaguuuauauuuuuuacuacauccugggugacgucagcuuauaugugauugacacacauuaccuccugauuuccuuauaugauuucuucaauuccaaacucaucucaaguaugaccuuucucaacauaucuccccuugucaucaaaauuaauccguguuuccuuuccuccccuuuaauauaaaagguuaaaaguuauauccuaagguuaaaaguuacacccugagguuaaaagcuucaucuauuuugcugucacauaguaggaaaaauaccaagaagaaaauaaaagugcccuuuaguaucaucauccagaaauaaccacuguuaacauuugauguauauucuuuucucauaaaacugggaagaugucauaagacuuuuaaguaaaaaaaaaaugacaauauguggaaauuauaagguauauguaugcauuuaaaacucugaaaaggguagaagaauaucaaacuuaaucuguguuuggaguagagaaaauauagggauuauguagaacuuugucuuuccuuuauucauauuuuuuacuguuguguauuaucagaaacauagauauauuccaauuugaaaagacgauucuacaaauauauugugauuauaaaaauagggaagacagguaggcaagacugcacauaaaaacuguaaggauuaucucuggguggugagauuaugugguauugugugugguaaguguaaacacgggcuuuguggggcaagaugaucacuugaguuuggacagguccagugccugucuuuuucuccuuccuccgcuuuacacaugcgcacacacacacaaacacacacacacacgcaaaaccaaaccaaaacaaaaacacacacacacaauuuuuuuuucuucugaaccuuugagcgguggauaugaugcgucuuuaccccuaaacacuucaauguguauuuccuaaaagcaaggaaaucuuuuauaaccauugcacaauuaucaaaaucaggacauuaacauugcuacaauucuauuuaaccuuacagagguuucaccagaugacccaauaacguccuuuauuaggcuucgagucuugagcaaugauguauggaugaagggacacuuaagagagucuucacuauggcaguuaccauggcauccuaaccacucuagucuacuucucugauuguuccuguggcuggguucucagcugccugcuuccugcucauuuuuuauucagccuauuucucuaaacuucuugucgauuuuauaagcuacuagaaauucuuuuaguaaauuccuuuucuaccuaaauuagccagaguugguuucuauaguuugcaaccaaaacucuaguaaauuacauuucccucccacacuucauauuucagaaucuuauucauuuucacaugcucaccucaaaugccacccuuuuuuuugagauggagucucacuccaucgcccaggguggagugcaguggugcgaucucugcuuauugcauccucugccucccgggcucaaacgauucuccugccucagccucccaaguagcuggauuacaggcuccuaccaccaugcccagcuaauuuuuguauuuuuaguagagacgggguucucuacuggucucaaaauccugaccucagguaauccaccugccuuggccucccaaagugcuaggauuacaggugugagccaccaugcccggccucgccaccuuucuuucuuuuuauuuuuuccuuuuuuuuuugagaaggagucuugcuuugucgcccaggcuggagugcaauggcacgaucucggcucacugcaaccucugccucuuggguucaagcuauucuccugccucagccuccugaguagcugggauuacaggcgugugccaccaugcguggcuaauuuuuguauuuuuuuuuuuuuuuaguagagacgggguuucaccauguuggucaggcuggucucgaacuccugaccucaugauccgcccgccucggccucccaaagugcugggauuacagaugugagccacugugccuggccuuccuuuuuauuuauaguaauuuguaguuuuaauuugauaguuuuccuuaaugaauauucugugagcaaagugcuucuuuuuuuuuuuuuuuuuuuuugagacagggucucauucuguugcccaggcuggagggcaguggugcagucuuggccuuggccucccaaaaugcugggauuauagguguaagccaccacgcccagccuucagagguuucuucauagagauugccgcccaucacucuucaucucauaccuacuuuauuuugauaccauuuaucacuaccugaagugauggugucuuauguauuuauaauagcauuauaaaguauuccuuuuuuguuguuugacuccucugguggaaugcaaacuucaugggugcauggaauuggucuuguucacugcuauaauccaagcacacugacuaaugccuggcauaguaucagcucucaguagauauuuguuguguaauugaauaaaggauuuuguguuuaagcaagggauuacuugcaguauucuggaaacauucacauuuauuuucugguagcagguuuuaugcuuuuccuguuacgauuaaaaccagugaagggagaagagguuuagcuuacaucugaaaucaaauccacucucugggcuccucucuggauagaguccucuauuuugccaucaauaaaaagagccagaaugaguuuaaauuucccuggccaaaaacguggcaucugucagaauuucuaacacauguuuucuuucuuugaugcccuucacagccugaagguguauagauuaggucuuuuuaguugcuagcagcacacaauaagcagcuguuuacuuuuaauauuuaacugcucaccuggccuuuuaagccuggcgugauugaagggauggcaagcaacagaggcuuacagaguaggggcaagaauaggacaguguuccagaggucagagaguuuuuuuauuuucuuccaucuuuuguuagagucugaaauaaauggugacaccuaagaggagguuaagaaauugugcacugaaucucagguuuugcaagaaugaaugaccaggcuuucucuacccugacagcaucaucaagaggaaggugagaggugggcugcgccugagcucugguguguaucggcuaucauuaugugauguggccaagagagaugcugccgcaacaacuguuacuaagauuacuagggaggacucggccaagaugagguuagcccaccacagccuauuucuuuugcugauagcaaccaaacucagugggcagauuaccugaggacucagaaaaguaaagaaaagcuggcagauugugaagugaaagccuggaguagcaaccugagugggggaugagagggguaaguuucucauuguucuuuuccuuuuuuuuuuucugagaccgagucucgcucuguugccaggcuggagcgcaguggcgcgaucucaguucacugcagccucugccuggguucaagcaguucugccucagccuccugaguagcugggacuacaggcgcacaccaccacgccaggcuaauuuuuguguuuuuaguagagauggggguuucaccauguuggccaagcuagucuugaacuccugaccuugugauccgcccgccucggccucccaaagugcugggauuacaggcgugagccaccgcgcccggccucauuguucuuuucuaucuggcuuugagccaaaggcaagcuuucagcagagcugcaguggugguacagagguagcaaaaauccaagagaaaucucauccuuccagccagaaggucaggaaaauguaagcuggagaguguguguguguugggggaaugcuuuccuuuuuuaaucacagugggcagaauccuuggagucuuuaaaauucugugaagcagagagauaaucucauacuuaugcaaaagguguaaggcaaccauaauguuaguauucuaacuccaagggaauuuuaccagcaugcagauguucaggcuugcaugucaggcuguggcccagccucaaaguuuguguacccuuccugcugcguaguccugauccugggauuugcauuuuguucugauggauggggagcuuugagaaaauccaccuuucucuaauacaagguaaaagcuuucucccuucuguaggcgccuuugcugcccuuucuuuuaauuaaauauuuuuuccucccuaauguugggagagcuuccuaaaggucacaauugaaaagagcugcagaagggagaugcagauuauaguaguauucugucuugucauggggaaaauugucuuguuaauuguucugccucugaaaaauguuuucuuauuucuccauucugguuaaaauugucaggauuggaaagaaggaauuuuugcuaacauggggccaugaugccauucauuugaugucugaggagcaauagaaagcaguucagcuagaaaagaagggcaugccagccaaacagcuuucaaaugucaugcauuguguggcaggaguagguuuuaaauauaaugcauguacuuguccuuauugcaaacaaugccgucuuauuccaucuacaaaauauuugcacuugaauucucuaaguacaaauuuugcaguaguugucauuugcuuucuauggacuuuaagaaugcugcuugcacaagugcugugggugcucacuucuuuuucauguuaauguugccauguggaagugcucuuauuuuauuuuauuuuauuuuuauuuuugagauggagucuugcgcuguccacccaggcuggagugcaguggcgcaaccucggcucacugcaaccuccaccuccuggguucaagugauucuccugccucagccuccccaguagcugggauuacaggcaccugccaccauguccaguuaauuuuuguauuuuuaguagagacgggguuucaccauuuuagccaggcuggucucaaacuccugaccucaaaugaucugcccaccuuggccucccaaagugcugggauuacaggcaugagccaccuuacacggccauguguaagugcucuuaaagauacagaaaauaagccaggcgcgguggcucaccugaggucaggaguuccagaccagccugaccaacacggagaaaccccguauauacuaaaaauacaaacuuagcugggcaugguggugugugccugaaaucccagcuacucaggaggcugaggcaggagaaucacuugaacccgggaggcagagguuguggugagccaagauggcgccauuguacuccagucugggcaacaagagugaaacuccgucucaaaaaaaaaaaagauacagaaaauauuuuuuagcugagugggguggugugugccuguagccuaagcuacuugggaggcgacagagcaaaacuccaucuccaaaaaaagaaaaagaaaaagaugcaauuuuuucauagaaaaauucacccaggccacaaaugagaaaagauaggcauuuuauagacucuucaucggggaagaacugaaaaggagaauaaauucaaaagaggagcuucagaugcuggaaagcuagagaagcauacaugaaaucauuuucugucagguaaaguguauaugcagaaaaagacuuuucagaugcauggcccagugauucauuccucaccauuuggucagugugugcauauagacugucuccauauaagguaggugcuuaaaaggaagagaauuuugguagguccauuuguuuuuuaauacaaaauggcaaaucaaacagcuuuuacugguuagggcuggaguuuggcccuuuucuuauaaaaacaaguaaaaaguuauguggagauuauaucuugugucuuacgaaauuuggccuaauuucauuuacagcuuuucaugacaaggagaguaaggucguaauucagucaaggggcuugaaugaugugauaugaggagcuuuuaugaaggcauacauagcuuuaugaaguuacagcugcccaucuguaagucagagcaaguacuaaugaaagugcagugagaauugaaauccauuucagaauugugagguggugugagaagaggggauguucugccagaugauggcauuaacccuuuaguuaacaaggauaggugcuuagaggcuuaaaccagaugaucuacaugcuuuaagagaaauaguauuguuucaaccaaauuucuaauuugccuccuuggauuuauauugugcaaccaacuuguaaaggcaucaguaagaaaguucuaaaagcagaaaagaacacuauccuuuuaaaaccucuauuuuuuuuucuuuuuuuuuugagauggagucucgcucggucacccaggcuagagugcaguggugugaucucagcuaacugcaagcuccgccucccugguucacgccauucuccugccucagccucccgaguagcugggacuacaggcacccaccaccacgccuggcuaauuuuuuguauuuuuaguagagacgggguuucaccauguuagccaagauggucucgaucuccugaccuugugauccacccaccuuggccucccaaagugcugggauuacaggugugaaccacugcgcccagccuaaaaccucuauuuugaggcauggaaaagguguuuaaaaaaucaagacucuuuugaacuuguuguaugcauuaaaauguaauugcauacaaaagaacugcuuaagacuuugcaauucuauuuuucuaaguuuugcuacaauaaauagucauguauugcuuaauggggauauagucugagaaacaugucguuaggugacuugucauugugcaauaccauagaggguacuuacauaaaccuagaugguguagccuacuguacacccaggcgguaugguauaacauauugcuccugggcuacaaaccuguacagcauguuacgguacuggauacuguagacaguuauaucacaaugguaaguauuugugugucuaaacauaaaaaagguacaguaaaauuacuguguauaggaugagaaaugguaaaccuguauggggugcuuuccaugaauggagcuugcaggacugaaaguugcucugagugagucagugagugaguggugagugaauaggaaggccuaggacauuacuguacacuacuauagacuuuauaaacacuguacacuuaggcuacacuaaacuuaugcuuuuuuuaaauaauuagcccuaguuuacuguaauuuucuuacuuuauaaacuuuuaaauauuuuuaccuuuuugacucuuguaauaacacuuagcuuaaaacaaacacauuguacagcuguaccaaaauauaucuuuauaagcuuuuguuuucuauuuuaaaaauacuuuucuacuuuuaaaagauuuuucuuaaaaaugaagacacaaacaauuacauccauuagccuaggccuacacagggucaggaucaucaauaguaagcggugaagccagcuggacuuacuggguugaguggggacuuggagaacuuuucugucuagcuagaggauuguaaaugcaccaaucagcacucugugucuagcuaaaggauugaaaaugcaccaaucagcacucuguaaaaaaaacgcaccaaucagcgcucugugucuaguuagauuguagaugcaccaaugagcacucuguaaaaacacaccaaucagcacucugugucuagcugaaggauuguaaaaaacaccaaucagcacucuguaaaaaugcaccaaucagcacucuguguuuagcuaaaggauuauaaaugcacugaucagcacucuguaaaaaugcaccaaucaguggucugugucuagcuaaaugauuguaaaugcaccaaucagcacucuguaaauggaccaauuagcacucuguaaaauggaccaaucaguaggacgugggcagggccaaauaagggaauaaaagcuggucaccccagccagcagcagcaacccacuggagucccuuuccauucuguggaagcuuuguucuuucacucuucacaauaagucuugcugcugcacacucuuugggucugcacuaccuuuaugagcuguaacacucaccacgagggucugcggcuucauuccugaagucagcgagaccacgaacccaccgggagaaacaaacaacucuggacgcacuaccuuuaaaaacuguaacacucacugcgaagguauguggcuucacuucugaagucagggagaccacgaacccaccggaaggaagaaacucgacacaucugaacaucugaaggaacaaacucuggacacaccaucuuuaagaacuguaacacaccgcgacggucugcggcuucauucuugaaguuagugagaccgagaacccacaagaaggaauaaauuccggacacaauaucacugucuuccaccuccacaucuuguaccacuggaaggacuuuagggucagcaaaaugcauggagcugucaucuccuauguaacaaugccuucuuuuggaauagcuccugaaggaccugcuugaggcuuacaguuagcuuuuuuaagaaguaaguagaaugacuguacucuaaaauaaugguaaaaaguauaauauaguaaauacauaaaccauuuaguaucauugucaguauuauguaguguacauaauuguaugugcuggacuuuuauaugacugguaauguaguagguuuguuuacaucaguaucgccacagaccugugaauaaugcugugcacuaugacauuauuuucagcuccauuauaaccuuaugggaccacuguuguaaauaugguccauuguugaccaaaaugguauguggugcauuacuuaguugcuagacaauggaguuuuuaauaauuuuagaaccuuaggcuuacuggccaggcucaguggcucaauccuguaaucccagcacuuugggaggcugagguggguggaucacuugaggucaggaguucgagaccugccuggccaacauggugaaacccugucucuacuaaaaauacaaaaauuagcugggugugguggcaugcaccuguagucacagcuacuugagagacucaggcaggagaauugcuugaacugggagauggagguugcaauaagcugaucgcaguacugcacuccggccuggaugacauagcaagacccugucucaaaaaaaaaaaaaaaacaaaaaaaaaaucauacugaaaucacuuaucuugguuaauuggcaucuuacgagaauggguaguuauguggggauagggacauuaccugaaaaaucuuaggugauugauauuuucucuuuugaaaugucauucuuuggggaaucugcuuaacuuuauggaacagggaugagaucuccaugcuguuuaaaaugggguggugguguuugcuuugcuuuguuucauuuuguaugagagcucaguucuaggcuuuuggaugaauuguuaauaggugaacagaguggguggauuugagacgggugguuggauucauuguaggugagaagcuuugucaaaugauaccuuuuuuuuucccccuugagacagagucucauucugucauccaggaaugcaguggcauaaucacagcucauuacagccuugaccuccccaggcugaggugauccucccaccucagccuccugaguagcuuggacuacagggaugugccaccaugccuggcuaauuuuugguacuuuuuuguagagaugggguuuugccauguuguccgggcugaucuugaauuccugggcucuaguaauccacccaccuuggccucccaaagugcugcaauuacaggcgugugccaccacacguggguguuggcaagugauauuuuggugaaccugaguuauuuagaagguaauggucuagaacucugaaugugaagaagaaacaaaccuuuuguuuuugaccaaacgguuacgcugguuuaaaauggaccacucaccagagaagggaauucucugaguauuuaauuuguuucugauuacauacuccauagcauacaagcaggcagagacacuuggcuuuaguuaguggagaaaaguuuguugacuggaucaaaaacuccuguugguaauauuuuuuaaagauucagguuacauuuuguagcccaggagauaaauauugcugagauacuuuugacugaagugugguaugaagggaaagggggaaauuuguaagaaaaaagagucauguggccacaugcagagaaucaaguaccaggaagcagauaauugaccaggugagauggagaggucaguacccaugcgagcccaacucagugucuauuaguauuguaaguuuacuacauaauaagauuuuuaaaagucuguuguuuuguugaucugauaguacugugcacuucauucuaaugcagaaccuaggagagauaaguugcuuuccgguuuuguuuuuguuuuuguuuuuugagauggaguuuugcucuuguugcccaggcuggagugcaauggcacgaucuuggcucacuguaaccgaguagcuggaauuacaggcgugcaccaccaugcccagcuaauuuuguauuuuuaguagagacgggguuucuccauguuggucaggcuggucucgaacuccugaccucaggcgauccgcccaccuuggccucccaaagugcugggauuacaggcaugagccaccgcgcccagccgcuuuccaguuuuaugucacauaaugguuacuguucagaucugaggguguauuauuugaaggaaaguuaagagugcaucuaaggagccaggaauguacugucuccaauuguugauucugcuaacgaaugguaauuacucuuucaugccucucauuuuuaucauuuuaucuuugaaauaaaauaacaccuaugagaaagauauaaggacuuggagaaggaaagggauggagugaagauccgugugagacgugucauugaacauuagcuuuguggguugguuuaccuuuuugucuguuagagucucucuacccacuuuuuuuucccucauguguugcuguuucugagcaagacugagagcugacaacuguuacuuuuuuauucuuagcuccuaaagaccgaggguggaauuuuuaguuaguuuaauuucccaaauuauccuaaaacagugagauuguauuauaauaaaacauuuuuggauauuuuguggaauuuuuuuauuuuuuuuuauuuuuugagauggagucucgcucugucacccaggcuggagugcaguggugcgaucucggcucacugcaagcuccgccucccggguucacgcuauucuccugccucagccucccgaguagcuggacuacaggugcccgccaccgcaccuggcuaauuuuuuguauuuuuaguagaggugggguuucacuguguuagccaagauggucucgaucuccugaccucgugacccgccugccuuggccuccgaaagugcugggauuacaggcgugagccacugcgcccggccuauuuuguggaauuuuuuaaaaagugcuccuuuguuaucuuuuuccuuaugauaacagcuuugaaugggauuugacugugauccuuuguuguugcucaucuucauggaaagccaguuuucccagcuuuuagaagggagacacacuguuaaggacagcuuuucaggcuucaggacucuagaguaccagaagucuucuguugucuugaagugauuaaaaagauggucccugcuucucaaauccggcaccccucacccccuguaucugacccuuccuuucuguuuaucuuuuauuauuccucuucugcucaauuugaauucugcccccaggaguuuuucuucagaguggaguuuugucuggcaaaagagcuuuuggccaguuaguuuugagaggucaaggggccacauucucagcuccuucagccuuagcugcaaauuccuugaacucaccagcuguuggaguagacccaacauauuuagccgcuguucccagaugggcccgcugaacuuuccaguugagugccuguuguuuguuuugggaugcccaggucugucagaugcugcauugaucccaucucugcuuccucucacagacacugguaccuaccuuacaggucuugugacuauuggugauuuguaccuguucaucuuugggacuuuguggagauacuuugucaccuaggcuuuuguggcuguuucccauggauuuuugauuuuguuacccuaguugcucuuuguauuuuuuaucaggggaccugggaaaaccauacugcugcugcugccaucuucccagaauccucaaacgugguuuuuguuuuuguuuuuuuuuuuuuuuuuaaugagauggaguuucgcucuuguugcuuaagcuggagugcaauggcacaaucuuggcucacuguaaucucugccuccuggguucaagcaauccuccugccucagccucccaaguagcugggguuacaggugcgugccaccacgccuggcuaauuuuucauauuuuuaguagagaugggguuuugccauguuggccaggcuggucucaaauuccugaccucaggugauccgcccauguuggccucccagagugcugggauugcaggcgugagccacugugcccagcuaaauguguuuuucuuuuuuaaaauuucccauuguugaucuccccggguuuuguuuugaacagcuguuaucucuugguuagaagcacguucuuugcuaauaccaaggcaggggauaaugugaguucccucuguucuugagguugggaagagucagcaggcggaagauagcagccguuccuucaguaggcucaucucaggccgugagucuacaucuagagcagaacuguuucucgcucauggguccucguacauacucuucccucagccugugaugucauccuccugcuucccacuggcucacaagccugguccugaagaugucccccauucccccuucucccccauuggugauguuuuuucugugcuuccguaacaucuugugaauguuuuauaguagcugauaucacacuauauauguuuacuucuccguguuucccacagcacugugaguucuugaggccugggcccuuggcuuauuggucuuuguauucccaaugccugauccagugcuggaagucaguaacuacucaggaaacacuguuaaaugaauauuggcaauuuaguggugcaaggagcaaaaguagcucucuguggacauauugcaggacagacaaauguaacaauaagugccacuuagaguuguacuuaaagaaauaaguuuauccugggaaggaacuaucaaggugacuguuuuuauuuucauuuuauuuaaaacauuuggccaggcccaguggcucacacuuguaauccuagcacuuugggaggccaaggcagauggauuacuugagaucaggaguuugagaccagccuggccaacauggugaaaccccaccucugcuaaaaauacaaauauuagcugggcgugguggcgcgcgccuguaaucccagcuacucaggaggcugagacaugagaaucgcuugaacccaggaggcagagguugcagugagccaagauugcgccauugcacuccagccggggcgacagagugagacucugucucaaaaaacaaacaaacaaacaaaaaaaccacugugauaggaggagacacuggucagguccuuaguaugcuacauucauuuugauuauaaccauuaaaaaagcugguggggaauuuaggaaauuuaaaacagaccaugacaaugauuaagaaauuggaaauuugugcuuauaaaggaaaaaauaaugguuaacuuaggugaagaguaaacauaaccccagaaccuagccguaggacagacuggugcaaugugauuucugcauguucuugcuugagggcagaggcuugaccuaucuagguuccuucuaguucaguaaugcuuuacuuguuaaaguucucuuccucuggcgacuugagaguuuggaaaauaucuucaagugggccagaagacagcuauuuaauggucugauuuuucuggaaaguggaaugugaugacauuaaaaccugagugacuaaggaaaccagacuuacgcugguagauaagagaguugaaaauuuaacugagacagagacaaaagaaaaucuggccauuugcagcauuaagcauaugcagugaaaucccagcaaaaauggaacagagaggcagauguaccugaagcaucccuuuccgccuucagaaaaacaguaaauggucaguggcaaugguucagguaaauauauuuugcacaccaagaucacccagaaaugcucaggguauuuauauaaagauauuuuuuauacagaugaccuuuaaucauaugauuuaacaaaggaaauguuuuacuuauaggccuucuaguugugucacuacuuauugugugugucuguggauuaaauagauuggcaaagcaaaacgguaucuuuucucucagaucauaaccacgucaagaagcaaauugucuuuauauaggaccauuuaaugccuucuuuacuagaaaaguuguugaugguaaucuagcucauagacuuuaccugggaguugggacuugcaaaauggcuuaauuugguaauuuccaaaccuuguuaaaaagcuucagaagucccaaauucuuauaagaagcucauuuuuuaaagcagauaaaaugaaacugauucuauugccauuucccccuuccuuucuacaaggacucccuaaaaggaccuccacaaacuguaguuuaaaaucacuaauuaguccaauaaaaguuacuccagucuaauuucccaaauuauccuuaagucauugaagcauagaacucgcaaggucuugacuuugagaaaucccauagucugucccuggugugggcugccuacagaugcaaauuaccuuccugugccuuccaguuuuagccgacuuggaagcaaaaugacacacaugagaaagauauaaggacuuagggaaagagagagauggaaugagaggccugugagaugagugguugaacagcugcacugaggguugaguucccauuuucuugguugugggaugccucucuccucccuuccccucugcuuuuuccauauacugaccacaaggaaggacagcuguauauacuucuuuugcuagagaaacaguugaauuugacuaucauguggaucauuuuauucccauucuuaauggccacaguauuuuggagcccaauuauuuauuauuauguacauuguucugggaucaagagauaauucacauauaugccauauacugcauuuauuaauuuuuucaaauaugaucaugcauaucuuauuuaauauacaacauauauuuuauuuaauacacaaagacaaauggaaacgcccuuuuuuguauauccguauccuuuuuuauucaauguuuuauugaaauuucacuucuugaaagaauuguuuuugcuagcguaguucccccugccuuuuuuuccuuuuucguauaggccuaguaaacaaaguuuuuuuugagacagagucuugcucugucacccaggcuggagugcaguggcaugaucauagcuuacugcagccuugagcucuugggcucaaguaauccucuugccuaggccucccaaagugcagguauuauaggaaugagccaccaugcccggcccuagcacacuuuucaaauaucgaaaacugucauugaauucuuuaauuaugaugguuuaugaguuuuucuauuguuaaaaagauaauguuuuuuaauagugaaaaaaguaguguaaguuguugcuuaugguccaaaugauuauauaagauaaaaaugaccuuaauagguuuacaaauauaaaaguuggcaauuaacuauuaaucaguuauauauuuuaaagcucaguaacauuaaacauuuugaaaugggcugaauuaguauuauuuuucaguuauacacauuguaaaauuuuaauugagaauauuugacauuaguaaucacugugauuaguuuuuggugacuuuuuuguuggaggguuuccuuaaauguguucuuucucauuucuuucuauucuaccuauucaccucuaugauauaauuuaccuuuugugaggaacauaggaggugggugaaaaauggugugaauguuuuugaacuccuuacuagcuucaaaacaggaaagccuuuucuauaccuuuuugcuccagaagaaaguagaaccagggaccugcaaaaacuagguucuuaaacauaaaaggcuuuaaauaggaucuguugucugguuguuauauguuauuaguauuaauaacuucugaaauuuuacuggcucaucugaaggcucuuggugauagagauaaucuguaaguauucucuuggcaacuucuuuuauuuauuuauuuauuuuggaaagaaaagguaggauauuuaaugaauaagguuguccaaauauacuguucauaggugggccaguuaaauuaagcagauuauaaauuaauguaaauuauuguuuauuuauuguaaguuaaauaggaugguagcuucaguaaguaaaucuuuuuauuguuucuguuaagcauaugguuccuuuugucuagucagucuaauccauauuaaagguaggggcuugaaguuucuaacuauuauuguuaaacuuucuauucucccuucuauucugucaguuuuugcuucauauauugugaagcuguguuccuaggagcauauguuuauauguucauaauuauuauguuucuuuuuuuucuuuuaagagacaggguuucacuccauugcccaggcuggaguacagugucaugaucauagcucacuguaacuucaaacucuugggcucaagugcuaggacuacagguucaugccaccaugcucagcuaauuuuuuauuuuuauuuuuguagcaaugcucucuauguugcucaggcugaucucaaacuccuggccucaagcgacccucccuaccuuggccucccaaagcauugggauuacaggcaugaaccacugugccuggcccuauuguuauaucuuuuugauugaccuuuuuauuauuauguaacagccuucuuggucuuuauaacgauuuuuguuuuaaagucuauuuugucugauauuuauguagucaugcuagcucuuuaguguuugcauagaauuuuuuuaugcuuuuucuuuauuuuacugcuacuuguaucuuugaaucuaaagugaaucuccuguagacagcuguaguuggauauugauuuuuuaaaaaaaucuauguuauaggcccagcaauacaauuauacacauauuguuuuauagaauugcuuuuaaaaucaguaaagggaagacaagagaagaaauaugcauuuaugugauauuuuauaguuacauaauuacugguuuuuucauguggauuuguuuuuuucauguggauuugaauugcuguuuaggaccacuuguuuuuaguuugaagaacuuuguuaguguaucuuguaaggugggccuguuagagcaaauuuucuuacguuuuguuuaucugggaaugucuuuuuuucacccucacuuuugaaagauagcuuuuuuguauguaggauucuuggcugacaguuuauuuuuuuuccuagcaacacuuugaauauguuauauuauugccuucuggcuuccguugauucugaugagaaguuagccauuaauuuucuuuggguugccuugugaugaguugguuuuuccuuuuucuugauuuucaguguuuucucgauggucugugugugugugugugugugugcgcgcgcgcacgugugaguguguguuuuaauuuuaucuuaacaaaauggagugggucugcagaauccuuguuuuuggcuuuuagcuuuuuuauuauguaucuaugaaucucuuugcauauacacuagaaguucauugagcuucuuggauguauaaagguuuuucaucggcuaggcacgguggcucacgccuguaaucccaucacuuugggaggcugaagcgggcagaucacgaggucaggagauugagacuauccuggcuaacacggugaaacccugucucuacuauaaauacaaaaaauuagccugccaugguggcacacgccuguggucccagcuacuugggaagcugaggcagaagaaugacuugaacccgggaggcggagguugcagcgagccgagauugugccacugcacuccagccugggugacagagcaagacucugucucaaaaaaaaaaaaaaaaaaaaaaagguuuuucaucaacuuugggaaguuuucaggcauuauuuuucuucuuuuuuuuuuucuuuuuaagagacacggucuugcucugucccccaggcuucagugcaguggcacaaucacagcucacugcagccucaaacuccugggucagcugauccuaucaccucagccuccugaguagcugggacaacagagguacaccaccauaccuggcuaauuuuuaucuuuuucguggagauagggucuugcuauguugccuaggcuggucuugaacuccuggccucaagcaauccuucugccuuggcuucccaaagugcugggauuacagaagugagccauggugccaggcccacccauuauuuucgacuauuuuuuucuccugugauaggugauuuuuucuuccaagaauuuugauagguuuaaauucuaaucugcaguaccucugagugugaucuuauuuggaaauagguuguuugcagauguaaucaaagauaaaguaaggucuuacuugauuaagguaggcccuaauccaguauaacucauguccucauaagaauggagaagaugcacacccauagaggagaaaaugccaugugaaaauggcaaaggaaggaaugcuaagguugccagcaaccacuagaagcuggagaaggucauggaauagauucucccucagaacuuccagaaagagccaacccuaccaauacccagauuucagauuucuagccuccagaacugagagagaaaaacauuucugugguuuuaagccaucuaauuugugauacuuuguuauggcagcuguaggaaaguaauacgguaccaggaaaugggguguugcucuaaccaauaccuaaaaguguggaaguggcuuuggaauuguguagugaguaaaagcuggaagaauuuuaaggugcaugauagaagcagccuacguugucuugaagauacuguugguagaaauauggacauuaaaggcgacucuggguaggucucagauggaaaugaggaacauguuaauggacacuagaggaaaagcgugccugguuugaaaguggcagagaauuuggcugaauuauguucuguacaguucuaauaugaauauguaaggggccgucggcucuucuguuuggagaaugacauggaguuaucaugacaauucuuauuauuagaaaguugauucauuuuuuuauuucauuuuuucauuuucauucugcagagcaggugaggucaaaaaugacccuugccuauuggaaaagcugcaaaacauuaagcuacucuuucuaguugaaaaucucaauuuguuuuaaauggauuugugugugugugucauuggacaagauaauagcucggcaguaguuugauuauauaauaggucuucagcuuauuaaucuaaauggauuccuguuaaucucugaacaaugcaaccagugaccgauguccagguaugaacuauuacagugaaaaccaccagacuaauuuuguaacaauauuuauaugaaaaugaugccuuuaucuuuauaguuuucaccuuguuuucugaucaguauuuuauuugcucuguucuuuuucuccauauugaggcuuugcauauuuuuauuuugucucacaucuuugcacaaugaaccuauaaaaccucuaguuuuuaagauacaucuuucaguuacaucaaaugucuucuaaacuuuuuuauuauuauauuacuucuuacuacucucuugugaaugaaggcuaaugacaacucugucucugcauuuguguagggguaaugagauccuuguucagugguucuucuaauuuggggacuggugaguuauucauaugcauaaggaucagccuauuauaaacacuuggcaggaccauuaauucgguuuaggucucccacuuuccauuucagugcuuguuucacugcauuaaucguuccuuagguguuuuagaucauaauccucuuuuagaucaagguaauuauuuugcccagauuuacauuuuugccauguguuacagcuguguucagagguuuuauagguuuuauacugacuggagaagccucucugaacucuguucacccaaugggccaacaaaagaauauugaauuuucccagacaaaacccugcugguguuuucagcucuaguucugucccgcaaauucucaucaguuacaaggcuguuuuuuuuuuuuuugagacggagucucgcucuguugcccgggcuggauugcaauggcgugaucuugacucacugcaaacuccgccuccuggauucacgccauucuccugccucagccuccugaguagcugggacuacaggugcccgccaccaugcccaguuaauuuuuuguauuuuuaguagagaugggguuucaccauguuagccaggauggucucgaucuccucaccuugugaucugcccuccucggccucccaaaguguugggauuacaggugugagccaccgugccuggccaaggcuauuuucuguagaauguuccugguauuuguuauuuacauagcagauucuauuauaucucuuuaaucugccagcaucuuuugguucugagaaacuugcaggaaugcucuaguuuucaggcagucuuugcagucccuagaucauaauguagaacgccaucuuuuuguuuugacagggaggcuuaugaugauauuugugggcugaacgugaucuugaaaggccaauuagucuauuucaugaaaguguaugaaaguugauucaggugaggauuauugacuaguguuaaauuuguuaagugaaugguuggggaacuagaaauuuacaguggaucaaauaacacugcacaaacaauuuccucgaugaaagagggaagacauaucuguacagugggugaguggaucagacuucauuauccaaacccugugguccaucuuaguuauuauauauagugcuuauguuuguucagccaucuuaugugcuguaacaaaggguucaaagcagcaucuguauuuuagccaaaaauauuuagcuugacuccauugagcacuuacauuuuuaagauuaguuuauagauaauauuggagauaaaaaaaaucuguaaauaauaccaugaggaagcaaacagaccuagccuggccuugucaauaagucagggucguaaaaauagggacugugcuagauucaaagagacuuaaggaauaaacaauuagauacaauuccugguccuggauuggauacugucuuggaaaaaccagcuguauaggacauuuuuuggguuacggaaauuuggaacuagccuggauguuauaugaaaugaaauuuauuaaguggagagaugaagaauauuuuuuaaaaaucuagugaccaaaaagaaguauauauaaauauauacauagaaaaagaucuggaaguauguguacugagggguuagugguacucugugggugagggaauuugggguuuuuauauauuuuaguuuugcuugucuuuuccuccuaauuuucuccagugcauauguccugcuucuguguuaauaaaagcucauuauuuuuuuuaaguccacacuaacccauccuauacagaugaguuguuuuaauaauuuuacucauuuuuuucuugauaaggauuuuguaauguuugggacacaucuuugaaccaugucuuuagauucuacaugcaucucuguuuuaaaaauuuaauauucuauuaugaaaaaauuuaaauacaugcaaaaguagauagaauaauaauacagugauuuuccauguacccaucauccagcuucagcaauuaccaauuaaguauaguauauuucaugucuauccaccauuccucuccacccacuauuuuggagcaaaccucacauguccuaucuuuucauccauaaagaguucaguguuuauaucuaaaaguuaacaacacuuuaaaaaauugcaauaccaguauuauaacaaacaaacaauaaauuagugguauuuccuuaauauaaucaaauauccagucauuauuuacuuuuucccaguugucucauagucauuauuuucucuagauuguucaaaucaguacaaauaaguucccuacauuacaacugauuaugccuuaagcucuuuugguuuauagguuucuccauccucucccaccauuuuuuucucuuucaguuuauuuauugaagaaacuggguuccuuaucuucuagaauuguucacauugugcaucuuucugcaugcucucuuaaccuuucagugcccaauacuggaaacuguucucuagcaugcaucugagcaggguuccuauuuaaaaaucuauacaacauagucaguuguaauacagggaacuuuuuuauacccaagcuuuucuauugaauuaagauuuugugcuagcuuuuuucuaggagcauuguguauguguguguguccacauguauacaacuaguugcucacacagacgcuaccugaacaaucacacaggcaaguuguagaaauugagccuggagagugcuaagagaguaccugagagggcacucacagaaggcuaucaagggcaaaugaaguggccuugacuuugucaguaauuugucuccucucaauauuuaaaaauagauuugagucaauauauaacaucagaauguucauuaaucaccuaucuggaugguucuggucauaacauguauuuauuucaaacucaaguuguuaauaagaaguacuaaaacaaauguagauguggaaugguuuucauuauucuagaguauggaaucuuauguauaaauguaguaccauguaaauucacacuccauuucacaagucauugucccucacuauauguaauaguguuuuccuaguaauauauguuuaaguuaaauaguuuuaaauaaugucauacuuucauugcucuaaaaaauuaaauaaagcuuuuaaacauguuuauggaauguguuuguaaaauccauauccauaaauugaaagggagaguugauuuccauccugaaguccuuugaguuuaagaugcuuacagccuugauuauuucaacuggaugaagcaacuauugaaauaggauacauagggauaaauuuuagagaucagcuacacaaauguuuaggcagcugcuugcuagauuuccuuuucaaugauuacuggaaaguucacccuaaaagaacacucugguauagugugauucucuuaaaauaauauuuaauaucuucagacagcuuggucuauugcuuuuuauuguuauguccauguacuuuuuuguuuuacugggaagucuacuaaggucaggauuuccacugcuuacuuauugauuugucucuaaugauugcagguugaagaugacagcgaugcagagaccuauggagaagagaaugaugaacagggaaauuauucuaaaagaaagauugucucuaacugggaucgauaucaagauauugaaaaagaggucaauaaugaaaguggagagucacagaggggaacagauuucaguguccuccuuagcucugcagguaugaauuccaguugcaugcauacuguuuagugcucugaaaguugcacagacauuuuauauauguuuuuaaauucuacuuuuauaacuagcaauuuauccuuuguucuuuggauuuuuaauucaaguaaaggacaguguuucuaauggcuuguaagggaaaaaaaugaguuuaaguggaaguaaggguuuccauguaccgauguagaaugacuaaagucuuugcgauagauaaaaggcuuucuauaaguggaaaaagcugagccaugcugcuguaaauuugauagucugagaaacauaaauguuuucuuugauauuggaggaaacauuccuuauauuuguaggaagcauuauaaaguuucuagaauauauguucucuuuuuuuuccuuuuuuuaaguagccagguauauacauaguaguggauaugcacauauuggagcuauaugcacuugaacaccaaguuuuuguuuuugcuuuuggauagucuucucugucaauaaagugaaaaacccagccuuuccgugaucagcuguaaucuaagauugauugcaccuugagugaugugaugcuggagagcaguaacagggaagaauggaggagugcuggguguacagauggcugcagggucccuacugagguguggcguaagaguuuaaagaauaacuggaagauagauuagugauuuccagguguuggggaugggagggugggaggcggaugugcuuauaaaggggcagcgugacagaucccugggaugcugacacugauuaguaucuugacugcgguggcagauacacgaaccuacgcaggugauaaaauuguguagaacuuaauauacacacgugugcacaaaugaguaugaauaaauuugaauaagauuggcagauuguaucaguuucagugucagucuucugguugugauauuauauuaugguuuugcaaaauguuaucauugggguaaacugggcaauguguacaagagaucuuucuguauuauuucuuuauaacugugugugaaucugcaauuacgucgcuaaauaauuauugccagguuaaaaagauauaaaggaugcagaugugagaagcagggaaguaaaacaaaaauaauacuuugggacugcuuugaauuuuuucuuccucaugacuuugauguugcuguuuaguucuaccuuucuucuuuaucugccuguauuuuugaaugcuggcaccagacuaagaacaauaaagugaugcauucucuucuaacuuaauagaaugugcuuuuccgagcaggaaagaaguagaucauaaaauugugagucaggagcacaggauucgucauuaccguagaugauucaaauagcauaacuucuuuagguuuguggauugcucucaacucauugacuguucaagaacugguaacacuaaauaauuuuuccuguaaaaugagugcuucccucuugguaccuauauuuuggccaauuauggguuuauaagcacuuuucuucaaggugggagaaggggaaugaagguaaaauaugagcugguuaguuuuaauucucaacagcuguucugccagaagaucuagggggagaaaauugaaguaauacaaugaaauuaacuuguggacuaaaguagauuuaauucaaucaguuguguagucaguuacuaguaucugucaaaaaaaagauacuucauaaauguuggaaggcaguuaaaaauucuaguccaggcugggcaugguggcucacgccuguaaucccagcacuuugggaggccgaggcagguagauugccugaggucaggaguucgagaccauccuggccaacauagugaaaccccguuucuacuaaaaacacaaaaaauuagcugggcgugguggcgggcaccuguaaucccagcuacuagggaggcugaggcaggagaauugcuucagccugggagguggggguuguagugagcugagaucguaccacugcacuccagccugggcaacaagagcaaaacuccgucucaaaaaaaaaaaaaaaaaauucuaguccaaccuagcaggccuguccucugguuuaugauuuugguuauuuauuuuagcauuuuauauauaauuaaaaaccuggcauggauugagucucucauguauuuuucuuguagucucuuugcuuacugauuucuucugaaguggcuuguuuaucugugauugguuuugguuuuuuugguaauugcagcugucuugucuuuugauaugugcuuacauuucuuucccacucuguugcugauuuaucaguuucuucucaggauagcauaagacugagaagagcuuccaugcuuucuucauacucaguguuuuggugcuauauugguuuacuuucgagaggucaacuucauucucugauaauaaaaauucuagaguaugcaguguuuucuagguaagcugaccauacuccuugaaacaauucugcuuucuaguguacuauccuuguuuguauaaauaaauagacaacugagaaaaaauauuguugguuccuuaggugugcaaucauaaacuuuucuagauauugccaaauugcuuuccacgguaaagaugagagaguuccugguguucgucaucucugcaaauagcuaguacuguuggacuuuuaaauugugaccaguugauugaaugguaucuaguguaguuaauucaacagauauuuaaguacccauuguuccagcuauuggcuuagaggcuggacauagaguggugaacagaacagauauagacaccugucucacagaguugacuuucuagaggguagagacaaacaagaagaguauauaaaauguuaaaugcuauaauugcuuagaauagaaauaaaaugaggaagggcuguuaaccaguuuuagaaguagccaggggucuuacugagaauauaacauuugagcaaagaucugaggagggugagggagcaagugaggauaucuaugggaaaagugucccaggcaaagggaauagcaagcucaaaggcuuugagauaggaggauagggaaucgcaaggaaggccaguguggcagaagcaacgugagcgaauaugcgauggggucagaaaggcauuauccagccagaucgcguaguauuguagaccauuguaaagauguuuucuuuuauucugagugagaugaaaaaccagcggaggguuugaagagaagagugauauaacacuccuguguuaacaggaucacucugcuguguuggaaggaacugaagacuggcaagaggggagcggguagacuaguuaggaagccacugcuacuacuaguagcagguagacuaguuaggaagccacuaauaauaauccagguaagcagcgguggugguugcuggguccagaggagagcaguggagguggugaaaagugguuggguuagaucuacguagagagaagagcagagagcacuugcaaaugcuggguaugagagaaaaagauacguaaggaugacacuagguuuugggucugaacagugagaagaagggaguugcccuuaacugagguguguaaguuauaggagguaccaguguugcauguauuaaaagugagaugucacuuugauaccuguugcagucagaauuccuuaauaaauggcuggcacacucaauauaauugaacacuuugacaaaggaaucauuuacaaagguauguguagagucuaaugaaagcacugagguagugcuguguugagagggcaaguagcggcagagauguuaccacccuaguuacuggaaauuugaagggagucauagagaguuggccuugggagaaugaaucaccuucggugaggggacucagccagugaagaugaccccacucugagagagucagaggaauaaacauucucuuccucccucugccaaggcuuccauaagucuaaccuacuggaagccagaagacaagggaaguuguaauccauauuggucaaccuucuaggguagaacagguuggagaaggguggaggauaaaucugcauuggcacauggaagagacccagcacaacaucuaauaggcgacauggagcaggcugcuggauagaggaaugugggguucaggauccaggccuggguuggcaauaauacauuugggugaugccagccuauagaugauauuuaaagucgugagaauguaugagaugacagggggaguuauuaccuagagaaguacugauucccaggcaccacagugucuagaguuuaggggaaagagaagagaccagcaaaggagacugagcaugagugguagaagaaagaaccagagaguguagugucuuuaaguguuuugaagcaggaggagagaucuguaucaaaugcaguugaugacaaugaagaauugacuguuaaauuuaacaggaagguuauuggugaucuucacaagugcaguuuuguuggagugguggcauaaauuuuuucuugaauuuaaaaagaaugugggaagagauguuugagacagcagguauaaaugacuuaauuuuaaggaguuuuguuauaaaggaaaggagaauaaugggcuggugggagaagugagucaagacuuuuuaauuuuuucuuuuuuuggcauuucuuuuguagugacagggucuucuuauguugcuuaggcuggucucgaauuccugggcucaaacaauccugccuuggcuucccaaaguccugggauuacugaugucagccacuaugcuuggccaguuaagacauuuuuuuaaaggugggagaaauaacuacauguuuacuuguugauagauccagaaaaggggacaaaaaucauaaggggaggggugagaauuccuggaucuguguucuuuaguagauaugagcuugauaggaucuauugugcagguggagggauggcccauugcuggggcuugggcaguuuuccaacuguaauuggaggaaaggcagaauauaugggcauagauauggguagauggguagaugucauggaggcuugaggaaguggucuaagaaaaccauggauaaguguuguggaggagguacuggaaguggaaggagagagcagaagguaagaaauaguugucaaggaagugggaaaguauaguuuccuauuuuccaaguaggaaaaugugguauagauguugggugacaauaggggcccacaugaaguugguauucauaaauuuaaggugagaacagguauacuuuucccugacucauauugugcuguaugggugcaggcccagaaagaccggacggaaggguaggacuuaaucaugauuacaguuuagcagagcaaaugcaaugaaaugagagagggaaaaggagaugauuagaaugauugaaaugaauuuaagugggauaaggaaauaagugaagauaugagagaagaugaggggcaguaaaaagauauugggaucacaggacuacagauuuuuucagggcagaaggauuauugaccuucuugagaaagugugaguuggagaggugggaagugguggcuguagauuagaauguuugacguugagauuugguggggcaggggguugcggaugacgguaaugauauagucuuauauaaaaauacgggugugccuggcugugaguugguguggagaccucgucuuuggaguuuuuaguuuacauuuccuuaguuauuacugagguugaacaucuuuguauuuguggugcuugcuuucuuugugaacugcugcucacauucuuugaccauuuggcuauuuuguuucuuauugauuuguggguuaaaaaaaaaguagucuugauacuuaucuuuugauauuuguguuugcagguaucuccugauaugagauucacuucuauagugugucuuucagugcauuguuuuaaauuuuaguugaauuuaucaauuuucuauccuacuguuuaugcuguuuuaugccuuuagaaauccaucuuucucccaagguuaaagauguucuccuauauuuucuagaaguucuaauuuugcuuuuuuuccugaagaauguuacauuuuauuguuugcuacauucuugugccaugguuuucagccccaucggguaauuuaaggucuucucuacgcuguuuauucuaguuagccauucaucuaaucuuuuuucaagcuuuuuagcuuccuugcgauggguucgaacagccuccuuuagcugggagaaguuuguuauuaccagccuuccgaagccuacuucugucagcucaucaaagucauucuccauccagcuuuguucucuugcuagcgaggagcugcguuccuuuggaggacaagaggcgcucugguuuuuagaauuuucagcuuuucugcucugguuucuccccaucuuugugguuuuaucuaccuuuggucuuugaugcuggugaccuacagaugggguuuugguguggauguccuuuuuguugauguugaugcuauuccuuucuguuuguuaguuuuccuucuaacagucaggucccucagcugcaggucuguuggaguuugugggagguccacuccaggcccuguuugccuggguaucaccagcggaggcugcagaacagcaaauauugcaggacagcaaauguugcugccugauccuuccucuggaagcuucgucccagaggggcacccgccuguaugaggugucagucggccccuacugggaguugucucccaguuaggcuacaugggguucagggacccacuugaggaggcagucugucgguucucagaacucaaacacugugcugggagaaccacaccucucuucagagcugucagacagggacguuuaagucugcagaaguuucugcugccguuuguccagcuaugcccugcccccagggguggggucuacagaggcagcaggccuugcuaagcugcagugggcucuguccacuucaagcuuccccagccacaauguuuaccuacucgagucucagcaauggcagacgccccucccccugccaggcugcugccucacaggucuaucucagacugcugcgcuagcagugagcaaggcugugugggugugggacccaccuagccaugugugggauauacuccuggugugccauuugcuaagacuguuggaaaagcgcaguauuugggcggaaguguccagauuuuccagguacagucugucauggcuucccuuggcuaggaaagggaaauccccugaccccuugcgcuuccagggugaggcagcgccccgccccgcuucagcucgcccuccguggccugcacccacuguccaaccaguccgaaugagaugaaccagguaccucaguuggaaaugcagaaaucacugucuucugcauugaucacgcugggagcugcagcagcauuuuaaaaacccaaaugauauaaugucccacuaauggcuuaugaccugcaguuugguguggucugaagcaucugauucauuuagucauuucaguaacuucgaaaaaugucugagcagaaacucuuuaguuuaauuaggucccaccugucaauuuuugguuuuguugcaauugcuuuugaggacuuaaggacucaaaaguuuucccuugguauccaagagggaugguuucaggacgccuguggauaccaaaaucuaggaaugcuaagucucugauauaaaauggcaaaauauuugcauauaaccuaugcaaaaaguauagauaccuuccuuuauauacuuuaaaucaucuuuaaaucacuuauaauaucuaaugcaauguaagugcuauguaaaguuauacuguauuauuuuuuauuuguauuuuuauuguuguauuguuauuuuaaaauaauuuucuuuauucauuuauuuuuagagagacaggguuuuccucugucacccaggcuggagugcaguggcaugaucauagcucacugcagccuugaccuccugggcucaagcaauccuccugccccagccuccugaguaggugggacuauagaggugugccacccacaccuggcugauuucuucauuuuuuuguagagacaggaccuugcuguguugcccaggcuggucuugaauuccuggucucaagugauccucucucuuuggccucccaaagugcugagauuacaggugugagccacugugccuggccaguauuauuauuuuuuauuuuuaaaaaauauuuuugaucuaugguugguuaaaucuaccaauguggaugguugccuguauguuauuuuuuucuucccaaauuagcuggaccucugguccaauucucaaauguuauuuggaagauagaccuuuaucuaagaguacaccuuuaucuaagaguagagaauauagaacuucaagaguagagaauauagcuuaacauauauucucuaaguagauuuccauuguaacagugaauuuuugaagacuuguaauuaaaaagugaauuucuauuucacacacacuguauguauaugucgaugcucacuuuggaagauaguuugccauuuucugauaaaacugaagaucuagcacuuucacccuuaaaggauacucuagagcagagguccccaaccuuuuuggcaccagggaccgguuuuguggaagacaauuuuuccacagaccagggugaggaugacgguuucaggaugauucaagcguguuacauuuauuaugugcuuuauuucuauuauuauuacauugugauauguagugaaauaauuauacaacucaccauaauguagacucaaugggaguccuaagcuuguuuucuugcaacuggauggucccaucugggaaugaugggagacugacagaucaucaggccuuagauucucauaaggagcgugcaaccuggaucccuugcaugugcaguucacaauaggguuuggcuccuaugagaaucgaaugcugcugcugaucugacaggagguggcgcucaggcacuaaugcaagcaguagggaguggcuguaaauagagaagaaucugcucacuugcccaccacucaccuccugcuaugcagcccgguuccuaacaagccacagaccgguacugauccauggucugggggugggggacccccuguucuagagaaacuccagcacgugugugcccaaauguucacagcuguauguucagaagagccucagauggaagcaacgcaaauauucauuaauaguggaaugaauacuuaaauaaguggaugaaucuuuucaacauagcaugaaguaaaagaaacaugcccacagaauucguuaguaugauucuauuauauaaaguucaaacacaggaaaaaaaaacccuauuuuuuaaggauguauauuuaaauacuaaagugacaaucaaggaaaugauuauuccagauaucaugauugcggucaccucuaguggggagaugagguguaaugauugaggagggcccgguagcaggugugguguuggcaguauucuauuuccuggccuggaugauuguuauuuauguugguuuaauaauuauucuauaagcucauauguauuaucaauuuuuuauuuuacagaucucuuuauaaaaggaauaaaacucuuuaaaaguggauuucuaaugguaaaauuucuguuaccaccauagaggugggaaccauuuuuggagaggcagcccuuuccagccugccuccuuccacuugugccacacgggcauugccugcucuguuuguuucugaccacugacagugacacucucauuuuuauuagugguggauaugggaaaggggacgguuguucaaagucauacuuuuucugguaagauugugagucuuuaggugucuuuguagaacucuuucuguuagucucugaaagagauaaucaugccuuuggcuuuucuuuuugaacaguauucuuggcaguucuaaguuacguuucaagagcuuugaaaauggcaccccacucuuaccuucaaacguaaaaaguaagaucuaugagaaauuucuucugcccuucauuuuuuuuccccaaaagucaaaucauugaauucaugcaauaugcauugucuguuccuuucaagaugucacagauagccagaguuagaaaaauguuuaacagugugagcagaaugcacuggaucaauauugaagaaaacguggggaaaauauuaugugcaagucuguaaacacuauuuuuagagauacaaauaaaaacgaaauaaccagacugcaguuuggucaguauaguuguugucugugcauauuuuugcuuaaaacuauuauauauuuucuucaauuuaauuuuaugaaaagcuauuuuggguaggaaauuuuaauuguaaugacauuggaauuucuucccuccucuguuccuugugccaacaauuagacugaagggaaaagaaaggauauuacucuagcagccuguacuuuuaaauuaaaccucgaaccuuuucuuuccaugaggcaacaagacaguuuuauuuguccucauugauucagcucauuuuuuucccucuucuuguaugguauauaguuugugccaauauagucucauauuacaaaggcaauauaguagaagaagauucuucccuuugauauuuaaaacaucugaaauaacacaaacagaacuauaaauuaaaaaauuuguucuggcugacagggcuaaaaaaauuuucaauuggauaaccaaaaaaauaaaaacaaggaaaacuccgauaacaaaaaaacuuuuccuuguagcugaauauugaauauugggccuaauuugauuuucuuuuuucuuuuuuuuugagacggaguccugaucugucgcgcaggcuggagugcaguggcgcaaucucggcucacugcaagcuccgccccccgggcugacgccauucuccucccucagccucccgaguagcugggacuacaggugcccgccaccacgcccagcuaacuguuuuguauuuuuuuaguagagacgggguuucaccuuguuagccaggauggucucaaaucuucugacuucgugaucccccugccuuggccucccagagugcugggauuacaggcgugaaccaucgcgcccggccugauuuucuuuuuaaaaaccuucaaaagauaagagcagaauuugugugcuaaacugcuagucuccagcgccauuuuguguuuucuguuguuuugaagcaauucuuuguuuuugcugguccagcugcaucauuuucaucauccugaacuaucauuuuccugcccugaaguugugcauuuccuuuagcagauccagccuaggcagcuuuauuucccuuucuuuuuccuuuaaaucuaugaccuuuugauucucauuuguuuagagauucuuggugauuuugcaugaguuuuuuucaguguuucuuuuucuaccuuucugucuaguaauuuccacaucucuuccuuguuucuuagucauagguuacaauugcuggcugcuucugcuuuauuuaguguuucuuuagcuuuuuucuuacauagaauuaaucucucuuuugcucuacugauaaaguguauccauuuuauuuccccaugauuugagaaaaggauaugugggugcuuucuacaggucacauuaucuaagucaucccaaaauuucagcaaacauucaaucuagacauuucauuugagcauccucagcacuucuguuuuuuuuuuuuuaaaguuuauuuuuguggguccguaguagauauauauauuuacuggguauaugagauauuuugguacagguaugccaugcauaauaaucacaucauggaaaauuggguauccauccucucaagcauuuaucuuuugcagcacuuccauuuuucuucuugcucuugcuuagcucugaauuuaguuuauacuuuguuuugcuucauucuuguuuugcaaaauaauccuccuugaaaaguguuagaaggucuguauuuuuauaccaggguucagggccagggucucuauaaacuuuuuauuggauuuaauaccgucaaacacugcacguguugauugcuuaaaugcuuuguguaauguuuuucucauuugaauauuuagugcuuguccuuuaucuucuaaucuuuaaaagauuagacauaaaauaauuaugucaucaggaguugcauccauugggaagccuuucauaugaauggaucugguuuuacaucauuuuuuucuacucaucaguugccagagggacauuuuguacuaaucagagggagguuuguuuggaaaaaucuucugauuuuaguuuuaucuguauuuucauuaguucugccuuugauuuguucagugcuucuauuauauuaaaaucuguuguuagguaauuuaaccuguugaauuuuguuauuuccagagguauccagcuuucauccaauuuagucuguuccuuuuaaaaauucgucuuacggcaaauuaaagucaucaaaaugauacuugauuugauggugguagguuucgguccccagagcagccauuguuuucacuaucaccauuuuuggcugcugugguuaucuuuccggucccaggcccccagagccgagccauaggaucgcuagcagagacuguacuuucaaguucacaugaaggacuguuuauuuuuaaauguuuauuauuagauaauuuaagcuaguuauacuggacauggcuuaaugagagaacguuagugaaucuuuucugaguuuaaguuguauuccagauacucuucugguuaucaaaugacuuauauuccaguuacucuucaguuagacaacuggcugcaucaucaaaucaucuggguacuacauucuuuucuuuucuuuuuuuuuucagacagggucucacucugucgcccaugcuggagggcaguggcgugaucucggcucacugcagccucugccucccagguucuagcgauucuccugccuuagccuccugaguagcugggacuauaggcacgcaccucaacgccuggcuaaguuuuuuuuguuuuguuuuguuuuuuuuugagacggagucucacccuguugcccagucuggauugcaacgaugcaaucucggcucacugcaaccucugccucccagguucaagugauucuccugccucagccuccugaguagcugggauuauaggcgcccaccaccacgcccggcuaauuuuguguauuuuuaguagagacgggguuucaccauguuggccaggcuggucucaacuccugaccucaagugauccuccugcuuuggccucccaaagugcugggauuagaggugagccacugaacccggccucaucuggguaccacguucuaauagcaucuaguguauccgucucaauugcuauugucucuucuuuguaugauuaucuuuuagacucauaccucuccuuaaaaaaauuaagauaauuuuagguggguuuugggaaggagagcaaauaaaugcuucugaucaaugucauauuuaauuggaaguugauaaauucucuuuacuugaucuggaaagauaauaaaagguuauuuuugauaaaguccuuaaagaaaaucaggguagaagcucuucuaaaauaaaacacaugaaacaugaauucagagacuaugaaaagggacggcuguaguguuaguauugugguaggaaaggcaucuuuucaguagugugccugaaguguaguauauguguuuaggugguggaauagaaggaacacuuggugggcgucaggggaucuuaguuuugguuuugguugucuuagaaccuuuuuuuuuuuuuuaaacuccaaacaaaaccagcuguuagaaauaauaccuccuugcuuuaaucuagggguaguugugacgaucauguggaauuauuuuacaaauuauaaaguucuauacaaaagcuaagaauuacuuuuuaggugaagagaaacaaacuguuggguuagaauauacugugggucauauuugaaauuaggucauuaacacggggcugucaugaaaauauccaagcaugguacuaacauauauauguaauuagaaaaauaaaugaucauuaacucaucuucucuuuuauuuagcuuuuuuguguguguuugugugggauuuguugaacuauuuuaacuucugcaacuauagaggugauacagggaacuugaaagaugauuaaaaauaagaaaaaacaggauuuaugaugaaagguuuaggaugcuaagcaaaagaagccugagaaaugguuuaauaauuuguguuuuccaagcuguaaagacaaaggaaaaaaaaaucaaaugugcuuaaacuaaaauacaggggauuuagauuagccauuuguguuaugaguguuaacugggcauccaagggauaguugggaaaucaccuuuacugaaaaucuuucaaaauggauuugguuucauuuaauggaaauggguucaacaaugguccuucuugcugcaugggauagagcaaggucauuuaucaaggaguuuuuucaacccuguaauucuguucucuugucuuuuaauuuugcgauaauucuacaguguuuuacuuguguguuaagugagcacacccaguguccucagaaggguuaggcuucauaaauaggcaagacguguguguguaaaugagcccuguggccacuagugacccugcaaccacaggugaccuuaagcuaacaagcugauggcggucaucagugcugucauuuccugaaaccuaccaguugcaggcugugugugagauguguuacacgggcacauucucuauuucauuaaauccuaacuuuaacuuaauaggguagguuucauuaucucuauucuauacauguagaaacuaagccuuagaaauaaaguucaacaauuuguacaaaauucucauaucucuuagguagcagaaucaggauucaaacuuaaguaugccuggcuucaagguuggaauuuuuugcacuugauacuguucauuaaaaucgaaauauauuguugauuaucugaaacuaaaaaaaacuauguuuauuguauaucacugucuaagauacacauuuuuuguuucugcaaaaaaagaagcuguguuguuuacacuuggucugcagcuucagagaagguuugugguugguuaagaagcugccuuugggcuggaggcaggcaccuggacagaagccccaaggcuugggagcugcagccaggccucagggcacugcacugugaggcucccaguuguguuggagggugagucuuuuggccuauggaaguuggucaggugguuuuccuucuugaugcauuucaccuccuuguguagacagucacagagaaugugggucuguguggccauaacccagggcaugcagacccagcaggaccugguuaggguuuuccauggggccagaaagcuuccuaggcauccagggugugaucccacucaucuuggggcagcuucugcaugcagcgcugauuaugaaucuucuaggcaugcuuguuugccaacuuguagcagaagugguuccugccuucuggggccacacuguugcaguugaaacaaaagcccaaagagagaaagagagagauaaauagaggaggccugcagaugcagguggaccaagcagcuggcagcagccuugaccucaguggaauaauucugguagauuugggagcucaugguuggagaaaaaaaccauuguucgcuggccugagaagaaggggaugggcaaagagauggucccagaggcugcagcuggggaggagaguggagcguaaucugaggcuggaguagggaagaccuugagucuguggguuuauuccauccuaacacuguggaggcaagagacugucugguggcuguccauuguuuuucucuuuuccuuuccuggccuuucccuuucccuuccccuuuuguuaaauaaaaagcaagccagcauaauaaaugaauuugaucuuaguuuaucaaaugaaaaaaccuucaaauguaccuuuuccaacagaaaggugacauaugcaaaagaauaaagcacauaugggauacugcauuguacauucuuagucacugucauauguggagugggauggaaagaauauccucacauaauuuguugugagaauacugcacuggucucagaauuuucagugaccugagaauggaauuaaugcuaaugaauuaugaauauauacuguuuaauuuagaggcauugaguggugaggaugucaacauacugcuuuucauaaccuguggugagaauuccucuuggaaaaguaaaucuauauuuuaucuguuuauuuagcacuugaaaagaaccugggcugggcgcgguggcucaugccuguaaucccagcacuuugggaggccgaggugggcggaucacgaggucaggagaucgagaccauccuggcuaacauggugaaaccccaucucuacuaaaaauacaaaacaauuagcugggcaugguggcacgugccuguagucccagcuacucgggcggcugacacaggagaaucgcuugaaccugggaggcggagguugcagugagccaagauugcgccacugcauucaagccuaggugacagagugagacucugucucaaaaaaaacaaaaacaaaaaccugauauagagccuuauggucaugaucuauuauauccuguguauugcacaugaaggaaaauauugucuuuaauaauauuacugcugguuuuuaaaaaaucauuaaguuucagaaagcuugcuuucuuuaccucuuacuuucuagcuaaguagauaauuaaugugguuuuauauuuaccuuuaaaauucuguaguuguagagucuucugccuuguguuuauacagaguuuauaaaaauuuacagugggccgggcgcgguggcuuacgccuguaaucccagcacuuugggaggccgagguggguggaucacgaggucaggagaucgagaccauccuggcuaacauggugaaaccccguuucuacuaaaaauacaaaaauaaauuagccaggcgugguggcaggugccuguagucccagcuacucgggaggcugaggcaggagaauggcgugaacccgggaggcagagcuugcagugagccgagauggcgccacugcacuccagccugggcgacagagcgagaguccaucucaaaaaacaaaaaacaaaaaacaaaaaaaaaaauuuacagugaaaugugagguuuucacaaauaacccugagaaacaaaaaucaacuuaauagaauccuaaauuuguuaugccaucaugaauuucugccuccaugggggaaugcuaugugaguuagaucugucagagagauaucaggcaccugggcuuucuggcauucugcccuugagagaaucaugaaccuuucaguauuagagaagaauccuuagagauaguuuuuucacugaacauuucuugaacuucuauuuuugaacauuuccuagaaauuaauagaaugaagcuuaaaaagauuaagugacugcguacauggccacagaauugggaacaguagucuuuggcuucaaacucaagauuucuagcuuauagguacuuacuuaccaaacacuaaggaaucagguguaucaugcaucaugucaggugcugaggguacagaaaugccuacaacacagugccugccuuucagaauauuguugggagagcugaauugcaguggcccagacugcuccugauggguaugucaagaaugcaaggcucugacugcucuuugucugaauuucucauaguuguguuuccagcaagcaacccugagggaugagguaauaucucccccaggguugcuucuacuuacucaaggaacuuacucuuacugaaaaaggaacacugagcugagggcaugcacucagcucaguguuccuuucugguaacaaaggaacacucagcucaguguuccuucccuguaauaaagcccacagcauguacaggacucuuugaauuaccacucugagacgggggcaaugaggaaccaacaaaaauuaacaugaaguuugacuacuccuuuugccagagacaccuuuugucucuggcccaggugucucaugucuucugcuagcacccaugaaacaguaacaggcuaaccuguuagcuuacagauaagguggaaucucagacccugcauaguuauuggcaaauaucucuugugaggugauauagaugugaggaaaccaacaaauacaguucagugugacagguacagagugcugugggauacagaaugcugugggauaacccaggaaagguucagcuggucaaggucaaggaggcuuuucugauuccacugcucuugaggugaaaauauugguugguucaucucuugaggguagaucuuuucauuguuaguguaugacacaggacauggcacaugguucaugaugacagagcuugcugaaugagugaaugaacuguuauuugugguuauugggugugauuuacugcaucaaaggucccuauguuugcuacuaacguuugucucauuuuuaaagaccgaaguccugggaagauguuuguucuucaaugaaaagcaacucauauagaaaccuacuaugaauaggcugggugcagugccucacaccuguaauccgagcacuuugggaggccaagacggguggaucaccugaggucaggaguuugagaccagcuugaccaacauggagaaacccugucucuacugaaaauacaaaauuagccgggugugauggagcaugccuguaaucugagcuacgcgggaggcugaggcaggagaauugcuugaaccagggagguggagguugcagugagccgagaucaugccauugcacuccagccugagcaacaagagugaaacucugucucaaaaaaaaaaaacccuaccaucaaucuauucuaacaggugaggaaagugacugaguuugcagaauaucuuguauguagauuaacuuaauaaaaugacauuaagguccaauuacuuauuuuguaaacuuuuuauuuucuaauacuuuuuagauuuuucagaagaguuacaaagauaauacagugaauuuccguguacuuucuacccagcuucccuuaauauuauuauuuuauauaaccaugguaucuuuaucaaaacuaagaaauuaacauugguauaccacagacuuuauuugcauuucuccaauuuuuuccacugauguccuuuuucucuucuaacucaggauaccacauuacauuuauucuuuguauuuccuuagucucuucuuauuugugacaguuucucagucuuuucugaaauugacacuuuugaagaguagaccauauuguagaaugucccuuaauuuggguuuuucugauuuuuuuuuuuuucaugaugaggcugagauuauggauucugggggagaauacccuaagaugauguaccuuucuuguuggaucaugucaguggacacaaaauauuuauaggacuuacugcugaugauguuaacucugaucacuuaguuacucuuaguuaccacuuagaaaccuccgucagguuucucccuguaaacucccuguuuuucccuuuccauuuauuguucacuagcagcgagucacuaaguccugcucacacucaagacgaugcgaguaagcuucauccauggaaggaggaauuucugggcauguguuaaaaacaaugacaguaaauaauguuuugaggcuaugcaaagauacuguuuuuccuuaaaaguucaggggaacuaguucucucugaagccaagaauugccuuggacaagaggucaaguuauaaugacuaaauacuugcccuuuuuauuuaugcuuuacugcagaucuaucuguauuauaaauggugcuauucuugugucauugacccuucugucaauuucuuugaagaauggaagcguuuauguuaacugaaugggguuaaugaggguacguuuguaaaacaaggugaaacaucaauaauugauuuuaauuucuuccucauuaaucaguuacaaaaagcuuauuuuaucuuuugucauuuguugguuaccaagaagccauauauauguguguguguguauguguguguauauauauguauauauauauauacacacacauacacacacguguguauauauacacacacacauacacacacacacacacacacacacacacacagaguauggacauauauguauaugguuagcuauaucccaagugauuuauauauccacgucuaaaauccguugcucagaaaaaccugccuuaauguugugcuucuugugcaagagacagucaugguccaugcaguuaagaggugcagucuuucaaaaauuaucccaacaggaguugauggguaggaaggaggcaugucccagugauccaacagucaucccaggacaugcuaaccauuugacugaucucccucagaaguugggauaauucuaagguagccuuuguugcuuuagggguguuguccagaugggcugguccagagagagagagagaaugugguugauguguuuuucgauucauaaggggaaaacaucauggggaaagcaucaugguauuuggauguacaacauaacuacauucuuuacugcuguucuuggaaaugccauaaccuaaacaaauucuuguuuccauuacuaaauucaaaaauuuugagucagugcagugguagauauggguaaacauuuauagcauuuaaaaaaaauuguaaaaucuuaaaaaaggaucaagauuuggcagugcugaguuaauagcagucaaucaaauugaauuugaccauugggacugagauuuggccucuuaaccauauguuauugcuuugcuccagaaaauauuuuaguaguauuaucagaaauacuuccauuuauuuuuuuccuuuuuuaauuuuuauuuuuggcagagcauagcauuugguaauucuuggggucauuacuaggguuuggauugggaugggagagggugugaucuuauaggaauuugaaauugagaaggcagcacugcugaaaaaugcauuagggccaaccucugaauuagauuggcuuaauuuguugggggcagagcugcagaugcagcucuacaucugcagagauguagguguuaacaaauguguuaaaauaacucuuauuuagugcuggguguggugguucaugccuguaaucccagcacuuugggaggcugaggcggguggaucaucugaggucaggaguucaagaccagccuggccaguguggugaaaucuugucucuacuaauaaaaaaaaaaagaaaaaauacaaaaauuagcagggcaugguggcauguaccuguagucccagcuacuagggaggcugaggcaggaggauugcuugaacuugggagguggagguugcagugagcugagguuggagugagccaagaucgcgccacugcacuccagccugggcaacagagugagacuccguuucaaaaacaaaaaaacaaaacuuguuuauagaguaccuggcuagauauuugguauuuuguauacauuuuguuuaaauucaaaauagcccuucaguguuaguauuagacaauuuuauagaugagauaaauuaagcucaaagaaguuagguaacaaggaucacauaacuaguguguaauggaacugcagugugaauuccuuucaaucugauuccaaaacccaugacuauucuuuauauugcacucucgcccccugugguaugcauacaguuggcuaugcagcaguaggcccuuuugguguauuguauagaaaaugagccauuucauuguuugggaaacuuguguuuccuccccuuccccccauuuuuaguaucuguuaaaagaagaaagcuuuuggcuacuuaaaaaaacuugguuauguuuaguuuggugccuuuugaucuggucaugacaaugggagcaauacucuuaugcuugcuacuuguuucauuuaaacugaaaaguccggaaaaaauauauuaguacgcaggagugcuaacuugcaaaugaguuuuucuugacugcuaauaacucaagcaaaaagauaauuauguguuauaaacugugcaugcggaaagugaaaugaaauucauccgcuucauauuuuuuaggaaaauugauaaggcaucgcuguuaauauuuuucacauuaccuuuuggauuucuuaauucagauauuuucucuccacaauuuugagagaaaauuaagagggguugcuguccaaaacuggggagucuuggaaucaaguugugauuguauguuuauauaaaaacucagugugaccucagcaagucacagcauuuuuucaauuugaugaucucuauuuuaaagugagaaaguuuuuacuugcagaguguuucugaauccuauguuaaucuuuuuuaaguucugauuggaggcucuagugauacgauuuuuagggcaggcuacauuuagcuguauuuuuuccauuauauuuugaagucagaaugguauugcaaguuaguaauuuucauacucuuguugauaauguuuugcauaugguacacaugggauuugggaacuaguuaagguccuugccuacacucugcuuagagcaagaaguaauuugggguucuccguguacagauaaugauaaaugggccaaguuguggggcagguuucacuuuagaccuugccucucuuuucugugugucacucccuuuucuuucuuaugugcaugacuaccuacuguagugcccaaggcuuuaauauacucauugaugccuuuugccugaucucccaggauacccauacauguauauuuaauauucguaguuugugcucaugucauauauggccaucagcccacaacaagagaaaucagaggacguguugccugggaggcagcacguuuggagaguucaugugugggacgguacuauaacagccuugcguaaguaaugcaacagguaagguggaaucacguuagagcaggcuguugcacugaggucuugucaaguuaagacauuaccagugcgaugauucuugaaaggugugcugcugacaaaaagauguuauuaaaucuagucugugugggagugugcaugucugucagcuauacaguauaauuccuaaauaagaacuugcugcuccugacauacuuacauacuuuaaugugucuucagcucuacauguuuagguuccuuguaccuauuucuucugugccuaguugcucugagucauacuaguuuacuaugagauaauguuaaacaauaucauggauucaaccaggaugucuuaaaucuucucccuuguuauucucauucuuuuuuuuccuuuacaaucauagugaaaaagugagcugauuauuuuuuaaaacccagaaaccagagauuuaacaaauucauagcuagaacaaguuaguguucaccugaaugguuuucucuaauaccaaucuugaaucucuuggauugcucaugcuauucuaauuaaccagcaguugauaaaagaaaaauauauaagcauauaugcauugcauuuuucuugaccacuggagcuccuuaguguuucucuacauguguccuuuacgauuccugaggaugccuaacgaacuucucuuaguuuaguaaagcugacauguuaugaaccauuggugucuuuuuucucacucuucaggaacauuauagaauguucauucugaaaacagauaacauuugguccaaaucuuucauuuuuuaaaggaggaaaccgaggcucauaaagguugagguuuaacuuaaggccauacaaguauuugugggagaugaauugcucagauaagaguguuuucuguagguucauaaauagugcaguuuuauuugcuugcuuguuuuugagacagggucuugcuuuguugcccaggcuggagugcagccucaaccuccugggcucaugugauccuuccaccucagccuccugaguagcugggauuacagccacacccuagcaugcccggcuaauuuuuguauaugguuuugccauauugcccaggcugaucucaaacucuugggcucaagcaauccuuccuccuuggccucccaaagugcugggauugcaggcaugggacaccgugccuggccaaccgugcagucuuuaaauaauagccuagauacccauuuaaauuccaauuuuuauuuugaagagggguuuacgaggugacucuucugugguuguguccuuuggaguaagcuauaaucaaauugauaugcagagaggaaguaaacgguucuuuauuagaguagacuuaaaauguggaauauucucaaguaugucaaccuuucuaaacaggaugaaaaagaaaccuggagcauuauaugagccaguaggucccauuuauugucuguuuuuuuauuuaucuuguucugcuaccccuacuccuuacuuuugccuggcauggacauacaucucuuuccucuguccauuuuucacauguuuguucuuguuagacuugggacuucagggugaaagugaacauuauucucugguuucuucuaaguuugugguuuauuaauauauccuucuaauauuucuuggguguaggaaccaggggaaagggaaaaaguaaggccgaauucuguuuuucucaaaugccuggggacgaauuuguacaccuuaauuuuauuuauuuuuauuuuuauuuauuuauuuauuuauuuugaaacagagucucacucugucacccaggcuggcaugcaguggcguaaucuuggcuaauugcaaccucugccucccagguucaagccauucuccugucuuagccucccaaguagcuggcauuauaggugccugccaccaugccggcuaauuuuuguauuuuuaguagagacaggguuucaccauguugaucaggcugguuuugaacuccugaccucaggugauccucccaccucgggcuccuaaagugcugggauuacaggcgugagccaucgugcccggccuguacgcuuuaauuuucauuugauguuuuauuuccaauuauuaaauguacucccccacucuguuuuucucacucaagagacuuccugugucuacaguggguuugcuguagucuaguaccacacauguucagaggaugcucaggaaauauuaguaauacgugucacuuuguucagaacggccagucugcauugguucugccuagagagaaauuuccucuuucuucauguacuuggaucgcuaagguuuucugguugaauuucuauguuuuuaaaauaguuuuauauagacauagugacuuuugaaaugguccucccucccucccuaccucucucgcuuccuccuccauccuuccaucccucccucccucccucccuuccucucuuccuuuucuuccuuucuuuuuccuuuucucuuucucuuucuuuucuuuucuuuuuucucuguuuugacagggcucguucugucacccaggcuggagugcaguggcguguucacagcuugcugcggcuuugaccuccugggcucaagcaauccuccugccuuggccuccaaaguguuagaauuacacgggugaacuaccacaccuggccugaaauaguccuuucuaauucaaaccuggcuguuuugccagggaggacuuacuugcucugagaccauauuauuggaaacuuagaguguaauagagaacguuugauucuucacuuguagaaauagucagaauuucaagguucaaaauuucacagacauagacauagggcuguaaugagaaggaaaauauguauguaccauccuuucuuccaaaguguccuuggaggagagcaagcauaagaauggugcucagugaggccacgaggcugggauacaacacccugaaucaaagcacgcugucauagccuccuaacaaaagagaaugucaagguuugaaaccggaauucauuauaauaugcaguauuuuauguacuuguaaauaaaaguaagggaguauaggaggagaugauaaggggaggauuuguuuugaaucugucucaucuucugcuuuguugaagugcuaaucagaugaucuuucuauccuaccaauauaugagaaaaagugucuuagaguaagaguauuggagcuuguucuuguuauccuaaaggcaagcuucccugucucauguaagaacuccagcuuuuuguguucccuuuaaauguauauuuuguguuuuuuguucauuuuguugcuaaaaaagguagugcggauuuuguuagugaggagacagccuuucaaccuuccuaucuccuugguaccaauuuaagccaaaaauuauuuuuuucuauacaagauauuaaccuugccauaacuaauucaugccauugugaccaugaguuuagcuaucucuuuucuauauaaggaaucacugcugggaauugguuuccuucccaagggacccuguaauuuugauuauuuuacuuccauccaggaugucacuauaccacaggaggcuggcugacucagggaugggaagaaaaggcauagaaaaauaaaguagcuuauguuucuaugccuaggauguuuguuucaaaaguucagcuggggaucugagacaggaaagguacaauaaauuuauguuaaaaauuucagcuggucaucugagacaggagagguacaauacauuuauguuaaauuuuuuuuuuguuucugucuugcuguuuacauuuauuuaaaauauuuuaaauggagauauaccauuaugccugcagaagguccuauuccugauacuuaaaaagccuaaauaaagauauauaaauuuuaaccaguuccuaauacacuuacagaauaaaaguguguugucuacuggaguuuuucuucccagauccauuuauggagaggccauaaaaaaucugaugcgggcauggcagaaauuuauauuaaagcuguguaauaaguccauggguauugguuguugguuuaaaauaacucuacuuaaaauugaaucucaagaauauauuugaaaauauuuuaaaguauuuuagagaaaaaagcgacauuacucacuuaggagauugacuucaaagcaggaaucauuugagauuuuggaugaauaguuaugagaauuccuuagugaacaggacagugcuggagaugaucacugaaugcaaaugaauacauuguaauauaaauaguaugucauaauaauugaaacauggcuuuuuuagauggaagaucauauuuccucuuuuaaaaguugauuuuauccaauauauccugcugguuguaauauuuaguuauauauggagguucaagcuuaaauacuugagccccaucucacuugcaaaagcaaguaaauugcagaguucacaaaccuggaaacaacucaggacaacuccaguguuugguauaauguuguuaggugaaauaauacuagaauauuaugcaagggaccugguauuucuuucuuuucuuuucuucuuuugagacauagucacucugucacccaggcuggagugcaguggcacaaucuaggcucacuguaaccuccgcugcccggguucaagggauucuucugccucagccucccgaguagcugggacuacaggcaugugccaccacgcccggcuaauuuuuguauucucaguagagaugggauuucaccauguuggucaggcuggucuugaacuccugaccucaugauucaccugccucggccucccaaagugcugggauuacaggcgugagccaccgugcccagcugggaccugguauuucuaacaaauucuguuguuuucucacacugaauucugaguucuauuaugacaaauucucacuuuuuguuucuaugcuuucuugauugcaaauaauuuuuugagauuuuguuaauuuuaguuacuucuggaauauuccaacccaaauuauagauguuuaguccuuuuuaaaaucaacuuauaauuuauuugaauccuaggucuuaguugcuugaucaauguuuaggcagcagaauaauugaguagcauuccgcauagcuaaguagcacuguuucgcaaccugugcccucuugcucuagaaaauacuauugcuugacauauaccaggaguuuuagguuagaguauuuggcagugucuauauggaaucaaaaacuugcauuaaaauggagaagaauaucuuugugaauccucuagauggcagaacaauuacaacaaacauaucuuagaagguguccaagaagcguguggaggagagaguguagaagagauggggugagaaggggaccugcgggcucuaagcuuucugucucaacccaaccagggcagaucugcucuuauaugucuuauaucuugauauuuuaucuaagaugguguuugaaagaaggaacauggcuaaaaacaugauaggaugucaaaacucaaaaucuguuguucuuuuuuuccuucaggauagaguuucgcccuuguugcucaggcuggagcguaauggugcaaucuuggcucacugcaagcuccaccuccuggguucaagcgauucuccggccccagccuccaaguagcggggauuacaggcaugcaccaccacacccggcuaauuuuuguauuuuuauuagaaacgggguuucaacauguuggccaggcuggucucaaaccccugaccucaggugauccaccugccucggccucccaaagugcugggauuacaggcgugagccacugugcccggcccaaagcucaaaaucuuaaguugugcacgccaacaucaaaucacagauuucugugaggacguacacaugcauuauucauguacccugagcaucuucagacuauagcugcccccaccccaacacacauguugaugaauucuagagugaugcuggccuacuucaacacucugcuacuuuaauuucuaucauagggguugaggcacagcauagucuuuuagccuuugucccugcuuuuaaagaaaucaccauuguugguauauuguauguuggcauaaggagaagagaugacuuggggagauauaacauagguaacuugcaaagauucauuccucacagagagugaaagagggagagggggcagguagagcauccaacagaauaaauguaagauuuuaagugugucacuuucuccacucaucuuugaauagaaagaugacuguaguaucucuucaauuucauuugcaaaguacuuauucaaauuccccugaagucacuuuuuaauagcaagaccaauuuagauccuuuuggauuaucgaugaaauucuagaucuaguaguauagcaaacgugauuuccauaugucaaauagagcaaaagcauaagggauaaauuugcuauccuguauuugcauaccucauaauaucauauacuaucccuaacagauauuaucuccuuauagcuauuauuucaguauaaacuacuuuaaaagacuccuucauuagacuuuucugcaguuaccuacuugccuauuaucagugaaaugcagcugagguauauuuuaggaucacuauucuucuggcugucugagauuguaccugagaaugcauuaagauacauuuucacauucauuuaacacaucugcugauuaacuaguccugagcuuaccuugggaauagacagauaaauuagauguggucuuuacucuuaaggcccucaaccaugaaaaaugcaauuucguaugucagacaacuauauaaauagauuuucuuauuuuuuuaacuuuuagauuuuuuuauagagauggagucuugcuguguugccuaggugggucucgaacuccuggccucaagcgauccuccagcuuuggccucccagagugcugggauuacagguugcgcuuggccauaaauagguuuucaauggaaucuaacaagguguuaugaaagaaguauccucaaaguguuggggaaguuccuaggcaugagaagcucuucuguagguauuaccagaaguuacccagaaguuacugcauguagaggacugucuuugcaacacaaaugaagggaagguauacaguugaugaaauauuaagaguuguacuauguuauauacugagccugauagauuuacaccaacagcuuucuagguuacuguaccaaaaaauucuauaaauagcuaaggauuuuuaguugauaacugaacuggaaaucaucucuggcuuuugcuucuuaaagaacacauuauucagugcuacauuucuauagugauaaucaggaaauaagaaggcccacguagucugaugaugacaacagugugacgucaaacaaugucuauaaaagugguaauguuuucugauugguccagauucuugaguuauuucacuaauaauuucaauacaaaaaauggagaaugucagaucuuuaaacaacugcugaauaacccauugguuguaaugaaccaguacauaggacugaauaaaugcuuuaagaauucucuacacaccacuggaucaagcaaucuguguaacuguagauaaugagacuucagcuugacuuguaauuaugcguggaguaguuaacuguauuuuuuacacaucaucuuuguauaggcucugagucuaggagggucagucacaaaugacugauacucugaaucaggguauugccacuaaucaaaggacagacugcacauguguucaguguggaaggauuaguuggucugcuuugucuuuuggcuacuguugcaaacaaagauuacaaaaagaggucuguauaugccuauguguuuguaaaaggagcuuucauuuuuguuuccuuaauugaacccuaacuccugauuuauuuuuauuuauuuuuuacaaauauuuguugaagacuuucagagaacacagaaguuuugcuaauucaagacaguccuuuguuuuuuuguuuuuguuuuuguuuuuguuuucuguuguuguuuuuguuuuuuaacaaauccaugcuguuuuagaaagguguuaaccagcccccucccugcccucauacuaguccaugugucagauacuaauuaaucuaugucaugggaucacuuuauaaucuauauuuagggaucucuuucucauucagagacaccgucuuucucauuuuggguguuuugguaauuuuucaauuuucugaguagcaucaguauuucugcuugaaccaaggugaaauuuugcaucuauuucucaguucucuaggggccucuuucaugacugucugcuugcuuacugguauuuuccuuacucccguuuuaucauggucugugaauuuaaccaacaugauguuuacucccgcuuuugaauuauuaaugagaaaacugugagaugguacuuuuaucuuuaauaguugaugcugaaaaagugacaaaugcaauaaaagcaucuuucucuaauucaguuccugucaugcaucucuuuagugucuuggugauaugacuugaaauaauagugcuuacaucucucuuuuagcuaguucacacugaaagcauauaaucaucuguuugauaucagagccacuucccagucacagauugugaugucacaaaccaaagauuguucucucucagcaggaagaagcuggagaggagaugaucuucauggugaacuacauccuuauucaaauuuggucacuucauaaggaaaauuaaccauaauaaggaacaaauauauuggcuaguugaaaugcccaguugaauuaagcuugaaacacggugccauuauaauggaaugaaaaaaauuccuuaugaaaacuuaaaguuauaauaaugaagauauaaguaaauauauauuuaaugcauuuaaaaauauuaugcaaugucccuuuaaguugaaugcuaacacagaaaaaugaauuuuagguauguuucuaauuuuauauacaaaauuauguugcuugguauuucagacaaaaauuacuuuuuaagauuguuaugucaacauacacgaaauggauguguucauuuugaccuagaugccauuuuuauuuuaucauaguuuaaauaaaaagcuuauagcuuuuggauaauuuaaaaugaccagaauuuaaggauauagcaauagguauuauuauaaggauauggcagccaaaauauuugcuccauuucuaugaaaggaacuaaugauacacaaucacauuacuuuuacaauauaauacuuuuauauaauaugugugaaugaaauacauucuaaauugcagaaacaaguaggcaggucauugacuacaucccaagacuguucagaaucucuuuaauuguuaaaucuaucaauaacagggaaaaguuguuauaaauaaaccaaaucuucagguacuagcauaaaaucccucauccauuuguacccaugagauguaaacuugaagcaguuuucaauuuuuuuuucacccuacaugaagaaaauacagauuauuccaaauugcuguaggguauuuuuuugaaagcuguuaccaaaacuucaguaaucacuuuucugaauggguuauuauagagcaaagccuugauuuggaaaggaaagaaagugaaaauucacugggauugaugcugacaaggaccaaauugggguggagcaagguaguauucauuugcccagccauugucauuagaaggugaguuauagaaacaaagcccccaaauuagugggauaugagucucuguuuacauuacaaugaguaaauaaaauccagaacacuuaaggaauauuguuaucugcccccuuuaauuccauuuauuggaagcaaauugagcauaguagaaauuucauacuuuuguccaaguuaauuaaaaaaucuuuaauuauaauuuaaaauauugauuaauauucuucauuuaaaauaucuacauauuuuugaaucaugucuguuuacaaacuguaauaccauaauaaggagggaacagaugaaaagaacccuuaaggguucagcuguuucucaguguagguaaacaacaacaauaccacccuuaacuuuuaguuaugucugguaugcauaagaaguauuuugagauuucuaaauaaacauuuuuuucucugaaacaaauuguuguauuagauaaucacuacuuguauuaaauugcugcuuuccuuugguacuggaaaaugacagguaaguuucuguaaugacuucagauguaaaagacuuaugauauuuaagguuauuuauagacugucuugaaaagccugaagggaucauauaauuuacucccuuaacuaaaauuugaaaaaaggaaagaauucagugaaauggaagagaauuucuaauuugacuacuuuuagacaaguauugaauacuuacuucugauaacuuuauguauauuaccacaagaucuccguaguuaggugugauaugcucuuguuucccugucuccucucuucuaagauaauauaaauauuauuuguuguaggacuucuuuaugauaaggugcuuuggaccuaaguuuuccaaugaaacucaugaaaaccaaugugguugggauuucugcuaaaugauaacguuuuguuguuuuuacauaagauugucacucuagaagucucauuaugcagugauuucuagggaauuucuuaaaggcacuguaucuuuuaaaauccuuugauggcuucacuagugcuuugcauuuuacaguuuggaccacugaccugagucaaagcuuuugagguuuuaagguaccagacaucuuucaucuuuuuauccucuuguugaaucagaaaaaugucuucauuuagucuguuauaaaaaugucuaguaucuuuaggauaaauuagcccuauccuacaagaguguuauaccucgauuuaguagagauuauuuuucuuuaguaugaaugaaaugacaucacagcuuuuuuuucuuaguaacaauagaaaucagucauugagcuuuuguuccuuuauaugaauaaaaauauuuaaaaugcuuauuaauuuuucuuuguuuuaucaaguacucugggaaacuaaguucauuugaauauuguugguaaacauuaucugugaauggcucuuaugcaccauucagggcucucuucaugcauuuuuuucaagcuauuaaauaaaacaaaauugggauaaaaauaaagacaaagaugagacaaauucaaugaaaaaugaaugggaguuuuggaugcuuuauuaucuaguucugagugacuuguuuaugcagcauaaguaaaaacaagcguuuaccucagcuuaaaucugcaaaagcuuaaggaaggguugcaagaaauucaaauccacuaucucauucacagcacgagcagauuuaauuucaguagacaagauauaaauuaagguuauaaaauuaaaucuuaccuggcagugguuuguuugaagcucaguaauuugaacucuggcuggaaauaguaagcuucgagacccaaaaugccuucucuacuuuccuuucauguuuuauuuugccaguguuuuauuucuugcagugucuuuauaucuguauuccugauaauccuguagcauuaguuaggauaguaugcgguagaugaagacuccauuuggauaggauuauagaaccagaagggugaguuuugccuuuaucugguaacagcaguugaucugaucacaaacaaucugaguguugagaacuuauuaaagauucauugaaugcuucagcaaugagaaauccugguuguuccuauaugcauuugacccccuggaaaaguucugcuuguucguauuucagaauuacacacgcuuccaaaucaagcugcuuuaaaaaacauuaucuggacuagaagcauggauguucuugcacucuugcuuuccuuucuccauacgaacuuuucaguccaucagcuuccuuucuguagaagaugaaggcauuucuucuguccuccucaugcuuuuguaacccaugcuucugguacccuguuuuuugaauagugagguaaaaauccagaaggaaguacggcuuuaucaugucucuggacggugagcguacuuggcaugaaugaagagcugauaggagcuauucaaaccagacagcaaacugaugggaugacgcugccauacauaaaaaacucauuaauuacuuccccugcuggacagcaguauauccugaaaggaagaaagaaaggagcagaugaugauauucguuuugauagguguucucuguuugaacagcuugucauugagaagagaauccaggaaaagcugcagcuucagagugugaucagguagaaugggcaagaguuauuugacagacaguuaagugacguauuuugggaggaaaaagagggcuuagcauggagguagcuggaauaagguuccaaaaugcuuuugaaaauguucauuuuuuccuguuagucuuuuuggcuagaagcuuuuuuuuuuuuuuuuuuuuuuuuuuaagcuuugcuaggcauuauucacagacauguugcugaguuauuuucucauaugguuuucccuaaagauggaaaauaauuuuuaaaagucuuugagauagaaagaguauacugugaguuuuaaauauuuguagcagagaaaaggcugccuuuuuuuuuuuuccuaaauguaugccuguuuuuauacaucuuuugggcauaugcguuuuguugcuuuggaguaaagcauuauaaguccucauuugauacaaacuuuuaacagggucuucauuaaagcuuuuccuuaaguuagaugaaauccauauuagcuguauaaaagaauagauuuuuaaaugucaauuucauaauuuuugcacuucaguuuuuaaauuuaaaauucaaauuuuuaaaacugcacuucaguuuaaaauuuaaauuuuaaauuuaaacguuuuuucccugccugaguucuuuaugaguguaucuagacaauauaauguuuuuaaauuuuaaaaaauuauuauggaacauuucaaacuuacacaaaacucugaaaaauaauacaaaaauaauacaugaaccuccagaaacucauuaccaagauucaacaauugucagauucaauucuuugcuaaaauauuuuaaagcaaaucucauuucaccuauuuguacuuuaguauguauauuuuuaaaguauggacacuuuuucacaugacccugugccauuaucacaccuaacacauuggcuauaauccucuggagucauauaauauccaguucauuuuaaauuccuugugucucagaaacuaugucuuuauguagguuuuuucugagugagaauccagacaaaguauacacuuuaauuguuagccaauagaauuuuaaacacugacagaugaacauguaugagaaagaagugaauuuuaguuuuauaguggucuuugacacacauuuguaauaggaauauuuaugcaagagaacauaucuuuagaauauuuucuugaacuuuucccacuuaacauugcaugauacugaaaaggauuguaauuucauaugguaaugauuggucauuauauacuggucacuucuauaauaaauaccccaaguuuuaagccacugauuauuaagccauuucaaugauugaaugugacuuagaguucaguggagauccaaaaugagagaaguaaaaaucuaucaaauggggccauuguguuuaugaggaucgaugacuauaauauuauauauguuuuucauuaaugucaagguuucuucccaauggauuuuaauuuuucuaugaaguuugaacuccuagcuccuuucugguaaagcauaacauuuggcuguccacuuaacuuuuccaagaauacaauagcaugagguccugaaaauaacuugugugccacacccucaccugucgaaauucauucucauucagguucucugucucuucucacucuuaucucaucuuucaaauuggcuggaugaaagagaauggggguggugaauauggggagccauuaaagggguguagauggaaauuauaauuuucuguuuccaucuaagcucaaagccacugcugaggaccgugcucccauuuuuuauggagggcaauagaauacuucucucccaaggugcucacucuugaguaucucuugucauacgucauguuauggcaugaacauuugggagcuuuguguuacacuuuauguucucaaauuauaccuuguccuuuaaaucuugcugaauaaggacuauaugugccaaucacuuuuugaaagcuuaguaaauaguuacugauuaucaccauuuaauacagauaagcugaaugggaaaaggugagcaaaaaugcuuccauucucuuuccaaguugucucugaaauuuuucucagucauuuauaauacaaugucaacauaggagaacacuuugcaaauaugcagguucugcuggagaacuuuguagggugggugaaaaagugguuauagagggaacuggaauaauagauuaugaguguauuuugggugcaaauauuucauaucauuaucucucaguacuuuagcuauaaacugaauuaauggaaaaacauugacuuaaguacuggccuguacaguuccaaauuauacuucagccauuguggaaaguaauuuucuccaagacuuugcucuugguauuccugauguuguucuuuuuuuuuaauaaaaagcuguauuuauuuuuacuuucuacaggaugaacuuucugcuuugaagcaaggaguugucuacaugaacuguauuguucagagaucuaauagguugaguagcuaguuggguggauggcuuguuuuuccacccuaaauaugaggaggaggaggaaagucuuagggauauggacuuuuauguuuucuuugauacauauaauaaagcacauuuuucuuuuguucagaugucucaacucucaucucccuuuuuacaacucuauguauucucauauuuaaacugaacucucccauugcccacuguaaaguuggcuaaacaacuucagaggcaucacagacuuucaaaugaauuuauguauaagauaaaugauuuuuucuuuuacaagguccuuuuuugcuagaacauuugguccauaccuagaguuaugcucauagcuguuuacaaaauuauaaauacuuuuauaaagaaaaaaagucucuccuuuaugcucuccaguuuuuagaugaguaggauuugugguuaaugauuucuuccauggcaacggcuuccuuuuagggcauuucaauauguauaaucucaauugagugugauuauuuuucaguuaauaaaugaagagaaaaaguugcauuuuaagagaguauuguggacuuauggaagcuguuucuaaaauaaauaugcuuuuaaauucuuguugaagaaaucaaaccuuuguugacuuacgugagucaugccaugccauuuuuagcacauuaauuguaauaauaaacauuuauugacuccuuacuugguacaagaccagugcacuugguucuuuggauuuauaaugcauaauuuuuaacagcucugaggcagacuguuaucauucaucuucuauaaagaaggaaacugagguacaccaagguuaaguaacuuguucaaguuuacccuguuauuaagauguugaacugugguaugaacccagccuaggugguuuuaaaguccaguaagauugccuacugagaauaaccaucauucaacuuaagcgugagacucccaguauaauguugaaagaguggcgucucuccagcaugacuaacauucuacaaaaaugaaaucugcaguuucuuggagaucuuagauaaccuggagaguugacugucuuuaauauauagggaauguguucuucuuguuucuaugucuugaauuuauaaagggugauuuauuuuucuuuccaaaauuguauuauggccucucaaauagcaauguguuuuaaaauacuauucauuuauguucuauuaaauuuuuuuuuaaaacuaaguagugguaugaggggggauaugaacuagagugguuguacuuugcaauacaguugauuauuaggaaacaguugcugucuucauauguauuacauucggguaaaacgauugcauuuuuuuucuuuuggcaucaguuuguuggagaaaaaaagauugcauuuuuaucuucuaauuuagacacuuuaaaugaaucuuucauuuuuaaacuucuuuaguuuauuccucuaccauagcacccacuuuuuucacucaucucaggccuuaaccugugaccuauuauuuggcucuuuccuaauuugucauccuuaauauuuugaccuuauacugaacugcagacaaccacuagaggucuccagaccacacuuuagaaagcucugauuuuacaaccauacccuaguaaguggaacagauacguucggggggagauuggguacuaauauuccucauuaaguauuugugaaaugcuuccuauauuccagguucuagaacuaugcuauguccuggcgguagacuuuuuuuuuuuuuaaguaaggacuuagacccuaagaacccuguaggcuaguggggacacuaacauuugaacguguggucacaagaugucacguuaggcacacccacaucacauccuuuuagauccuaaugacuggagucuuuuagauuucuaaguuugugaaugccccacuaauacucucuguagcgagaucauuccugcuuucuugaugagcccugauacugcaucaaucuggcaaggagccauucucugggggcaaauaggauuauuuggaugggcuuugggguuuuuuuguuuguucguuuucuuuuuuuuuuuuuuuuugagacagagucucgcucugucgcccaggcuggaaugcaguggugcgaucucggcucacugcaaccucugccucccagguucaagcaauucuccugcuucagccuccugaguagcugggauuauaggcgcccaccaucaugccugucuaauuuuuguacuuuuaguagagaugggguuucaccauguuagccagacuggucucaaacuccugaccucaagugauccgccugccuuggccucccaaagugcuaggauuauaggcgugagccaccgcgcccggcuggguucugguguuuuacuuucugauacccuucucagcagcucuggcaucugaucuuuagggaagcacuucauacaaaagccagccacugccugucucagugaacaaggcagaccccacagagauuuuagaccuuccauuuccauuuugcuuuauaucagauaaauuuuaaagaaaggaucuaucuuccucuuggaucucuugucuguuagggcuguuuaaauagacagguaucucauagaaacagucuuagggacauauucugauuaacccaugcaaagcaccuagcacagugccuggcacagagagggcagaugcuuaguagaugucaagaguugucauaauuauuauggaauuuaauuuaauuuuacugcuggaagggacuguagagauaauuuaguccugccauccauuuuacacaauaaauuuuagugcucuuuuuccuucucauauaggcaucuaacuguuaggaguuguucucuucaguuaucccauguuaggaaggccacaauuuugauuuagucauuauccgcuuaaugauuauacuucuguaugagaauuuuuuuuuuuuuuuuuuuuuuuuuuuuuuuuuuuuuugagaacgaguuucgcugugucgcccaggcuggagugcaguggcgcgaucucggcucacugcaagcuccgccuccuggguucacaccauucuccugccucagccucccaaguagcugugacuacauguaugugccuucaugccuggcuacauacacauuuuagugggaacaugaauaaaugaaaaugaucuugaucauaauuguaugcuaugcagaagauaaggggggaauuauagacagacagauauuaugcagggaaauuuagugauuuguuauguuuuuaaaggauuugagucugauguggcauguuaaaaaauuuaggaauuagcaagagguuaugaugaugauccagggaaaauaugaugauuccuuagacuaagguaauaauagauggaaagaaagggacagauuacaggaauauacagagguauaaaugauaguuugcugaugaauuagguaucuagguaugauggggagagaaguguugagaaugacccugagaacucuggcuugaguaacuguggcuggagaugcaauaugcugaaauuggggaagcuggaugaggaacagguuugggaaagggaaaucaagagagaauauugaacaagaugggcuguggaucugguaauucuuaccuucugaaauacuugaggcaugugaaggaauacuuuacaauugacauaugugagaagcaauacacuguuacauguuauuuuuuuaaauagguccuuuuuucccccauuccuuuguuuuucauuacgguuuuuaaccuuacuuuguuuuuuccugucucugccacuuacauguaacaccaaucauaacuucucuccgugcaaguauuucagugagauaggaaaggaauuaaugaaucaaucuuucuguguggggugugguuggaaauagccacucuaggaauaaauaugcugugcucugccccccaaaccugguugaaaauaauuucuuuaaaaucaucuaugaaugauuuuugauauggaacauuucuuuaauuuucuaaaaagauuucuugguuauacugguucauaggaacacacucuccucagaugaucaggcacuucguuuucuuuuuuuuuuuuuuuuuuuuuuuuuugagacagagucucacucugucgcccaggcuggagugcaguggcgcgaucucggcucacugcaagcuccgccucccggguucacgccauucuccugccucagccucccgaguagcugggacuacaggugcccgccaccacgcccggcuaauuuuuuguguuuuuaguagagacgggguuucaccguguuagccagaauggucucgaucuccugaccucgugauucgcccaccuuggccucccaaagugcugggauuacaggcaugagccaccucacccagugcagacacuuuauuuucuagaugagaaugcugagcaucucagagguuggcauucacccaaggaugcagaucuuguaacuaguuaaaagucgauacguuagaacaguagaaccuuaagaaucaaaauucuagccaauaauuccuccuaugagacauaccauuuacuuaucaguuucuuuaauaagagaaauucuuaugcauaaugagaaaugaaauauauuuuauggcugggcaugguggcucacgccuguaaucccagcaggugugagauuuaggaggcugaggcaggagaauugcuugagcucaggaguucgagaccagccugggcaacauagugagacucugucucuguaaaauaucaaaaaauuguccaggcaugaugguguguaccuguaaucccagcuacucggaaggcugaggcaggaggauugcuugaacccaggaggucgaggcuucagugagccaaguucucaccagugcacucuagccuggacagcagagcaagacucugucucaaaagaaaaaagaaaaagaaauauuuuuaccagaaauacauuugauaagguaaaaauaguuacauuauuuauguaaagacuucauauuuaaaauuugauaagauugguacuuuaguccucaguugaacaaacaguuuagcaccuaaaacaugugcauuguucuagacacuggauauaugagcaugacuaagggauaaacucugcucccacacagcugaauggaccgcggaagacaagcauaucaaggaauaauguuaucuuuauguuauacucaagucgcuauacagcagaagauaaaauggggcucacaugaaggaggaaauagcuaguuuaaucuggagaugucagggagguauguuaagcugugucagcuguagacauugguuaggugcucuuugaaccccuucaaaagaguucauuuuauuuuuauuuuuuaagaaguucuuuuuuuuaaucccaaagcauuaauaagauacuuaugugcuaagugaugaauguaguucugagauuaaauauaaaacauuuuuaaaauauuucuaguggaaguggcaacaaaaucucucucucucucucucacacacacaacacacacacacacgagacacagacucucuuccucauuuuaaccuaaguauucuaguugccauaacaaccugauugugguagugcauuugcugcuaugguugagguugugucagcaguuccauuauaagcugcaauuuucaggauccuaaaauucaaugucacauucacagacgugacauuuaaaauucuauuuauuaauuugauuuugccucaugcuuaaaucuccaaaaggcauugaccucucccccugugcugaaagagguucguguaucugguuuguaggcuucugcuuuuguuaauuuguauuuuauuucuaaaagaaaccuccauaucugaucacggucccuuauuuuauaaagaggaaguugaggcucugaagggucauccgacaaggcccuugccuugccuuuucacccuuaggcaagucauccgacacgaauccaguaguuauacacuacugcacagauguuggaguucaguggcaucuucugcuuagugauguuuuugauuuuugguuaaaucucaccaugacaugccuuucauuuuuuugcauaugugucucuuuguguauuugauauauauccuuucugcuguaauaggauucauucuguugucacauuccauguuguagaaauugguuuauaugucuuucugaucuccacuaaacguuucuccaggguagacaccaugcuuuacuccuuauaaugucuccagcauuugcugagaaggaccagcucugccuccucuucuuccucguucucauuccaguucaccuggugucugaccuuucuuguugcuuauucuuagugcuugaaccuaaugaccugucuuuagagggguuggggagugggcacugguguggagagaggagggggccucccucugccccuagguagagucuggggguucaagaguguggugcucggagggcuauggcuaugacugaaguguagggaguagugagagagguuaaagaggcauuaaggggccugaagguagacuuggauuggacuuccugcugaggaaucugaacuuuguuuaguagacaagagggaccuauugaaaggucauaagcagggaagugauaugaagagauuaccuaaaacugcugcacauucagguccuugaagacugaaauucguauuuaaaaaaguauggcauaaacagguaauuauucuaucuaguaggaaaauguaaggucagagaggagaguaauuaauucugccuuggguuugaugacaggaagcuuucacaaaugaggugauguuucaacuggauacuaaaggguagcuaggauugcaccaugcagggaaguugggaagauggaauuuuagacgugagaagcagcuugagugaagaaucagaggcaagcauaugcuuggcauauugggaaaaucuugacccugcugauguugauguggugccaggucugaggagaccaauggcuugagaggagacuggauaggaugggcugaaagcaggucaccaaagguuuuuggugccccacuauggagugaagauuuuaugcucuagauagaggggagcugugagcuuuaaaaaagcagcuaaaagacacgagcacaccuauggcauagagaaauagcucuagcaguuuagaggaugaauuggaaaaugagagcuggaugcuauucuaccagaccagguaaaauaaacaaaggugccuguugaacuaggauggugggauuagaaagaguauaaauagaggauuaggaaugaagaagaggcauguuucaaagguuaauuuagcagaugugauuggcuguauggggaaaaguguauaaagaaguuuucuuucuuuucuuuuccuuuuuuuuuuuuucuugagauagggucuugcugucuugcccaggcuggagugcaguggcaugaucugggcucacuguaaccucugccuccugaguucaagugauucuccucccucagccaccugaguagcugggauuacagaugugugcuaccaugccuggcugauuuuuuuguuguuguuguauuuuuaguagagaugggguuucgccauguuggccaggccagucuugaacuccuggccuuaagcgauccacccaccucugccucccaaagggcugggacugcaggcgugagccacagugcauggcgagaagaaguuuucuuauuauucaagcgucuaggugaauuauuuugcaauuuaucaagguaaggaaaacaggaggagaagacagauuugguuaaagauaauauuuugaaaaguucauccacauuuuaaaauuugggguauaauuuacauauaaaaugcucaaaucuuaacaguuugauaagcuuugacaauuuauguacaccuguguaaccacuucuacaaacaaguuauagaauagugguucuuaauauuuagugugcauuagaaacaccuggauggcuugacggaccguaaguugcuacucccacucagaguuucagauuuaguagaucuggggugaggacugagaauucaacuuucuaacaauucccaagugccacuggguucagggaccacacuuuggaaacugcugauauaaaauaccacugucacuccagaaaggcccucuucacccuuuuugccucucuccccaggcaaucacaguucugauuucuagcacugugauuaguuugccuauuccuggacugcacaaauggaauuauucaguauucgcuuaugucuggcuuuuuuuuuuuucauacaauauaaugauuuugagauuccccuauguuguugcaugggguuuauuccuuuuuacccgcugacuagcauuccaucaugugacuagaucacaauuuguuuaucauuucuccuguugacagacauuugauuuaguuucaauuuugggauauuauaaauaaaacuuccgugaauauuaauauacaagucuuuuugugguuauauguuuucauuucucuuggguaaauacguaggaguaggauuguuggguccuaggguaaauuuaugcuuaauuuuauaagaaacugccaaaauaguuuuccauagugguuguaauguagucaaauugugauuaaauuuuuauugacucuagugaagauccuagacauugacuagacugaaggacuuuuugucaaagaagaaaggucucuaauggacaaggaagcuuggcaguguuacccuuugggauauacguguggcuaaauaacagugaccguggaacucuuccaaauccuaagagaauugaaaucuauguuuagauuuaaaaaauguaguucauuauucauucaaagaacaguuaauaagcacuuaccauauauuagccauagaagggcacguggcucccaguacuguuccugaggagcucacagguaaaacaaauuauuaaacuuuaagaaggugcaaggcagugccuuaaaucuaaacuaucuuacuccuaguuuaucugaauguuauuuuuccagaaauucuaaauaucagacaaugaggacauaaaccaaaaaacccaaaaaaaacucccgaacauuucacaucacuggggaaaaagauggauuugucaggaaaaugguguugguccaaguggaguucaccaucugggaaaaaaauugguauucaaaccucguaucaggaugaugucaacaugugccaaagaguuuaaugcaaaacaaaaacuuaauguaauaaaaauauuagaacaaauuauagacauacucuuuucuaaugucagaauagggaagguguuuuaaaauauuggacaaaauccagaaauacaaggcuguuaaaucugauuaucuaaaagugacgaauuucugcauggcaaaacccaccauaaccaaggccaaaagauaaaugauuaugugugugugggcaggggagauaggauggugacucauuacagagaacuaguuuccaauauauaugauguguuuuaacaacccuauuaaaacugggcaaaggcuaugagcagacuguucacagaaaaugaaaugcaaauggcucuuaaacaugugaaaagaugcucaaugcacucauaggagagaugcaaauuaauuacacugaaauacauauuuucaguuaucagauugacagaucagaaaguuugauuagacuuugcacuggcaagagugaggaugcgcaguguuggagaagaagggcauuucaaguugaggggaauuggaggagcggggagauggaaaugggaaagguagggccagcacauuagagcaggacaggugagcuaauguaggggcaggcguguugacuuuagcaaggagcgacagcuggcgcucuagugucaugggagaagcagggaaacuagauagcuacacgcaauaacuacaaaugcuggucaccgcggaggcagacggcccuacagauaacagcccgagggagucacuuaccccaaaaggucacauuauucccagcauuuuccauuuaaggaagcauuaaaauagaauuuuuaauggaaugaaaauuuaacacucuuaacaaauuauaguuuaaagauauauucuucaguugucuuaaauuuaauuuuuggagaauauauaugaagaugcugaauacaugaaacacaucucuacugguuuagcugcuuauugcuguuuguagcuuuucuuauggugaauuacguuacaucacugaaugcuuaggacaaaaaugugcagucaugcuugugucucccuuugguugcaaagguagcauaaguaacugauucggagagagauuaacuauuaguguuuaauuuuggaaaagcaaguaaugcauguaauuuaacagaauggugcuuuucuuuuuaauucccauccccccgacauuucuuaucuuccuaugacuucugccucaucacucauuuuauuuucagaauucuaaaauucauaauacucuuuaaaaugaaacuaucauuuuuccugacuagcuuaguauuggagguaaauagauaacugcuugagauaccuuuuggucuaggacguuauaauucugugugguacauuauaguuuuaagcguuguacguuguggauuaugccugcagauuuauacauauuaggggcaaauagagcaccaaauauuuaaugauauucuuguuugcuuacauuccuaaagaagaauguaauuacauguucaaaccaacaaguuaacuugauuuacauuuuccuucucacucacaauuugguugcuaucuagauuuuuuuuuaaaauucaacccuaugcccaaauauauuucaauaguuccuugagucacuaagacaaaagauuaagggaaaaaaguacaccuaauagaauacuuugaauauugaccagcaaagauuguauaguauuuucugacacuuaagguuauagauuacauuuuaaaaaaauuaaaacaaaaaagacaauacuguggugucagauagauaguauucuuuaugguaucugaaaagcaagcuuauuuuauauugaauucuuguacagaugggcauuauccaaaauguccuguacucacuccagugcaaagcuguagaaagauagccauuugguaccuuccaguggcccuuucaaggacuuuucuggguagaaaaucuaaugauugagaaaauguugauauugauaacucagauauuauuuaucuuaguuaagaagaguugaguuugugggacuagaugcagauugaaaagucuuuauuauacuuuaaguucuaggguacaugugcacaacguacagauuuguuacauauguauacaugugccauguuggugugcugcacccauuaacucgucguuuacauuagguauaucuccuaaugcuauucccuccccccuccccccaccccaugacaggcccuggggugugauguuccccacccuguguccaaguguucucauuguucaauucccuccuaugagugagaacauaugguguuugguuuucuguccuugugauaguuugcucagaaugaugguuuccagcuucauccaugucccugcaaaggacaugaacucauccuuuuuucuggcugcauaguauuccaugauguauaugugccacauuuucuucauccagucuaucauugauggacauuuggguugguuccaagucuuugcuauugugaauagugccacaauaaacauacgugugcaugugucuuuauaguagcaugauuuauaauccuuuggguauauacccaguaaugggaucgcugggucaaaugguauuucuaguucuagauccuugaggaauagccacacugucuuccgcaaugguugaacuuguuuacacuccugccaacaguguaaaagcguuccuauuuuuccacauccucuccagcaucuguuguuuccugacuuuuuaaugaucgccauucuaacuggcgugagaugguaucucauugugguuuugauuugcauuucucugaugaccagugaugaugagcauuuuuucaugugucuguuggcugcauaaaugucuucuuuugagaagugucuguucauauccuuugcccacuuuuugaugggguuguuugauuuuuucuugaaaauuuaaguucucgaaaguuuaaguucuuuguagauucuggauauuagcccuuugccagauggguaaauugcaaaaauuuucuuccauuguauagguugccuguucacucugaugguaguuucuuuugcugugcagaagccguuuaguuuaauuagaucccauuugucuguuuuggcuuuuguugccauugcuauugguguuuuagucaugaaguccuugccuaugcuuauguccugaaugguaaugccuagguuuucuuuuaggguuuuuaugguuuuaggucuaacauuuaagucuuuaauccaucuugaaauaauuuuuguauaaaguauaaggaagggauccaguuucagcuuucuacauauggcuagccaguuuuaccagcaccauuuauuacauagggaauccuuuccccauugcuuguuuuugucagguuugucaaagaucagaugguuguggaugugugguguuauuucugaggccucuguucuguuccauuggucuauaucucuguuuugguaccaguaccaugcuguuuugguuacuguagccuuguaguauaguuugaagucagguagcgugaugccuccagcuuuguucuuuuugcauagaauugucuuggcaaugugggcucuuuuuugguuccauaugaacuuuaaaguaguuuuuuuuuuaauucugugaagaaagucauugguagcuugauggggauggcauugaaucuauagauuaccuugggcaguauggucauuuucaugauauugauucuuccuauccaugagcauggaauguucuuccacuuguuuguguccucuuuauuucguagagcagugguuuguaguucuccuugaagagguccuucacaucccuuguaaguuguauuccuagguauuuuauucucuuuguagcauuugugaaugggaguucacucaugauuuggcucucuugucuguuauugguguauaagaaugcuugugauuuuugcacacugauuuuguauccugagacgaaaagucuuauuuucuaauauaaauguugggaugcuuagggaucuauguguuguugaaaugaaguguuuuuuuuuuuuuuucucuuuagccucuuauggacaaggguguauggccuguccaacuugguguuuugggcauauguagaugucuucguauagugcccuauuaggcauucagacauacuuauugguugauugguaaauucuuguccaugcuguuuuccucaguuggauaguuucaguuccacaucuaguucaacaaucucagaagauuagguaaaguuguguaguuauuacaaaaaaugcauauuuaauaucuauuuuuucauuuaugcuguuuugggagccaguuuuuaaaaaagacguaauacucuuucauuauuuaugcgguuuccuaucuuuuuggagaaucauuguaauuuuauugccauugaguauguugguaucugacucagaaagggaagaaauacugaaauuacaguggaugagacuuaauuucucauuuccugcaaccaaguuacuacaggugucccaauuauggauaagcaucuaucuagacagauaaaguaggauagauuuaggagucaucuucuaauaguuuggggaauagguugcaagguauauugcucucuuugcuaaugcuuugccuccuccaacucccucuaucuauaccuuugaaccuggagugauuuuuuuuccccuuuuugauguggaagacaggcugacuuaucuugcuauugaagauaauaucauuuccaccuguuugugagcugcuguuaucuauauauccaccuuggcgcagauuuauuucuaaagcuagaccagacagaauuuuguucuaaaauauaucuuuuguuacugcagccacauaaacccugaauaaucuauacaucuugcuauugaaaucaaauggauuuuugagcucuagagcucugcuuacuuggguggggaugguacauuguguauaguaaguauuuaggaaauuaauguuuggccuuggucuuauccagcuuuccagauggaguugagagugauuucucugagaaauagaagcaucuucucaguaaagauacauuuuuacuuugagucuauuuaucaaacuuuccucugugcuaguauggucuuuccuaaacaauuucuucuuaucauuauuuuauauucauuauauauaugguauuguguuaauagacaugguucuguaacuuauaaaguagccuuuaccuccaucuucuaccuuauuugccuucaaggagacagguuugacaaaaauggaagagugugggcuaagguauaaugagauuuguuagaggagggaaaggggaaugaaagaaggaauuuuuuuuuuuuggauggcaaauugcaucuuuuuuuuuuuuuuauuauacuuuaaguucuaggguacaugugcacaacgugcagguuuguuacauauguauacaugugcuguguugguuugcugcacccauuaacucgucauuuacauuagguauuucuccuaaugcuaucccuccucccucccccaccccuugacaggccccgguguaugaaaugaaggaauuuuugaaggcugguuuagacuuuuugguucugggaauaaugucuagaaguauuaaauugacauggucaaacuauuaauuguuaauaaauuacuuuagaaauacugugaggaauguuuugaaggaagcguaccugagagacuaaaaaauacuuaacuucccucccacgcacaggccuuuauaaacguuuuggugcugcgcauaggaaugcuacacaggcuuuuuaacaucuggccuuggcugaagucuccugccaccucucacaaguucacccuuguggguuuguuuucuuccuccccccacucgccucuucccuccucuccccuuccucccacccucucucccuuccuuuccuuccuucucuuucuuuucuuucuugacaggguaucacucuauugcccaggcugcagugcaguggugcaaucauagcucacugcagccucagagcuccugggcucaagugauccuccugccucagccucgcgaguagcugggacuacaagcaucagccacccugccuugcuaauuauuauuauuuucuguagaggcagggucucauuauguugcccaggcuggcuuugaacugcuggcuucaagcuguucuccugccuuggccucccaaagugcugagauuacaggugugagccacugaacccagccagaaguuacuuuagaaauacucugaagaauguuuugaagcaaguggagccaaggagacuaaaaauuauuuaccucccucccacaugcaggccuuuauaaagccuuuggugcuguagguaggaaugccacacaggcucuucaagaucuugcuuuggcuuuaguuuccuuccaccucucacaaguucacccuuguggguuuuuuccuugaugucuuucuuuuuuuccucucagcuuauugagguauaguugacauauaaaaauuguaucuauuuaagguguacaauguaaugauuugauauuuguauacacaguguaaugaucaccaaucaaauuaacacaccuuucacuacacaugguugcccuguauguguguggugagaauacuaagaacaacucuuagaaaauuguaagagaguaauauuaauuauagucacuaugcuguuuguuagaucuccagaacuuacucauaacugaaaguuuguacccuuugaccagcaucuccccauuucccucacacuccagccucuggcaaccacuguucuacucucugcuucuguggauuugacucuuaguccacauauaagugagaucauacaauauuugucuugcugugccuggcuuauuucacuuauuauaauguccuccagguucauccacauuguugcaaauagcaggcuuuccuucuuuuuuuauggcuaaauaauauuccaugguauauauauaucacauuuucuuuauccauucaucccuugauagacacuuagguugauucuguaucuuggcuaucgugaauagugcugcagugaacaugggagugcagguaucuuuucgagauacugauuucauuuuggccguauacccagaagugggauugcuggaucauaugguaguucccauuuuaauauuuugaggaaccuccaucuguuucccauaauagcuguaccaauuaucuuuuggcuuauuuuuaaaaacagcuuuauugagauauaauuuacauaucauuaaauuuacucauuuuaagaguauaauucagugauuucuucguaaauucagaaaaucaugcaacaucuccccagucuaauuuuacaauguuuccaucacccagaaaagaaaccucguguccauuugcagucacuuccccuucccacacccagccucaggcaacgacuaauccacuuaaaaaauuuaugcauaauaauuauacauauuuauggaauauacuugauauuuugaugcauacaaugaauaaugaucaaaucaggguaauuaggauauccaucaccucaaacauuaagaauuucuuuguauagagaacaucccaaaucuuauagauauuuugaaauauagcguaaauuaacgauaacuauagacccccuacugugcuguugaacauuagacuuauuuggcugggcgcgguggcucacgccuguaaucccagccgaggcugaggcgggcggaucaugaggucaggagauugagaccauccuggcuaacacggugaaauccugucucuacuaaaaaaaaugcaaaaaauuagccgggcgugguggcgggugccuguagucccagcuacucgggaggcugaggcaggagaaucgccugaaccugggaagcggagguugcagugaggcaagaucacgccauugcacucuagccugggcaacaagggcaaaacuccgucucaaaaaaagaagaacuguuuguugaaaugaguugaauugaauugucauauuuaaaaaccuucaaaagucagccaggcacgguggcucacgccuguaaucccagcacuuugggaggccaaggugggcggaucccuugaggucaggaguuugagaccagccuggccaucaugaugaauccccugucucgauaaaaauacaaaaguuagccagacguggugaugggcaccuguaaucacagcuacuugggaggcugagacaggagaaucacuugaacccaggagguagagguuccagugagcugagauugugccacugcacuccagccugggcgacagagugagacucugucuuaaaaacaaauaaacaaacaccuucaaaaaccauaccuuauuuuauccuuuauccugugcauccuuggguucucaaacuccugcuguaguguucgugagugacacagugaugacuucuuugucuuacauuuuuaguaucuuuauuuagguaucuaaauauuuagauauuuauuaaaagauacuaacacuuauuaaaaaguauuguuacuuuauuuuuaugcuuccuugcaucuuuaaaauacugaugaucuuuagacacuuagauauuuaaauuuuacuuuuaaaauauaaaaaauaggcugggcgugguggcucacgccuguaaucccagcacuuugggaggccgagccggguggaucacaaggucaggaguucaagaccagccuggccaagauagugaaaccccgucucuacuaaaaauacaaaaaucagcugggcgugguggcgggugccuguaauuccagcuacucaggagggcgaggcagagaauugcuugaacuugggaggcggagguugcagugagccgagaucaugccacugcacuccagccugggagacagagcgagacuccaucucaaaaaaaaaaaaaagaaaagaaaaauagacauuguuugauacucucauaaauauguuggauguuuucagagauagcauguggucucagaugaagaucuaauuguauauauacuugaguguguuuacacuuacaguuugaaaagauuuuuaaugccauucuuaaaaaccuuuaaagcagaauuguucauguauuuucuaccuagcagaaaucuauugcuguaauauuuuccauccauuacagacauggcauagccauaauuuuuguuucaaaugacuuucaaagggagucugagggaugauaccacucaguuaaauugcuuauuuaauuacaguugacccucuguaucugaagguucugcauccacagauucagccaacagcagauuaaaaauauuuuuaaaaacucaaaagauaaaaauaauauaaaaaaauaguaaaacuauuuacauagcauuuauguuauauuaauuauuauaaguaaucuagaggugauuugaaguguacaggaggauguuguauguuauauccaaauacuucaccauuuugugucagggacuugagcauccacagauuuugguauccucagggguucuggaaccaaccucucccucccuggcccccugccuccuauauggugggaugacuggaugugguccccaaacgcaucuacguauuacagauguuucuauuuugcuuaucuuuuucuuucagucucucaugaugguuuuuuacuuuuccuauucauugguugggguuuaccucucaguuuucaaggaauuaaaacacuaggagcaccccguuuggcuuuucucuuccucaugcugggagcauucguuguuugguuuuugcccacaccaaucugcaacagaggcauaugagucugucuggaagccagcauuuucuguccguggugucccagaguuagaugggaaaggagucuuggagaggcuggagucuugcgcuugacuuuggacacccucuacuuuaucuuccuguuuccaguggagcccccuccaccucuuccaccaguuaugcuuggggucccugcauccagaguuccucuaauuccauggcccuaaccugucuacagaugagaaccaccuggggaaauugugaaacugcugacaaccagccacaccucauaccaaucaaacuucaaaucagaaacucuggugggacucuugaguguuuuaaagcucuccaggugaguccagugugcagcugagcagaggaaucauugcucagauugcuccuccugugaccgagcccgcacuacaucugugacuucucugcugcccuuuuacucuugccuaaccgcuccccgcaaccgcagcuacuuugcuguacccucuuuaauuaugcguccauccugagguaugugcaccugcugcucucugucuggagggcuguuucccuuguccugugcaucacucacuucuccuuccuuuuagaucucugcucuguagcaaaaacugccccacgcuuccuacccaccggccugcuuccucuugcgccauagcagucaugacaucugagcuaacacagauccuccugcuugugguuccccaauagaauguaaguuccaugagggcaggacuaagcuuuguucccuuggagauuucugggcaucuagaacugagccuggcauccaggaauugcuugcccgauuaucaguugaaugcauuucucuagagauuuucugcugguguuggaaggaguguugguuaugugauuuauuguguuggacaggagaugagggggagugacuaacugcucuuucugagauuuuucagcccuaccucugccuccuuugccugagccuuuauuuugggcuguuuuucuaagguucacauuacuagggcugccaagucaguuuuggccacugucauaucuucucuuuguccuuacagauuuaugcuuccagauauauauaucuuuaauacuuauuugaguauuugggaggaaguacagguaacauuuguauuccauccacucuguuuaaccagaagcugggcccuucauuacuuccuccucaguucacacacagauuaauuucuuccaugaauuuauugaauacugacuaugugccagacacuaagaauaaaauauacaguuccugcucucacugagguuaguaaacggugaauuuggaugaaaagaaucaggaguucuuuuuauuauucuugcaauauuucuguaaguuugaaauuauuuaaaaauaaacauuuucgggccaggggagguggcucacgcuuguaaucccagcacuuugggaggccaaggugggcggaucaugaggucaggagaucgagacuauccuggccaacauagcgaaaccccgucucuacgaaaauacaaaaaaauuagccaggcgugguggugugcaccuguagucccagcuacucaggaggcugaggcaggggacucgcuugaacucgggagguggagguugcagugagcugagauugcgcgacugcacuccagccuggugacagagcgagacuccauuucaaaaaaaaaccaaaacaaaacauuuucuaagagugcaccaagcagacccacaaaaucaugaagagcuccugugccaugccagagauccugaaggcucugugaaccauuaaagguuuuaagcaggggaguacuauaaauuuuggaauugagaaaaauuaacucugaguagaaacuaggauggguucagggcaucaagacuggaggaaggcauaccagguaggaggcuuugcaauaauccagaaaugaugaaggccucagaugagacacuuacgguggagaaaagcagcuuuucccauaaugcccauuuuaccagauucucuuggagguaaagcuguuucuguggugacauaaccagccauuauuaagggaagugggcuuguucuuauaagcgaaaugucucuugugguuguacccagagacaaaguaguaggaucuaugacaagauugacauugcaauaaauaaagagacccacuagaaaguagcuuggguuauugccauucagggaacagcucugugugauuacagacauugcucagaacugaauucaucuggucugguggaugcaaugcuggaaucuguacuaauaaauuuuuuguaguuaucucacccauaaauuuucuauuucauuggauagccugugcucauugcuguggagaguccgugccugguaugccaagcuaacauguaccuuaaggacuuucuauauaucugcuuuaauggaaaggcauuucuaucauuuuuacuucaagguuuucucuuuuuacaaaagaacuuuugguggguuuuuuuuuuuucgagacugagucucacucugucgcccaggcuggagugcaggagcgcgaucucggcucacugcaaguuccgccucccgaguucaugccauucuccugccucagccucccgaguagcugggacuacaggcgccggccaccacgcccggcuaauuuuuuguauuuuuaauagagacgggguuucaccauguuagccaggauggucuucaucuccugaccucgugauccacccgccucggccucccaaagugcugggauuacaggcgugagccgugccuggccugguugaguguuuuuaaaaaaauuuauguugauuuccauuccacacgcagguauuguucuuugugcuuaacauggaaacuuuguccagagaaacuugucuggagaaguccacuuuccuccuacaauuuagcagguaauuaaggagaacugugaaauugaucaauucacuggacacguuauaguugccggcacugaacuaggucuuguggguuucucugaucugcucagggacagggaucauggccuaauuaauuucuauauucuucuucaguuaccacaguauaguugcuuguuucauaaauguuuguugaauugagcaggggaugugagagaaguaaaggcguuguucagugaccacauucagacucgugugggucuucugggcaacuuuauucaguagguuccuguuggauguugggaaaauauaguacuaucagucuuacuugaagaguugagacaaaugaauuaaucaaaaacauuuuuaaaaauugugacuaggccagguguggugguucaugcguguaauccuggcccuuuaugaggcugaggagaaagaaucacuugagcccaggaguucgagaccagacagggcaacauagcaagacccuguuucuaaaaauaaagaaguauauaaaauaaauugugauuaaagaaaaacauauaauuuaccaugguaacaacuuuuuuuuuuuuuuuuuuuuuuuuuuaaagacggagucuugcucugucacccaggcuggagugcaguaguagucuuaagucacagcaaucucugccuccugaguucaagugacucuucugccgcagcuucccaaguagcugggauuauaggcgugcgccaccacaccuagcuaauuuuuuguauuuuaguuucaccauguuggccaggcuagucucaaacuccugaccucaagugauccacccgccuuggccuuccaaaguguugggauuacaggcgugugcccagccuauuguaacaauuuuuaauuguacaguuccauaggguuaagucuagaauuuguucaucuugcauaucagaaacucuguauuauacacuaucucccuuguuugcccucccucccagccccugacagccuucauuguacuuucuauuuuuaugaauuugacuacuuuagaugcuucauauaaauggaauaauauaguauuugucuuuuagugacuggcuuauuucacuugguaauaauguccucaagguucauccauguuguagcaugugacaggauuuccuuccuuuugaaggcugaauaauguuccauaguguauauauaccacauuuuguuuauccauucaacagacacuuggguugccccuaccucuuggcuauugugaauugugcuccuaugaacaugaguagccaaauaccucuucaagauccugcuuccaacucuuuuggauaaauauccagaagcaggauugcuggaucauaugguagcucuauuuuggauuucuugaggaacuuccuuacuguuuucuauagcaguugcaccauuuuacagccccaguaacagugcacuuucuuuauguucuugccaacauucacuuuuauuuuucuguuaaaaaauguguuacgguguugaaucuacauucuguaugaauguuaaagguaaaacagaaggcuccaaauaaaucaugauuuuuguggcagauccucuaaugaaaggaauauagaacuuuugauaaguccugaaugauaaaagaaauccucaggauauuguaauugagaagaauucaugcacauauauagagauaaaaaaacuuuggcugggcacgguggcucacgccuguaaucccagcacuuugggaggcugagguggguggaucaugaagucaggagaucgagaccauccuggcuaacacugugaaaccccgucucuacuaaaaauacaaaaauauuagccgggcaugguggcgggugccuguagucccagcuacuugggaggcugaggcaggagaauggcgugaauccggggggcggagcuugcagugagcagagaucgcaccacugcacuccagccugggcaacagagcgagacuccaucucaaaagaaaagaaaaaaaaaagauaaaaaacuuccucucaaagcggcauguuaccaaguacaacuucauuuaaauacuuaguaccacgguuguugaguagacagacgucuugaauuaugucaauaauguaagacuuucugaaagugauacauuuugaaugggagcuugaagggagauggugugaacugacagcaagaggagugggcauuaauauauaaaaaaaugugaucuuaaaauuauacaaacauagaauuugacaacaggagcuaagauucaaugcuuuuucuucucuauuuaguaauagcuguaauuggaaauaguaacugaguuuauuuaaugaggacagauuaauuuuuuugugauuuucauugagauuugacaguaagucuucaagugcuguaacgauuugugucacacaaucccuagaaaggauucaaagcuuacuugauaaacaccauuuuguuaucuaaccuccuaggacugaguguuuuuguuguuuguaauuuagggcaggcugucccuuuauuuucuuuguuguugacauggcuacauguacaaaagaacacuuacuaucaagaaagcaaacacuggaaagcugaaguguguaaauagcuaacaauguguucuacuuguacaaguauugccuauccucugcaaaucuaagucaaccuucaagcaaugacguuuuccauaugaaugaggaguguaagacuauugucccauaaguucuauuuuuuuuuguuuuuaauagauuuucuucuuucauaggauaugucuuaaggcuuguccaucuuuaguuuuuauuucccuuauuuugcugguaauuuaaauuauucucacuuuguauuuuaauuaacuuuugcuuaaaaguuuauuuuuguuuuuaauguaaauugugcgguucccaaacugaaacuagaacaaccagacaagauauaaguuauacugugacaggauaauagcaguuuacauacuuggaccagacagcuggugguaguuucugucacaugugaccauauucuuugauugguagguuucaguugcgugugucaggaggaaagucuuacuguucguuuaaccuuaaauaguuggauguuggaaaauuaauauuuagaaauagauaaaugauucuuugaaugguacagugucagaagcaaaacaaaaaaaaaacaguuucaguuuagcuaugugaauuuaaucuaauaacaaauuuucagcaaaagauuuuacucaaguaccuuccaaagugaguuccuuggaauaccaguuuuauaggguauuaguaaacauucugugaagaaaggguguuaacagucacauggguugagaaacccuagauuaaacaguagaaaucagauuucuuaacucuggggcuucucaaagccuuuaauguuugaauguucauugugaauugauuaggaaugagggauaaccuguaguguuucugaaacauuuguagaauucuuuuuucuucgagcaucuuguagaacuaauacucuguaaagaaaccguggaacaauggauuaggaagcauuuagagcaagagguuuguuggaaguuacaggagguauguaugguucagaugagguugaaucccuauucagccuaagcgauaagaauuucauaucguggcugggugugguggcucacaucuguaaucccagcacuuugggaggccaaaguggguggaucacguggucaagaguuugagaccagccuggccaacauggugaaaccccaucucuacuaaaaauacaaaaauuaucugggcguggugucaggugccuguugucccagcuacucgggaggcugaggcaggagaaucgcuugaacccgagaggcggagguugcagugagcugagaucgugccauugcacuccagccugggcaacagagcgagacucugucucaaaaaaaaaaaggaauuucacaucuugcaaagacauuucaacuaaacuuuaugugugcaaccugcuucccaguuuuauagguaugaccggcauacuuucauagguacuuggcgacgcaguacuggggaugagcuggccugcuaacuaguaauucauaauauuguauuugcacuucacaacuuagggaagagcugaaagguugagaagaggaaaaagcaaauuuguuuuauugaaauauuuggcauuacucuauuuuggaaaguuaauagcugccuuaaugauuuuuuaagauuguuagaaggaaacugagcugcagacuuacauuacuuguucaguccaaauuacacuuuccccaucuguuuaacaaaaaaugcgucauagcuuaggcugcuauaacaaaauacuuaaacuggguggcuuaaaugacaaaauuuauuucucauaauucugcaggcugggagguucaagaugaaggcaccggcagauuccuccugcugagggccugcuucaugguuccucgagaguaucuuuuugcucugucuuuaccugguagagaaaggaagcaagcucucucagaacuaguagaaggaauguaaauauacuuaacacuacugaacuguaaacuuaaaaaugguugagaugguaaauuuaacguuguauguuuucuaccacaauagaaaaaguaaaaagagggauauuaauuucauucaugagggcuucucccucaugacuucuucuaauccuaacuacuucccgauggccccaucuccuaagaccauuacauuaggggguaguguuucaacaaaugaguuuugggggaacacaagcauucagucuauaacagaaggcuuauagaauuuuagagcuguagcaacguuuagcaaucauccuauuuuuaagaugagaaagcuaaacacgagggauaguauguaacuugcuuuaauucacagcuauuuugaaagcaggguuuagauuagaauccagaucuccugguucguaguuugauaauuuccacugcacuuugcaacccucuauuguggcagugaguugucuuucucuguugcucauuaucugucucucuguaaauauauuuuauuguuucuuuagauuuuaccucuguaggggauuuugccuuuagcauauuuucuucaguuguacguguuacuccguaaguaacaagcgauacugauuucuagccuaugcuccugucuccuaaaaugguuccauuugauacucuggcaguuuaugaauuguaauuaauuaaugaaauugguuuaaauacuauugaacacauuguaaauucagugacaauuuguauagaagugaagaagagggaagacugagguucuuccucccucccuguggucucaaggcuuuagugacugguagaauggcagugccguugaaagaaauagguguggccgggcgugguggcucaugccuguaaucccagcacuuugggaggcugaagcgggcgaaucacgaagucaggaguucgagaccagccuggccaacauggugaaacccugucucuacuaaaaauaccaaaaauuagccgggcguaauggugggcaccuguaaucccagcuucuuuggaggcugagacaggagaauuacuugaacucagaaggcagagguugcagugagccgagauggcgccauugcauuccagccucggcaacaagagugaaacucugccccccgccaaucccccacaaaaaaaaaggaagaaagaaauagguguaucugauccugucgguuugguagggagcaugauguuugugguuagacaucuggaguuuuuaaauuuauaacuuuaucauuuauucugguuacauaacuaaugcauucucuguuuuaaaaauuugaccaguuuggcauuuugaugaauaaggugcugcuaagagguuagguaugaauguccagcaaguaguugagauuuguaguucuuuguguauucuagaaugaguuguuaauuuuugguugguuacauguaugcaaauauuuuucucccagucaauggccuguuuuuuacuuugucuguggugucuguuguugaacauagguuuuaaauuuuauuuuuuauuuuuauuuuuauuuuuuucaagacggagucuugcucugucacccaggcuggagugcaguggcgcgaucucggcucacugcaagcuccgccuccuggguucacgccauucuccugccucagccucccuaguagcugguacuacaggugcccaccaccacgcccggcuaauuuuuuguauuuuuaguagagacgggguuucaccguguuagccaggauggucucgaucuccugaccucgugauccgcccaccucggccucccaaaguaaugggauuacaggcgugagccaccgcgacuggccagguuuuaaauuuuauaguaaucauauuuguccacauuucccuuuauuauuucagaccuguugcuccaagaaaucuuucuuucccccuaagauauuaugauuaugauuccuuuauuuuaaauaguuuaugauuuuauguuaugauuauuauuccuuuauuuuaaaugguugauuuuucauauuuaguacuuuaauuggaauucuuuuucucuuucuuuuuuuuuuuuuuuuuuuuuuuuuuggucaaguagggauuuguauuaguucaggcugcuguaaauaccauauacuggaugacuuaaacaacagaaauuuauuuucucacaguucuggagacuggaagucuaugaucaagguaccagaaggguuguugucuggugagagcucucucauuugguuugcagacagcuuacauucucccugugcucacagggcagaaauagugaggaaacucucuggugucuuuucuuauaaggccauuaaucccauugugaaggcccuguccucaugacuuggucuaaaucugauuaccucccaaaggccccaugucuaaauacuaucacauugggggguuagggcuucaacauauaaauuuuggggggauaccauuuaguccguagaaggauuuauuuuuuuuuuuugagauggagucucgcucugucgcccaggcuggagugcaguggcgugaucucggcucacugcaagcuccgccucccagguucaugccguucuccugccucagccucccgaguagcugggccuacaggcgccugccaccacgcccggcuaauuuuuuguauuuuuaguagagauggguuucaccguguuagccaggauggucucaaucuccugaccucaugauccgcccgccucggccucccaaagugcugggauuacaggcgugagccaccgugcccggcccugauuuaauuuuuaaaauguugcuaacaguugccccagcaucuaauugaaucagcugucuuuuucccacugauuuacaaugauagagugucuguuuuuggucuuuuuuuuuuuuuuuuuuugaguugaagucucgcucugucgcccaggcugaagggcaguggcgcgaucucggcucacugcaagcaccgccuccuggguucacgccauucuccugccucagccucccgaguggcugggacuacaggcgcccgccaccaugcccggcuaauuuuuugcauuuuuaguagagaugggguuucacuguguuagccaggauggucucgaucuccugaccucgugauccgcccgccucggccucccaaaguguugggauuacaggcgugagccacugcgccuggcccuguuuuuggucuuaauuuugaucacugcuuugucuuuaauucuaccaauaguacggucuuaauuauuaaaguuauacaauaaaucuuaauaucugagaugguaaaacuccuaauuuguuauucuucaaaauugucuuggguauuaguggcccuuucuucucucaugugaauuuuaggagaaguugauuaaaucacucaugcacacaccacagacacacacaaaacaagacaaaaguccccaaauguauagauuuuguuuguauuuacauuguuaugaaugaucuggggagaacugacuucuuuacaauauuguguuuucucagccaugaucauggcaaauuuccccauuuauuuauucuguucuuuuauauuguagaauaauauguuguuauuguuuccaugagucuuugacauauuuuauuauauucucagguacuuuauaguuuuuuugguauaacgcaaggauugcuuaucaauuaugcuuucuagucaucagaggaacacaucugauccaguaaccuuagugaacucucauauuaauccuugcaguuugucugcagaugcuuuugcauuuuuccauguagucugcuguguugucuguaugcagaguuaguuuuguuucucccuuucuacuacugaucuuuuucuuaucgauuuugcaugaugcugaauagaggcagugauagaggccauccuuguuguuuuuuuuuucuuuagugggaaugccuuuaaaaucucaccaugauauguaauguuugcuguugguuuuuauagcuguuaccaguuuaagaaaguucccuuccauucguauuuuugcuuuuuuaaaucuugaaaucgauucauuuuaugauuguuuucuggaaauuaaaagguuauucuuugguguauuucuugccuuaaguacacuauuacaaaacuaaaugaaugagccuauauguaacugaggguaacuuuaaaaaauuaaaauaauaaaggaguccucucggucuuaaacauuuauaauccaguauagaaaauuuggaaaauagucaaagcacauuaaaagaaguaaaaauuagucauaaucacccuauuuaagauguuuucuucuguugauaccuuaugaaguauagagauaggcugccucaaucucuacuuuccgcuagguuaccacuuaaacaauucauacacauugcugcuaccuuuuuucucuugcacuuuccauguagucagcauacaaaaagaaaguagacuaaugaaauauuuaucuauacacauauauaaccuuuauagaaaucuccaagugggaucaugccauauauauauacacacacauauauauacacauauauauacucacacacauauauacauauauauacacauauauacacaaauauauauagcagcuuuucuaaugcaacaauauuuaauugacauuuucugaguucaaaaaaaugcuacuuagauccuuaugugaauuacaaaccacauuacaaacauucuccaguuugggacuauugcaauaauugugaauacacauguauauacaucuucaacuacuugugcuagcuagcauuuuugugugauagaguccuagaaaaaggccugagaugccucgaauuuuccacgucuugaaaaucauuuuuaugacgaccuguggaaagagauguuuucaauuaagugucucaggauuuucaguuuguauauugugguucaaaauaggagaaaguggagccaucagaauacauuagucaugucuacacaucagucccauggacucauagcacuuggauggaucguuccaccccgggaaagagccuuagugaucaucuguuuggauccuucuuuucauagaugaauaagcugaaaaucuggaagauuuucaaaguaaauaauacuugagacuuauaauaugccaggcagugugcuaucuccuuuacuuacaucguuucauuuaauucuugaaguaggaauucucauuuacccuucacaguugaggaaacagguuagaauuuaggcagacaacuuccucaaggucacacaauuggaaagugauagagcucagguuuggagacauaucuaccugauucuguagcccauauacuuuucacuaaguuacuuccauucugagagagcguaaccaggauacaagguaaauacaugauacucagauuguuucuguaaugcuuugauuucacgacgugaagaguuaaacauaguccucaucuaccacuuagucauccuuccuagcaaggacauuagagugcugcagagacuccacuucacagaguuugcaguggaggaaacuagcccuuauguuuguguggcucaggauagcuguccaaggugagauagaucagaauaaaaacacaaaacaaaugagaaauuaacuuggaaauagauaacacuuugugugauauuuccccuccucccuugcaaauucuuuucucuucuuuugguugcuagaagaauugcuuggucucuaauugcugaagauuuuguuuuuugagacuagguuucauugugucacucagauuggaguacaguggcauauucauagcuuacugcagccucaaacuccugggcucaaggagucccccaccucagccuccugaguagcugggacuauggauauggcuaauuuuuuuuuuuuuuuguagagauggggucuugcuauguugccuaggcuggucuugaacuccuggcuucaagccauccuccugccuugacuucccaaaugcuagaauuacaggcaugagccaccacaccugguccugaagaucuuuuuaaucauaauaucuuaauuugaguauauaauagauugagccucagcaaugagaacagagggauuucuugagcaaagaaaauuccuguuucaaaccagucguuuuuguaugugucugugugugagacagagucucauuccaucacccaaaccagagugcaguggugcaaucuuggcucacugcaaccucugccuccccaguucaagcaauucuugugccucagccaccugaguagcugggauuacaggugugugucaccacuccuggcuaauuuuuguauuuuuagcagagacaggguuuugccauguuggccaggcuggucuugaacucccggccucaggugaucugccugccucauccucccaaagugcugggauuauaggcaugugccacugcacccggcugagacuauuuuucuaacucaguuuguacaggcccuagcauggugcguggguaugagagaaaaagagacuggagcuccaauggaggaugccucaguucucucucucucucucucucucucucucucucucucucucucucucucucucucucugugugugugugugugugugugugugugugugugauuguuggaggccaggccuggcuuacuuccugagccuaauucaauuggaguguuuccauagagagggggagauaccaucuaguccaguuuagcauccacauucauuucucuccaucuccauauggagcugaacagaucacucaggucuaaccaaguucccugagaguuuuacaaccuuguuacugcuuuggaaagaccauuauacuccagcuuuguguagaacagagagagacaagggcugucuuuugaauauauuccacucuuaucuaacgacacagaguugucguaaccuaccuauaauaauaaccuuugugauacuggagcugccagcgugugaggagggacauucuuucaggugucccuucaucuucaucucugauuaguauauucuguuuguaaaggcaaugcuugagccaguagcuuucaaacauuuuugaaugggauccaaauaggaaauacaguuuguuuugcuacccuucucccacauauaccagaaacaaaagauucaugaaauaaaucuugcauuuacugcaugcaguguuguguucuauuauuuauuucaucuaaaaaugcugacacccacuauauugauuuaacaaaccacugaugugucaagaucuacaauuuuuauuuauuuauuuauuuauuuauuuguuuguuuauuuugugauggagucuugcucuugucacccaggcuggagugcaauggcacgaucucggcucacugcaaccuccaucucuaggguucaagcaauucuccugccucagccuccugaguagcugggauuacaggcgccggccaccacaccuagcuaauuuuuguauuuuuaguagagacaggguuucaucauguuggcuaggcuggucuugaacuccugaccucaugaucccuccaccucagccuuccaaagugcugggauuacaggcgugagccaccgcgcccagcccagaccuacaauuuaaaaguaacgcuggcuuaaggagaccauuucuuauucuucuucauaacuguguauuauucuuguuacaguuuaacuuccucauagaguuaaucuugcaaaaacguguaccuaguaaugucaguguacauagaguuguccugggaacuaugucugucuucauggcacuguccacggaguacacacuuagaacugacaagaucacuguaugacuuguuaacaugugaaucacugguggacauggagacucuugcuguuuuguugauuuggaaaugguaguucugaacuugccaaauuggguauauguuauuuaguauaaguuacaaaaaaagaccaaagguuuucagaauguguguuuauucuucaagguucugcucauuucuuuuagcauuguaguuugauuguaguuucugaugcugcucuuaguggucugcaaucuucaccucauaagaugcucuaaauuuucugacuuuuacaugcuggaagucuguucaaaccagccuuauagaaugcuggauaauacugcuuauugugauuuacuucccuggagaucaagcucaucuuagaaucaagccuuuccacaugaaugugaggauucuggaugcuuuauucuuucucucaucucugucucucuuccaucagggggaugguuuugacugaugagcuauuuuucccaauugcaaaucaacuauacuucuagcugugagaaagggaucuuucuaaucaauugggucuugccuucugcuuacuaugugaauucuaaugaccaagcucuuuauuuuuuuaaaaaaaguaaaauaagagaauuuaaauuaauuacuugauuuuguuguaacacuuuaauaaguuuagugaaaauauucaggccgggcgcgguggcucacgccuguaaucccagcacuugggaggccgaggcgggcagaucacgaggucaggagaucaagaccauccuggcuaacacagugaaaccccgccucuacuaaaaauacaaaaaauuagcugggugugguggcgggugccuguagucccagcaacucuggaggcugaggcaggagaauggcgugaacccaggaggcggagcuugcagugagccgagauugugccacugcacuccagcccgggugacagagcaagacuccgucucaaaaaaaaaaaaaaaaaaaaaaaaaaaaaaaaaaaaaaagaaaauauucagcauaguuucuuuuuggcaaauaaauaaauuuaaaaggucccuuaauuugaugguuauguguugacugaaacaagugcaaaacaaguccauacaaaugauccuauaaauagaauuaaauauuuaaauuuguuauugaaagcugccuuucuuaacaagggagcaugguuucuaauuuagacuauagauaauuuccucauuguuugugccguauccaucguugguagucauucuaaaagacaaaagaaaaguacuaacgucuaauuauucuaagggguguguaaaaauaugggaucugcccagagaauguuuagaaaucaugaaaucauuguuacccugcagucacaccccuuaguaauccuuaaguuuuuuuuuuuuuuuuuuuugagacagagucucacugugucgcccaggcugaaguacaguggugugaucuuggcucacugcaagcuccgccucccagguucaugccacucuccugccucagccucccaaauagcugggacuacaggugcccgccaccacacccgguuaauuuuuuguauuuuuaguagagaugggguuucaccauguuagccaggaugguuucaaucuccugaccucgugauccuccugccucggccucccaaagugcugggauuacaggcgugagccaccgcgcccggccaguucuuaaguuguaacagauuacuuuucauucugaauuucauauugaacaugauaaucuuaauuuuggauacagacuauucccauagcauuuuagauuucguaagaaaguauauguaggcuguuuuaugugaaaagaagagagauuauuuagcuccaugucuuugagaaaauaguuauggauuacaauuuaugaguauuuuauacauguucacauucuuuuguaucauguuucuuuaugucuaggaccugauguuuacuuggcuuaaacugaaccuaaaauuaguaguuaguuaauaaacucucuuuaaggauuacauuuuuuuuuuuuuuguccuagauggacucaaaauaauacuagaguaaugcuuuacuucuuaucuugggugacuagaugucaagaugucaucccaaaucagguccauaauaaaaucuccuugggacaugguucugcucacucuuagaguaggaaacaauagaccagaaggauggagaaagauggcagaagaagauguguaaagggauggaagguauuuguuaauuuuuuucuauugcuuuggagacuuaccauggcaugcuagaacaguuuccuaaucuguucgucaagacacuggugcuuuuauagggccccuuuaguauuucuccacuggaugaaugauuuguagcacuuaugaagaaaggacuggaggaauauuuuuuuaagcggcgguuauaccaguuauaauugagcauacuucuauuucaucagccgguuaucauagacuuuuuauucaguucccuaguaguuuaaugccuuaugccccuguuuguucugaauuaauuucauuucuuaaauaugugaagauuaagcugaucugcuucaauguguauuuagggacacuguguuucccauuuaucaccugcugcuucucuuuagcaguaaaauuaaauugacauuuguuaaaagauguuuugaucuaucuuuggaaaggguaguaaagaauaauuagucacaguaauuuuccccccauuuugugugcaaauuuagguugcuuggugaaauauucuaauuuuuuaauggugauagagaauucuugcuuuaguuuugugguuuaaacaguugaaaguccgaugaauccuugaagcauuaguaauuuagcagccuuguaaacuagccucuuuuacuuggguagcucacaaggcuggcaccagcaucaguccuacaaagugguuuacucuuuuucccucggcccagaggcuggcccuaguccuaucaguugaaagacugucuacagcuaugcagugugggcaacucacuugaaauuguuacucaaaauaugaagucaggacuugaggaaguaugacuuuagccuuccugggugacaggguuaacauuuauaugccucagcggauaacagucagcauacuuaccauggagggaaucaaaugugugugggaagcagaaugccucaaagaacugcugagauucaggugcuaaggugauaaaacacguacauuuuauauugaacauaguuugguauucuaggucaggcaccccauucuccaacuccaugguucuaaggccccaccaagaauaaauuuucuauaagcaggaagcaagagauacaacuguuauggaacuuaguaagaauuuuuauucuguuccacaugacugucacuuugaguuucuugaggccguuaugauuagauggguacuaccuugcuggagguucucaucucuagaguaggaacaucuuagguaguauuccacaguauuauuuaauaccauaucagggaaggggaggaagaaauucugcuuuauuuguuauuauguugauucuuguccaugaggcaggugccuuuugaagacacaucuggacugauuuuagacccagggcuacugcauuaaaggcccuuccugccugggagcaccuccccauuaguuucucugugacucuugguacuugugcagucccucugggaaggauggcugagcucccuuucugugucagcuucuggguucauguggcaaucaagucaggauggcuuacuccauacauccuugcccacccuuggaugcauagagcucuauuuccuccucugccucccccauucaguugcgucuuggagagcacucuacuuguugacuguuucucaaccucagccucaaccucuuguacuauuaauuaguccucauaaggcauucuucagccuuacgucugcuguccacaguaucuccuuaccucugauacuuccagggccaccuuuccaguaacucuacagcccucucugccagagauugaucccuugcuuucuuuuagcuugcuggccagguuucuguugucaaauuuaggaaucccuuucucaaguuucuuucauaauaugaacuguaagauuucagagcuuucaaguuuucuuuugcagggacuaaucuuucaauuuacaacagucaguaaccaguuuguuugugucuuuguuguaguggcucauuaugaguuuuauguaacauucuuuaauaguaguauuuuacugccuuacucaacagagagacuuccauuuugacaagguguugaaaagagcugaaucuuuagccuacaguuuuacccacguggugguuggaaaaguuucgcauggauuagcuucuuuauacauuccaaaccuguuucuucuccacuacccaccuacuucaucaccaggcauaguaggacacacaguaagcucuccagccuguacuguuguguccugaugcugaguuggcacagugggcagugggaauauuccagaaagcuauuccuauaccaagagggccagcacuacagaaaccacauuaaauauguccccaacucaaauuuccccuuaucuagacccuccaagguuccagggccacaccaaagccacccuacaugaggaaaagugugaaguuugaauggaaagaaaguguucuuaacagauugcaguuaaaauaucuuucuuuugcacauucuacaaaaauauaugaccauguaauacauugcuagggccuccaaauucuacagaaacaugugaccaugugaauaugugccuugggccucccaaggccuuggaaggggccugugcaagugaggagcccugaagcuuguucuguuagccuuguuguaaauuaccuccaaucagucuguaucuuccaguagagaaauaucagaacaucauagcaaaguaugguuagaaacagugcuuuuuagaguguuuuauacauauaguuggcacuggagaaucauugagaugaauuaacuaucauuauuauugauaauuauuaacuauuauuauuauugguaauuaauucauuucaaugauucaaugcagacacuuuccauuuacugggcacuguuaagagcacuuaacauaucaucucacuuaagucuuaggaaguucaauuauuauuauuauuauuauuauuauuuugagauggagucucgcucugucacccaggcuggagugcaguggcaugaucuuggcucacugcaagcuccaccucucggguucaagccauuuuccugccucagccuccccaguagcugggacuacaggcgcccgccaccacacccggcuaauuuuuuuguauuuuuaguagagaugggguuucaccguguuagccaggauggucucaaucuccugaccuugugauccgccugucucagccucccaaagugcugggauuacaggcuauuauuuucuuuuuaaaauuauuuuuauuuuauuucuagcuggguguaguggcucacuccuguaauccuagcaauuugggaggcugaggcaggcagaccaccugaggucaggaguuugaaaccagccuugccaacauggcaaaacccucucuuuacuaaaaauucaaaaauuagcuggguguguuggcacaugccuguaaucccagcuacucgggaggcugaggugggagaaucgcuugaacccaggcaguggagguuucagugagcugagauugugcacuccagccugggugacagagugagacuccaucucaaaauaauaauaauaauuucuaaguuuuuuuguagagacagggucugguuauguugucuaggcugguuuugagcuccugcccucaagcaauccuccugucucagccuccccaaaugcugggauuauaggcaugagccucugugccuaaucuuacuuucauuuuaaagaggagaaaucugaggcacggagauucuaaauaaccugucaauaaauaguagcacuggggucaaagcucagacuccacgguucacuuccugaccgccccugcacugccucucaaauccuaauagagcugccgugaucccaauccucacaaggccagaaagugaccuuuccagcaugcuuaguagggauguauuuuguuuucccuacuuuaggagaguuaagaagagaaagauuuguagaagagaagcuagaaugaaaggagccauaaauaggguucuggagaaaacacaaaaauugagacagguuaggcagugagagggcagguuauugaauagcugcuuaauugcacuguguuuuccagacucugggaaauacuuuucacauuuuugauuuuuuaguccauauaugcuuuauggauauauagaggugauuugguaauguuccccugccaucugaaaaacuauguugaaaccguuagcacaaaugaaaauggcgucuuggaaaaacagcacauacaugguugcuucaaggauaucgcccaauaccuucauuugcggagaaggcauaauuaagagaaaauagcuuaaauaauacaggaagagucugaugaaacauaaggaauguuuucuuaauaaucauguuagaacagugcuccaaaaagggaagcauaggauuucagucuuuaaagguaaauaaaauauaauuauaaaaacuuuccaucucaaguagguucagaguugacuucuagccaugauuugaaauucuuucucccacuaaagagaguaucagcauauaaauuaaccuuacugugguaccuuguuggauaaaauucuuuauaaugcaccucauucacuacagucuuacuaguuaguaguaucagcucucacccgugcugaugggcaggaauuacuuuuaagugucuuaugcaauuaacagccauuaaccggcacaccugucuuaaaagcacugccuaugguucugaggguccuaauaccauugcagugcugucaccgcagugacuggagcaccagggaaacuauuggcauuggcauggaauggcccuauuugucccauuucuucaaccaaagugucuucacuaaagucuuuagccagacuuccuucuuugaccaccaauuuuaucuuaauucuguggguaucauaugaacaguccugguuuuaucuuauagaaaggaagguaucagagggagguugggguagaugucuccccaucuaaugcuaacauuaaucauuuaucccugggacuuugcaaaaaaugauguuagguugagacaaagugguacuuuuucuuguaauugcuuuagggaaucauagggaggaagguacaggggcuugugugaagccaucaucaaguugcuuuauaauaaaagccagaagacauguaaacaccaauauaguuaacacagaguuuaauaaagaaugaguuuaaauucuaauuuugauaugaauaauuaaauauuuccuaaagcgaaauuugguaacauaagguuguuuguagguaaggcaaaaggaguucuaaaaauauguuuaaccagucaguugcauuuaucaaucacaguugcaaacauaauucauauuuuaaaauauauguauauaaugaauuacauauauuaucuauuuaauucagaguagguuccaaauuuucucaauuauuuauuaccuaugucuuucuucaaauaaugccagcaauuauggguccuugauaauaaugaaauauucuacaguugaagcaagaagguacucugaaagcuuacaucucuauaaauuaaugcuucaaauaauuuaauacuucaaaaugcuuugaaaaacuccaugaacguauuugauaaaauaguauaagacaaucauaaugaagcaguuuaaaaugaugugcuggccaggugugguggcucacgccuauaaucccagcacuuugagaggcuguggcagguggauggcuugagcccagguguugaagaccagucugggcaacauggcaaaacccugucucuacaaaaaaaucaggaaauuuagcucgguuugguggcacaugccuauaguucagaggcugagguggaaacaucaccugaaccugggaggucaagacugcgucgugccaggaaaaaaauaauaauuuuuuuuuuuuuuugagacagucucgcucugucaccuaggcuggagugcaguggcaugaucucggcucacugcaaccuccaccuccgggguucaaaugauucuugugccucagccucccgaguaggugggacuacaggcauuucucugcagaggacuaccguaccccuaguccucugagugccuugauugcuuuaggcacucaacaaauaguggagacagaaauacuaugcauuagugguccccaaccuuuuuggcaccagagacugguuucauggaagacaguuuuucuguggaccagaaaagggggggauaguuuagggaugauucaagcucauuacauuuauugugcacuuuauuucuauuauuauuacauuguaauauauggugaaauaauuuuacaacucauaauguagaaucagugggagcccugagcuuguuuuccugcaacuagauagucacaccugggggugaugggagauagugacagaucaucaggcauuagauucucauaaggaguagcaaccuggaucccucuuaggugcaguucacaauagaguuugugcucuugugagaauggggauggggaguggcuguaaauacagaugaagcuuugcucacucuccccugccuugccacuuaccuccugcuguguggccugguuccuaaccccuagggguugggaacccaugcuguacaucauggugggcaaacaaccacuugagggccaaauauggcucauugccaacuuuuauaaauaaaguuuuauuagaacacagcuacacccauuuauuuacuuauugacugauugccuuugcacuauagcagcuaguugaguaguuacaacagagacugugugacccacaaaguuaaaguaauuacuauuuaacuauuuacugaaaguuugcccaucucagcucuacguuuguaacugcaggcucucacaauuccacgucuuguaauuuggaagucacagaauaaaucaaguaauaugcuuugaggaauuaacuuacuacucuucauuaaugcaugugcuugacuauuguaagguuacauaugauuauuaaaauuauaggaguuaaacauauguuucaaggauagaauacacaauuacuccuuuuuguaauuuguaaaacaauguuuggcuaaaucuuacauuacuaguucuuuuuucuaccuaauaagguuguuucauugaaauggaacaaaagcaugguaauuaccaagcuuaucucucucucucucuuagcuuauccuauuuuaauguaguuugccuuaaucuugugaaaacuuucuaauuauaguaugaauuugcauucuuaaaauauguguucuaaaucagguuaacucauaaaguauuauuuuaaguugauauucauuaaguguauauauacacauauacaugagaaacugauuagaauagcuauaaaacagauguaaauucaacauuuucauucauucauuccugauaaaacuuugauugaacuuuuuacagggaauuguggauguccuaaggauugagucacagacacccuuccucacccaagaaagagcauaagaaguaaagcagaaagcauauuucaugaaauaagcuguaagaagagaaggccucugagauaauauagagaauuagguugucaaaucaggaacuggguaccaguggcucacaccuguaaucacagcacuugugauuagaggaggcugaggugggaggaucugaagccaggaguccagaccagccugggcaacauagugagaccccaucucuacaaaaaauaaaaauuagcuggguguggugguacaugccaguagucccagcugcucaggaggcugaggcgggagcaucucuugagcccagggguugaggcugcagugagucaugaucaugccauugcauuccaacuugggcaacagagugagacccugucucaaaaauaagagaaaaaaaagugucaaaucacauucacaagaaucagcccuuagcuuacaucaagguuuacuaauaauguucaggaauacgaguaguccucagguacaggauagccauccaucccuacucuccagguccucucuagcugcacuaggaugcugugggcccagauuuaagguacaagggcuuagaagcaaugccugugguauguuaggaagcuguuuccauuaggaaucauuuucgcuuuguacuccagugguugcauaacuuaugugacauauuuuccaaggggcuauacucccuauauugaaagauuccaaauuuguuaaccagaaguaauccuagacagauuagauacguccugcuaaaauccaucgauagggacuuucuuacuaauaaacaccauuggauuguuugucaagagaucugacacuaguauguuuacaaggagaauugaccagguuaacuaccuccuuucuuuauuuacuaggaguguuuccauagaccccuccccacccuccgcucccugcucuuaaggagaaaugaacuguagguuugcugcuaaccauuuuuucccaaucucucccuccagccugagcagagacaagacaauaauaauauagccaggucaguuagcaugugugcugaguuuucuucuguucucuuuuguuaaaguuugagauuuguggaugugcuuacauuuugaguaugauucuugucucuucagaauaggaaaggaaguguccaaaugagccuuucugaugcucaaacccucaugaugucauuguuuucuaaauauucuuguugccacucuguggaauguaguuuaaauaucuuaucccaccaucucaaggcaaugcacaggcugcucccaacuuaccuuuccaacuuucuuggcuuccauuuucuugaagaauccucuuugccaacuauauauugcugccucuaccucaagugugccuuccuuauuucuuugacuuuuccuaaguuccuucuuccaggaaugcacucucucucacucuccucccuguucucucaauucgagauuaaaucucaccuguucugaaaaacugucucaauuugcagcagacucuuuuuggaauuaguaguuacugucugugucugucaccuggaacuugccuuucuucuuaauuagaucaugagcuccuucagggugggcacuaucuuaggugcuuaggugcaguacugagaagauuaaucuuuaucuacuaggagcuugagcuauguguuguuaaaauacuugaauacugcuacuacuaacuaauaauagugaugagaauggaaauuuugcuuuguggaaaagcguuaaacaguuaucaagggcacacauaaauuuaccuauugaaacacgaggaagggccaggugcgguagcucacgccaguaaucccagcacuuugggaggcugagguggguggcuuacuugagcuccgguguuccaaacuagccugggcaacaugguggaaacccgucucuaccaaaaauacacaaauuagcugggugugguggugugcgccuguggucccagcugcuuggggggcugaggcaggaguaucgcuugaaaacccaggaggcagaagcugcagucagccgagauugcgagauugcaccacugcacuccagccugggcaacagagcaagacuucaucuaaaaaaaaaggaaguauauuuggaaaaguaaucaucaaacauguaagugucuuuuauguacuugccacugugccagagauccagagaugaaucagguguggcccuuguccuuaagagcacagucucauggcaagacacauacauuuuuucuuugcguuuuuaaaguguuuugcuuugaacauggauuacuuuuguuaucagaaaaggagcauguucuuuucguugaaagauaaaaguguacugggguuaagauauaagucagauuuaggaaugagacugcuaucaaaaggaauaccgugauauugacaacaaguagugggauugagugaaauaagccagccucaaaaagacaaauacuguaugauuccguguauaugaaguacugaagaagucaaauugauagaagcaguagaauggugguugcuagggguuggggagauggggaaaugaguuguuuaaugaguguaguuucagcuuugcaaggugaaaaaguccuggagauugguugcaggacaauaugcauauacuuaaugcuacugaacuguuuccacuuaaaaauguuuaagauggcacauuuuaugugauguguauuuuuaccacaauuaagauuguaggacaaaucugcauugcaugguugacucuagcacccuguugcauauagaagaagaaaucucauuaauccaggguuaggguuuugcugggccaguguagaauaagguaacaagggguacuauugaggguagguucacgugaguaguuaguucugauggaggagauggauagggaaggaauaagagguuaggaagaggucuuaaagaguaggcauacugggaaaaugccaaagacauaggagauuguaaucagacuaggaaacagaggcuuguguguauucuguggaagugauacuuaucuacauucauuaugaauggaaaucuguuggaugggaagcuucuuaaugguugguucaaauuuuuuuguacuucguguuaauuuagggaaugaggccaaauaccuggaaugugcucagugaaauuaucaguuaaauaauguguguguauugucacauaucuggaaguagcauccccuacagaaaaugccuuuggcuugcucuucuuuucccucugugcucuuauucuaagccacacauuucugagguguuugcugaguaguggacagaauucauaugguucauucccauacccuucuuguugucuaagggggauugauauuccacugagauuuggggauaaaauuauagauauugacuucacccuuguagauucugauuucauugcuuuuggguagaaccugggcauuucuacuuuuaauaagcccuucagaugauucugauauacaccaaaguugcaugacugcuguuugagagauaccaauuugucuuucuaaaguuagaauugccuugcuagauuucccuuugcuguauaacaucacuguuaucuaauguuuuuagacguuauugaaauuuggaguauugaaaaauaaauucugggauuuauuuuucuucugcuaagaauauuuauguuagcaagauauuaguauggauuuuuuucuuaaaaacacaaaagcaccuguaaucucagcaauuugggaggccgagguggguggaucacgaggucaggcauuugagaccagccuggccaacagagugaaacccugugucuacuaaaaauacaaaaaauuagccgggcgugaugggcaggugccuguaaucccagcuacucgggaggcugaggcaggagaauugcuugaaccugggaggcggagguugcagugagcugagaucacaccacugcacuccagccugggggacagugugagacuccauuucaaaaaaaaaaaaaacagaaaagcagaggcaugggcuauuucauguguuugaugaccagauggcaguagcauuaaccucuccuuaaaaagguagauuaauuuccuucacauugaggaaauucuguuuagucaauuaagacaacaucauuuagaagaaaaaguuuaauuacaaaaaggaugcuguaggcugggugugguggcucuugccuauaaucccagcacuucgggaggcugaggcgggcagaucaccugaagucagaaguucaagaccggccuggccaacauggagaaacccccaucucugcuaaaaauacaaaaaauuagccaggcuugguggugugcgcaggaggcugaggcaggagaaucgcuugaacccgggaggcagagacugcaugcagugagcugagaucacgccacugcacuucaaucugggugacagagcaagacugucucacaaaaaaaaaaaaaaaaaaaaaaaaaagcuguaauuuaagacugggaagacacaacaucaucacauuuuaugaaaugcuuuucuuugacaaauuauagcgauguucaacuaaauaagcaagauuuagaaaacuauggcuagguuccuauuauuaguuugauuuuaaaaguacauaguaggagcuaaaugagcuuaaaauuuaugguuauuuaaaagaagcuucaagcaguuuuaaaauguugauuaauuuuuuccaguccugccaauagcacuugcuuugcuuugcuuagauacguaugagaaucugcuuuuauaucagaaagcuuagaaugaaacaacuuauuuuugucuuuguugcauauuucauuaugaaacaaaauaaaaaguagaaaaaagugaaauuaauggugcuaauguauuuuauugaacuggauauauccaaaauauuauuucaaccuguaauuaauagaaaaauuacuuuuauuuuguacuaaaucuuugaagaaucauauauuuuucuuuucuauuucaauaaauuuuuagggaacaggugguguuugcuuacaugaauaaguucuucaguggugauuucugaguuuuuggugcacgcaucaccugaguaguguacacuguacccaguguguagucuuaucccuuaccccccucccacacuuaccccugagucugccuuugcauccucauaacuuagcucccacuuaugagugagaacauaugacguuuaguuuuccauuccugaguuacuucacuuagaauaguaaucuccaauuccauccagguugcugugaaugccauuauuucauuccuuuuuauggcugaguaguauuccaugguguguguguauauauauguauauuccauguguguauauauauguaguauuccauuguguguguguguguguauacauacacaugugugauugauauauauauauauauacacguaugugugugaauuauuccguguguauauauauguaguaucccaugauguauguguauauauauguguguguguauauauguguguauauauauaguguguguauauauauaguaguauuccauguguguguguguguguguguauacacacacacacacacacacacaccacauuuucuuuauccauucauuaauugaugggcauuuaggcugguuccauauuuuuguauugcaaauugugcugcuacaaacguaugugcaaguaucuuuuuuguaugauuacuuuuccucuggguagauacccaggagugggauugcuagaucaaaugguaguucugcuuugaguucuuuaaggaaucuccacacuguuuuccauagugguugauaugguuugacuguguccccacccaaaucucaucuugaauuguaguucccauaagccccauguguuguggguugugggagagacccagugggagcuaaucuaaucaugggggcaguuacccacaugcuguucucaugacagugaguucucaugagaucugaugguuuuauaaggggcuuuuccccuuuguguugggcacugcuugcugcugcgaugugaagaaggguguguuugcuuccccuuccaccauguuuguaaguuuccugaggccuccccaacccuauggaacugugagucaauuaaaccucuuuuuuuuuuucuaaauuacccagucucaccaguuuuuuauagcagcaugagaacagacuaauaacgaugguuguacuaguuuacauucacaccagcaguguaaaaguguucccuuuucaccacauccaugccaacauuuauuauuauuauuuuuuuauuauggccguucuugcaggaguaauguaguauugcauugugguuuugauuugcauuucccugaucauuagugauguugagcauuuuuucauauguguuuuggccauuuguauaucuucuuuugaaaauugucuauucauguccuuagcccacuuuuugaugggauucuuuguuuuuuuuccugcugauuuaaguuucuuguaaauuccgguuauuaguccuuuugucagaugcauagauugcgaagauuuuccccacucuagccacccagcggaguuucugggcucugggcugguacuggggggugucugcacagaguccuguuaugugaucugucuucaggucacuuagcuguagauaccagcacuugcuccaguagagguggcagaggagugaaauggacucugugaggguccuuaguuguaguuuuguuuauugcacaaguuuuguguugguuggccucuugccaggagguggugcuuucaagagggcaucagcugugguaguauagggaggaucagguggugggugggacccuggagcucccaggagauuauguccuuugucuugggcuacgagggcagguagagaaaaaccaucagaugggagcaggguugggcgugucugagcucagacucuccguggguggggcuugcugcggcugcuguggggguggagguguggcucucaggccaguggaguuauguucccaggagaauuauggcugcuucagcugugucaugcaggucaccaggaaggugggguaaagcaagcccuuacccagcucccacgcugcccaaaaggccagucucauucccaccaugcuucuccaacagcacggaguuuauuuccaggccgcgggugagcagggcugagaaccuaccccaggcuaccagccucuuggcugagaaaccaaacagggcuuucagguuucaggccuccccaccugcuguggcuucugugcugugucugcacuccugauucauccccucucccgaguucuguccaggaaaacuuugaguucuaucgaaauuguuacaaagcucagcuggaaguucccuucuccuuguggucuuuucccaguuccucugguagcccuccccaaggaccucugugagacagucagaaauggcuuuccuggggaccaagagcccacagggcucuucccgcugcuucuucuacuccuguauuucacuugacucucuaaauuugucucagcuccagguaagucauauucuucucuugugaucuggaccuucauguuccccagugagggugugugcuuggggguggaugaucccccuuucacacuuucacacucugggcacgcaacaguuuuuugguugucuccuguggccuacaggagcaaugcgcuugcuuccuucaaagagucuguggauuaucuugguuuuccuuauauguuccugcaguaguucuuggagcaaaaguucacgaugugagucuccacaugcugcucugagugggagcugcaaguuaguccugccuccuaucuaccauuuucccccaucuccccucuuaaguauuuuauacuuaaaacacauaucaaauugccccagacuuggccaguuggaagcccuuuuuaacuacugcuguauauuugugacauguuccccaucauuuuuugaggguacuuucuuucugguaugcaucuugucccugcuguuucccaacccugaaaucagucauuucucucaggaauccugguuccuuuuagugcaaaugguuuuaaagaccaagauacagguucuaggugugagcauugcacaugaggugccuuugcuagauggugagagcuaaggaauacauuuauguguacauauauguacauauacugauaugaacuacaugcaugcauacauguaucucuaccuacacuuuuaaaaaaaaaucaugaguucauaccaguauuucuaguucucguccauccccacagggaucuuucuugccuucuccugcuccauguuuguauaucccuuucaugaugagaaccuugucacucagcaguaucaaugcauucaaguguguguucaauccuauaacucaucuaguaugguuucccuauaugccuguuaaaaaggaauuuauauuuucuucuaguacuugagcuucauauuuuauauuuagauccuggaggcauuuggaguuuauuccucuguauugugugaggaauggguccaauuuuaucuuucuccaaauugcuauacgguuguaccaguccuauguauuaaaaaggucaucuuugugauuugagauguacuuuuaucauagguuagguacaggucuauuucuggacuuacuucuuuggcaucugugcgcauacgugcuacacacuguuuuaaucacaggcuuuuaauguguuuuaguauuucucauggcucuuccuuuucaguguguuccuagcugcuacuguauguuuauuuuuacauucaaacuuuauaaagaaaaacuauaaaaccacuguaaaagagcucauagcuauuggggggggguuauauuaaauuuauacauuaacuuagaacugacauuccacuccucccauuccucaaauguaagcaccuucuauggguauaauucuauucaucugcuccucccugcucuuugugcuauuguuaacuucuacguaugcugugaaccugacuuuacaauguuguuauuuuugcuuacaugaucaguugucuuuuaaagaaauuauggaagaacaaugauauuuuauauccacauauuucccauuuucagcccuuuucauggauuucuguagaucugaguuuccgccugguuauauccauugauauuguugagauauccuuaaccaagaauaaggaauggucuuuucauugguucaaggcuacuuuuguauucuuguauaaugagaaguggugggagaggacauucuuaccuugcucuugacuuuaugggaaaaauauuaaauauccuaagacuaguuauauucuuuaucauuugauuaugacucagagggcugguuuucaguuuuacaggaaauguacaaacuucaaugacuuaagguaauuuguaugaguuacuggcauuagaucucauccuaggcucacuguacuugcuacacucagcccggaugcuagucacccucaccaugggucuuaggaaauacugcaagguaauuuuaauauuagaugaagcaaaacauaauuaggaauguaaaucugcucaaagccccuuauguucuguaaugagcuccccagucccaaauuaaugauguuuugguugucucuauuauccuccucauuaauagaggaauuuuaauguugagaauuuguauuauuuggaccuguauguauauaucuacuccuuuuaauaccaauuaguuuaaaaguuuaacauuugguuucagcccuuguuugaacguaggcauggucacgggguuugaguuaaagccucuuaauugaauacaauuccucugcauucuuuuuuuaaaaaauuaugccagcugggcacaguggcacaugccuguaaucccuacacuuugggaggccgaggcgggugaaucaccugagguugggaguucgagaccagccugaccaacauggagaaaccccaucucuacgaaaaauacaaaauuagcugggugugguggugcaugccuguaaucccagcuacuugggaggcugaggcaggagaaucacucgaacccaggaggcggagguuguggugagccgagaucgcgccauugcacuccagccuaggcaacaagagcgaaacucugucucaaaaaaaaaaaaaaaaaauuaugccuuuuacaugauaaucuuuaaacaacauagccaguuuauaaguguuggauuagauuuacuaaugaaaauucuagccaaauguggauuuuaguuacuggcuuauagggacucaguuuuuuccuuuugccaccaaugggaguguaaugggcaugagugucauaugucaccagucuugugacaauugauuuguucaauuagcagugaaagacaagcucaucccuaaaaagagaacauacagagcuaagauuagaacagcucagcauuucaguugggcagaaccucaacugaaguauccucuuugagagggauuaaguuacacauugauggaaauccaugcuuggugauguuuuguauuguacuuugcccuuugaccaagaauuguccuuaacauuauagguaguaacuuuaugaggaaccucauuuagauaauuaauuagauuuucuauaaauauuuuacauaguugagguuauuucauacucuuuccucuuagaacuugucuccauguuuaaauguuccauaacugauaauuuuuuaauauuaagcagacacuccauauugcauaggaugccuuccaacuguggucugucaucauugcaaauagucaguaggcagccaacguguagggagcacuaauauuuaugccucuucuaaagaacauacguuuguucuuucccuuaaacuuaacaguucuaugaaguagauaguguuacaucuuauuuuacagaugagaaaguugagauuaauugacuuuacuaaggucacagaguuaauaaguugugaagcugaguuaaacauaucucuuugauuucuauuaccucaugcuguuuccaaagauccauagauaauuuacaucaugcagggaauauauagaugacacaaaucuuccuugaagccugggguucccucucuccuugcuuauucaaauacuguuauugggagauccaacauaaaaauagugaacugacuugcaguucauaccuucuucuuucucucucuggaaguucuucuguaugcuaacaccucucuaucagaagcaaaggaacgguauaagucauuagcuaguugcuagccuguaauugcuacuucaauuuucuguguaguuuauaacaaaucagauuuuuauguuuuuuuauauugccaguuagacaaauauacacaaugacuuuuuaaugcuuaaauaauauaugcuuuuauguuuagagcucuguauuauuaaccauuguauuuugcuuuuuaacagucucaguucguggcucagaaauucuuauuuaaauaucaugacccugggagagcccagcauaucaaauguaauuugugcuuuuaacgaagaguuauuucccaauuugcuguauuaaauaagauguauaccucuuuuuccgggcauugcauuauuucuaaguuacugugaaagaaaaguauauaaugccaugugaacaggguauguaaaguauuuuauccuucaaagguauguuagcaaaaaaggaggggggcagggaacaaagcuaaacacagaugagaauagcuagugaugcccuugauuuuguugugcgugcucuggauaucuuucuccuuuguuccucaaggggugucuggcaccagcuuugaucugcugccuucacagugguaucuggucaguagaacaaguuucaaccauguguuuugcuugacuccuacuuaauaugguauuggcagcggugguuuugauacugugagugaugagaagaggugguggugcuggaguuggucuugagaggaauaaggaacauuuauucugcuuugaugaacauuuuugagaggguauuuuaauggguuggcuucuaugcaguuuaguuuuuuagaacuguccucacuguuuuagcuucucucccaacccaauguugagucacaaugauucaucgguuuaaaacuguuuuucuuccaaagcaguugaauagagaauauuuaugaucuugacgucuccuaagauauuauuuguccauuuuguauaugggaaaauggaugaauggagaguugagugauaacuagucagcaguggcaguagaacugggaugccccuuaacucuccguugggagcugccaugaucacuguuggcuagacucaggaaacucccauuucuuuucaggucagucccuaccagaguguccguuggcccaucugcagaauguuccuguuauuccagccucaccaaugugucccauuagacagaucuccuucuagcaucaugaguaaugcccauugggugaguugggcauuuuaugaggugcauucucucucccugucacuuuuuaagauccuagagcacaaauucccacuaguacuuugugagagaggaagaccuuguauagcaucacuuuggcuauaggauaauuacaugacagauacuggcgcagcuaucuucacgucccaauuucuuccacacacuuuugccuuuguggccugaguucuuaacagcaccaggcacaaugcugugcagguauugaguaugugguaaauguguuugcuuuguauuauuuuuguuucccuuuuuucuuuccuguuagugauuucugaacagacaucuuacuaguuguccagcaaaauucacagccaccucacaccuuccccucuuguuuuuucacacuucuuuuagcuccccauugaaagaucucagagaaaugaaaggaauauaugucuuacagggaagccaaggagacucauuuuuaacaaguacuaccuugcuuacuaagcaauuuuuuuuuuuuuuuuuugagauggagucucgcucugucacccaggcuggggcuggagugcagcggugcgaucucagcucacugcaaccuccaccucccggguucaagugauucuucugccucagccucccgaguagcuaagauuacagguguccaccaccaagcccagcuaauuuuuuguauuuguauuuuguguaauuuuuuguauuuggccaggcuggucucaaacuccugaccucaggugauccacccgccucggccucccaaaguguugggauuacagacaugagccaccgugcccggccagcaaauguuuuuaaugcuuaaaaaaggugcuacauaaaugcaaaguuguggcaguuauaauuuuauauaccugauaaaauuuauaccuuguaaaauuacaauaauuguagccauuccaaaauuguuuugauuuuaaacauuugaaaagugaaauacuuaggugguuuuuuaacugguagcuugguguagggguaggaauggagcugacaccuuuagcaucuaaccaggauucuuuuacuucgaaagcugaauugcuaauuccaaagaacauuguguugacagugccugcaauuaagaagccaucaccuuuguguuaugacaguuuucuuccuuacuacaagcauuauuguuaccuggaauaaaagauuccugcuuuuuuguucacaucuugagcugguuaugaguauuaacccaugucacuguugguacauuuauagaguauaaaaucacucuauaauugcaaaugggcaaauagguuauucccaugagaacucuuagguuuuuuuguuuguuuguuuuuucucccugcacauuuuacuuuugucucuuucucugaauugccagccugugccacacuuggguguuggaaguaaaggugcuuuugcuuuccugagaaaccuggguucuacaaaaucacauguuaaaauaacagggcuuaagggaaaaauaaggguagaagcuggcuauugagaguuuauuccucuuuguaaccagaacacuaagaaacucaagcaccaaaacaaaacaaaaaccaacuuguacuuggggagauguuugagggacagcccaggcaggcagcucagagugguagaaaaccacuacaggggguauuaaaaauguacagaaacacuucagugcaucucugaagcagcuucagaauucagcaaaaaucaugugaaggaaacugcccagaucucaggucuccagcuuugucgcucuagaccaccccaggugacugcuccugucuuugcugguuugucuuuucuccugcagacuucuguaugaaucaagccccagcccucuuguaguuucuccauuaacugaauuauuugucuuuuuaaaauauugauuuauacacaauagcaaagaaguaaaaacaaccuaaguguuuauucauggauaaaugaauaaaugugauacaguggauuauuacucagacuucagaaaggaaauucggaaacaugcgacaacaaggaugaaccuugcugagacaaauaagccagucagaaaaaaaagaaaaauacuguaugauucuacuuauaugagucacccagaauggucagauucacagagacagaaaauagaaugguaguugccaggguucggggugaguucucaugggaauaaccuauuugcccauuugcaauuauagagugauuuuauacucuauaaauguaccaacagugacauggguuaauacucauaaccagcucaagaugugaacaaaaaagcaggaaucuuuuauuccagguaacaauaaugcuuguaguaaggaagaaaacugucauaacacaaaggugauggcuucuuaauugcaggcacugucaacacaauguucuuuggaauuagcaauucagcuuucgaaguaaaagaauccugguuauguguaauggguaaggaguuuuaguuugggaugauaaaugaguucuagggacagauaguggugauaguuacacaauaaugugaauguacuuaaugccaccggacuguauacuuagaagugacuaaaaucguaaauuuuauguauaucuuaucacaauacaaauuuuuuaauaagugauuuguaaaauauacaauguaaaugaaaaauagccuuuuaucugauguguugcaaguauuucuccugcauugucauuugucuuuugacuuuccuaaauuuuuggacauagagaugcuuuacauuuuuauguaguuagaugcauuuuguauuguguuuauaaaggucuucuucacuccaagauuauaaaagauaauacauuucacccauuuuuuucuucuagcacucuuaacuuuuuuauguugaaaucuuuacuccauauaguuuuuuuuuuuuuuuuagugcugggaauuuuguggauuaggacagcagggguauuucuagugcuuuauuguuuucaagguuuauuaggacuuuagagaaacaaccucuguucucugauucuuacauacugcugaauuuuaacuugucuacaguugucagaauggagaggugaggggaauaaaaggcagauagcaacaugaaaucuagcuuccaaggcugugauacauuaugaauacuuugcaacagucuggccugaaauauggcuacauuuccuuccuuccugaugagcugacuuagcaacaaaaaucuuuuaaaccagugaaaaauauggaacagaaggcuggcaaugucccuuagaaacaaugucucauucaaaaagcauaaucccauguggaagcaaaaugacugauguugauaccccagccuuuccucugagauacuccuugaaauucccagagcaaaacauagcugaccucagguuccugcccuugagacauaacauugccugagagagaggaaaagggacagccucugugucccaucauuugaggucucggcuguaaggagaggcccaguuaacuuggugccuaguaggugucagaaaacaacuggaguugggcgagcagggucuauccugcugauauuugagauauuaucauauuggacaagaugugguccagaugcuaguaugaggaggcauuccaagucuauaauuauuuuucuuuucauucgugguuugguagaaaaagcugugggccgucagguagaagaacuugguuguaauccuuguucuaccacucauuguuugacauuggaaagccuguuaaccaauuuguguacacccccuucccccccacaccccuuuuuaaaaacuagaugaauacauuuuaaaaauuguguuaaaauauacauaagauuuaccacuuuaaucaucuuuaaguguacaguugagugguauuagguguauucacacugcuaugcaaccaucaucaucaucauccauauccagaguuuuuuucauuuuccuaaacugaaauucuaugcccauuaaacaauaacuugccauugucuucucuccaccaccccuggcaaccaccauguuacuuucugucucuaugagucugacuacucuagguaacucauauaagcagaaucauauagcauuugucuguuuuugugacugguuuauucacuuagcauaaugucuucaagguucaauaaaaauuaaaaauagaauuauguauuucgagaauuccacuuauuauauagcccaaagaauugaaagcagggacuggaacagauauuuguacauccaacuuuauagcagagcauuauucacaauugccaaaaggugaaagcaaacucaaguguccauagagaaauaaauggaugaacaacuuguggcaucuauguacaguggcauaucauucaguauuuuaaaaggugcuucucauguuuuauaucucuaaaacuaggugguugaaccaguuaaucucugaagccccucuaguaucuuguguaauacacugguauggagggcuuguggguccuauuggugcauguuucauuuccucuuuguuguuugccuucccuaccccucccucccuccacccauuccacauacacagaagcucaagcacacacaauucacuccagcucuguucaguaaguugggagaaacguagaccuguucuuagguaaccaaguagcuuuaagcuugaccuuuuuuuaguagggcaaugauguuaauaaaaugcaauuuaacaacuuaaugcaugccuucauggcuauauggacagcaauucauguauaggagguacugagaaaaucuagaaauagaagaaagacaguguccuagaaauauagggaagacaguagguaacagguaugcuaaacauaagaugcaugguguuucagugcauuugguugaauugggugggugucugggagugaauuuuaccuuuuuuuuuuuuuuuuucuuucccgaaacaaggucucaauuugucauacaggcuggagugcaauggcacggucuuggcucacugcaacuuccaccucuggagcucaagcaaaccucccacuucagccucccucugggaccacaggugcaugccagcacuccuggcuaauuuuuuguauuuuuuguagagaagggguuucgccauguuucccaggcugauauaaacuccugagcucaagcaauaggcccaccucggccucccaaaaugcugggauuccaggugugaacccuggcguccagccaauuuuaucuuccuuuggaagaaaauaaucccuggagaagauuaguuugguuuggcauugagggauaggcagauugugagggcuggacuuucaaaguuuauugagcaucuaauacaugucagauacugggcaagcucuuuuauguauauuaucucucacccuacagauagccuuauagaauggguguuauuauccuuauuuuuccaaugagagaauugaagcuuagauaauuuaagaaacuucuccaagguuucacagcaaguaaguagugaacagcaguuuaaacucaguuuuuucugaccccaaagccuguggguuuuuuuguuuguuuguuuuguuuugacaccuaauuaguuuaaacaccuaauuaguugggaaacaaaaguaguuuuuuuuuuuuuuuuuuuuuuuuggagacggagucuugcucugucgcccaggcuggagugcgacggcgcaaucucagcucacugcaaccuccaccucccagguucaagugauucuccugccucagccuccugaguagcugggauuacagacgugugccacaacacccggccaauuuuuguauuuuuaguagagacgagguuucaccguguuggccaggcugaucucaaucuccugaccugaggugauccacccgccucggccucccaaaguacugggauuacaggcgugagccaccacgcccaaccaaaaguaguuaucuuuuaacagauuuuuaaaauauaauuaaauauaaccaaacuucauuauaaagaacaacagauauacauauauaugugugugcaugugugugcaagcgugcauauucguguguguguguauauauauauauauauauauauuuuuuuuuuuuuaaagaaacagucucggccaaggcagguggauuaccugaggucaggaguucgagaccagccuggccaacauggugaaacuccgucucuacuaaaaauacaaaaaauuagccaggcgugguggcgggcaccuguaaucccagcuacucgggaggcugaggcaggagaaucguuugaacccgggaggcagagguugcagugaccugagaucauaccacugcacuccagccugggcgacaagagcaaaacucugucucaaacaaaacaaaacacagucuuacucuguugccuaggcuucagugcaguggcacgaucauagcucacugcaguuucgaacuccugggcucaagugguucuccugccucagucucccaaguaguugggacuguagguguguaccaucaugccuggcuaauuuuuaaauauuuuguagagacaggguaucacuacauugcccagguaggucucaaauuccuggcuuccagcaauacuccugucuuggccucccaaaaugcugggauuacaggugugagcuacugcaccuggccuacaaauauguguuaauauauaugcauauacagucaugcacugcauaaugauguuuuggucaaucauggaccacauauacgacaguggucccauaaaauuuuaauaccauacuuuuaccauaccuauucuauguuauauauguucagaaacacaaauacuuaccauuguguuauaguugccugcaguauucaguacaguaacaugcugaacaggcuuguagccuagaaacaauaggcuacaccauguagccuagguaggccaugccaucucgguuuguuaguacauucucugauguuugcacaaugacaaaucaccuaaugaugaauuucucaaaauguaucccuauuguuaugugaugcaugacuguauauacacauauacaauauauauucacuuauaaacaaguauguucuuuuauauauaccauguuuucuauuuuucauucuuuucagauucaguuaagaucuauacaaugcaaaguguuaauauuguuauauuuuuccuaaacacaucuccuuacuaggaucccaugugugcuuugaggaaacuuguaguuaaugagauuauguaaugccaaagcauguaaaauuagucuaagggagaccaagaugcuguaucaaucagggucuuaguugcaagcugcagaaacugacuuaggcaaauuuaagcagagaaggaauuuauugaaaguauuuugggcagcuuacaaccucucugggagcgcccagggacuguguucaaaaacuagaaggaaggcuaguauagggccucacauugcagagcugacugaagaccugcuguugcugcacacaugagcacugcaauuugugccauccaugucaguguuacugucacugggcaguggacacugcuacugccucuguccuuuuauaaacuguuuguaguugccaccacauaauacuaagaauggauucugcauaaucccucauucucaucccuaguuuuugauucaaauacugcgggugaguauuuaugaucaauguggccucauuuacgugccgaugucuagagcaagagaugcuggaaaagaaguaucuagaauuuucugcuuugauaguaggagaggggcucuguuuuauaaggugagggaugcuaaggauuaggaaggggauucagauccuggcggccaaaagaaugacaaguggcuccauuagauggcauuugcuuuagcaguugugaaggguggaggguaaauugaucaucaaacuauaggagagacugcuaaagauaaacacacaggauuaauggauaaauuaauuaguuuaauuaagcuacagaauuuauuccuaagaauuuuuuaugauaucaaaaaugggauuguugucuugauuucuuuuucaacuaggcuguuuuauuugugcguaggaaugcacugauuuuuguguguugauuuuguauauugcaacuuuacugaguucauuuauucuaacagguuguuacuauguggaaucuuugggguuuucuacguauaaaaucaugucaucuccagauagagauaaaggcauugauuuggaugccuuuucuuucuuguuugauugccuuugcuaguauuuccaguacuauguugaauagaaaugggcaucccugccuuguacuggaucuuaguggaauaguuuucauuuguuuccuguugauuaugauguuaguuguauguuuuucaugagugaccuuuauuauguugaggaacuuuucuuguaugcuuaaacugugaagaguuuuuauugagaaagaauauuuaacuuugucaaaggcuuugucugcauccauugagaugaucaugggguuuuuaaaucuuucauucuguuaaugugguguaucacauugauuuuguguguguuaaacuagccaugcauaccaggaauaaaucucacuuguuggugaugucaucaacaaaaauaaaacacuuaggaauaaauuugaaggagguaaaacauuuguacacuaaaaacaauaaaacguugaaauaaagaggaugcaaauaaauggaaaauacccugugcucauagauggccuuggcaaugacuuuuuggaucacaccuaaaguucaagcuacaaaagcaaagauaaauaaauacaugaacuauaucaaauuaggcuucugcacagcaaaacaaacaaaacaaaaaaccagucaacaaaauggaaaggcaaccuaugggcuaggaaaaaguauucacagacuacauaucugauaagagguuacauuuuuaaguuuuuagaaauuuuaagaacuguuagaacucaguggcagaaaaacaaucuguuuaaaaaguagacaaaggaccugaauagacauuucuccaaaaaagacauaaaaauggccaacagauauaugaaaagguguucaacauuacuaaucauuggggaaacacaaauuaaaacuaccaugagauaccaccucauguucauuaggauggcuguuauaaaaaagucaagauguaaauguuggugagguguugagaaaagggaacccuggcacacuguuggugggaauguggauugguauagccauuauggaaaacaguauggagguuccuaaauaaacuaaaaauagaacugccauaugaccuaguaaucuuucuucuggauauauacccaaaggacaugaaauugaaauugccaucuuguaaagauaucuguacucuauguucauuucaguauuauucacaagagcgaagauauggagacaaugugaguguccaucagugggcaaauagauaaaacgugugugcguguguaugcacgugucgguauuucauuguauguggacuucuagugugugaauaucuaguccuuguuggcaugauaccuuuugaaagguaagguagagucuuuuucuuuucuuuuuugagguggagucuugcucugucgcccaggcuggagugcaguggugcgaucuccgcucacugcaagcuccgccucccggguucacaccauucuccugccucagccucccaaguagcugugacuacaggcgccuaccaccacacccagccaaguuuuuuguauuuuuaguagagacgggguuucaccauguuagccaggauggucucaaucuccugaccucgugaugugccugccuuggccucccaaaguccugggauuacaggcaugagccaccgugccuggccaguguaagguagaaucuuuuucuaagauggaguuacuuacaucaagggugcucuauagacauuuccuucuuucuagccccagcccaaggaaucuuugaaggaaagguagaagauacgucucaagguuacuacugaagaaaacacaaaaaacuguucguuggcaguuaauaguugucuggguauugcuauuuaugaaauagaauaauuaagacuuuaaauuaaauuugauuuaaacuugucaccuauagauaaaugucaaguuuuagaccuuaagguaauuauuguaugguugaaaauaaauacagcaccaaugauauuuuacuugaccuauuuugcuaugcgaucaguuuuuuuuuuguauuuaaaaauuacuaaauuggcuaggcaugguggcucacaccuauaauccaagcacuuugagaggcugaggugggcagagcucuugagcccaggaguuugaaccagccugggcaacauggcaaaaccaugucucuacaaaaacuaccaaaaucaacugggcgugguggcucaugccuguagucccagcuguuugggaggcugagguggaaggaccgcuugagccugggagguugaggcugcaguaagcugugaucaugccacugcacuccagccugggugccagaaaauaacuuugucucaaaaaaaaaaaaaaaaauguucucccaaaacucuauccacuuucccgcacuaaguagagugacuguaaucucacacaguugagaacauuuagacauaauguggcuuugugggagaggugaccuucuagauucugaaggguuucaaggacucauuuccaauagaacaacuauaauugcaguauccuagaaaagggcuuagagagaagaagaggaaagaaaaaaaaggugauucauaaauacagauguagacacuaggacaauaauacaugcgauaauugugaccuuggcauucuuacugugaauuuccauugaauugcuguaaguuagauucucuguucuguuuacuucuuugcacaugacuuuauacuugugugugaaaaaaaaaaaaacugaacugugauuugaggauccuuagcuuuuaaucuaaaagaaugaguugguacgaccucuggaacauacuucuggaaggaagaauuaccuaagagaaugguuuuucugcuagucagaaaucuaaguuuuguaugcuagcuugcaaguuaaggauagaaaaggcuuucccuggccgggugcgguggcucaugccugucaucucagcacuuugggaggccaaggcagguggaucacgaggucaagagacugagaccauccuggccaacauggugaaacccugucucuacuaaaaauaaaaaaucagcugggcuuggugacgggcgccuguaguuccagcuacucgggaggcugagcaggagaauggcaugaacccgggaggcggagguugcggugagcugagauggcgccacugcacuccagccuggaugacagagcaacacuccgucucaaaaaaaaaaaaaaaaaaaaaaaaaaagguuuucccugaagcaaauaaauguaaacacuuugaaucaauguugcauuuucaagagaaaacuauuucagcagaugaacaaaauagauuaaacacaauagcaaaaucuuugaggacccuccagcuguuucuaguucuacuaccauaugguagcuggaucaaugaagaaaauucaguuugagcaucaguaauugcuaccugggugaugugaacaaguucaaagaacugcacuugaaaguguccugucaacaguguaugagccucuucacugugucauaggggcagaggugaguaccacaguuaacucucucagugguccccaaaagucugcugaaugaaguacagaauccuuauuuaggcaugugaccaccuucuaucugguccccaccuaccuuuccaguauaucacacuuagagcuaaugcuuuuaucaaauuggacuccuuccugguaucaucacccuuuccuaccucugucuuacaacacuauaauauuucccccuuuacucggaauguccuacucuucuccuuuauaucucuuaacccaaauuauacuccucuucaggaccauuucaaauacuauuuuugaauaccaugaaguccucuguuaaucccccugggacuucugaaccauagcacuuuauaugucuuuuuguggcauuugucauguuuuugucuuguuucauagcuauuuuuguguguuguggguugaauugugcccuccuaaaagauauguucaaguccuaaacuucaguccuugugaaugugacauuauuuguaaauauggucuuggcaaaugugaucaagugaagaugaggucacacaagaugagggugugucccaguucaaugacuagugucaaaaggagagagaaauuuggacagagacacagggaagaaggccaugggaccacagaaucagugauuggagugaugcaacuacaaacuggaaugucagggguugcuagcaaggcuagaugcuaggaagaugaggggaagcuccuccccuagagccuucagagacagcauggccuugccagcauguugauuucagacuucuaaccuccagaacugggagaauaaguuucuguuguuuuaagccacucacuuugugguccuguacaaggcugcccuaggaaacgcauauaguguguugaucuaaucucuaguccuccccaggcaauguauuauaaguugguaaagagcuugggcuguuuuuuacucaucauuaucuccuuagcagugacugagucauucagcuguuuuguuuuguuuugagacggagucucgcacuguugcccaggcuggagugcaguggugcgaucucggcucacugcaagcuuugccucccugguucacgccauucuccugccucagccuccagaguagcugggacuacaggugcccaccaccacgcccagcuaauuuuuuguauuuuuaguagaaaugggguuucaccguguuagccaggauggucucgaucuccugaccuugugauccgcccccuucgaccucccaaagugcugggauuacaggcgugagcuaccacgcccggcccauucagcuauuuuuugcuuugcuuuuuuagauacagagucuuugucacccaggcuggagugcaguggcacaaucauaacuugcuuuaaccuaaaacuccuuggcucaagccacccuccuaccucagccucucaaguagcuaagacuguaggugcacaccaccauggcugcauacauauauuuuugauuuuuaguagagauaaggucgucuuauguugcccagacuggucuugaacuuuuggccucaagcaauccuccugccucagccucccaaagugcugggauuauaggcaugagccaccaggccuggcagcuguuguuuaaaaaaauaaauucauggccgggcgcgguggcuuaugccuguaauccuagcacuuugggaagcugaggcaggcagaucgccugaggucagggguucaagaccagccuggccaacauggugaaacccugucucuacuaaaaauacaaaaauuagccaggcaugguggaggcugaggcaggagaauugcuugcaccugggagguggagcuugcagugagccaagaucaugccacugcacucuagccugggcgauagagugugaguccaucucaaaauaaauaaauuaauuaauuaauuuauguuuauugagguauaauuuauguugagcaaaauucagccuuuuuagguauacaguuuuuacaaauguaaguagucugugaccaccaccaacacauagaacauuuuuaucaucccagaaaguucccuauguaccuucccaguccuuuccuggcaacuauagauuuguggauuuugucauuuuuagaauguuauguaauggaacccuauaguauguagccuuuuaugucuggcuucuuucacauugcauaaugcauuggcgauucaucuauguuguugcacuuacuggaagucuguuccuuuuuacuacucauucagcugauuuuugagugucauugcacgcuagcuauugugcuaauguccugcagauggauuaaugaauagggugggcacaauaucuaccuuuuggguuuuauaugucagguaauaacaauagaguaucauaaguguugugaugguaucaaguacaguguauuauauaggaguacagaggaggaacauuuaacagauuugaaggaucuuaaaaggcuuccuagaggaacugauguuuaacuugagacucaaggaugaaugauuaggcuccaggcagaugaugagagggauggaugcaggcuuauaccagcuucagaguugauuguuaaaaauucaggaacucugcaaguuaguggcuaaauuuuugacagauugaaauuggccguggugggugugcuuagaccauggauauuguuaaacacaucaaaugaggacucucucccagccccuaaacaguucuccuggacaccacuggauggacaaguauuauaaccaggagagauaauuaacaugaaugcaagaaagaacauggcauuuuugaagaacugaaauucaguacaguugaaguauagaguguaagggagagaacugacgccuggagaauucgaugggugccagauuguauugggugauguaagcuaugcuaacaagccguaauguccuuuucugcuaauuucauaucugugucaguucuggcauuauuuugauugacugaucauucuccucuuuagggggccauuauuuuccugcgucugugcaugccauguaauuuuugauggcauaucagaaauugcuuuuaccuuguugagugcagucauaauuuuguauuccuauaaauacuauguaguuuuuauucugggguauaauuaaguuacuuggaaacaguuuaaucucuuuaggucuugcuuuuaauauuuguuaggugagaccagagcaauguuucguguggcguuaauuauucucuacuacagcaagacccuuuugaauucucuacccaaugccucaggaauucucuacccacugccuuaugcguuaggaggcaugaauuagggggcagacuuugugacuguuucagguaggaggguacauuugaucccuagccuccaucauggcuggauauaaaaguuauuauaccuuaucuaaaauuaguggagggcaguuauagagagguuuaacuaagagucuggcaggaucagauuuguauuuuuaaaagaucauuuugaauauaauacagauaauggguuguucuauuuaucugguggaguugguggggccuucagaauacuauauuggagguagguaaaccaguuagaauacaacugcagcgauucaguuaagaaguaguuaugacugggcugggugugguggcucaugccuguaauuccagcacuuugggaggcugaggugggaagaacacuugagccaggaauucgagaccacucugggcaacauagggagaccucaucucuucaaaaaauaaaaaaguuagcugggcaugguggugaauaccuguagucccagcuauucaagaggcugagguggcaggauuacuugagccugggagauugaggcugcagcgagcuaugauugcaccacugcacuccauacuggguaauagaguggggcccugucucuuaaaaaaaaaaaaaagaaauauaguugcauugaaaacagugucugaguuguucaaaaaguaucucugaaguagaaaauauaaaccauugcagaagaacagugaaaaaaauaguagguuaagcuucaaagauaaaaaaaucagcccaaaucugauuuaaaaaauacauugucauacuagagaguaaguuuguuugaauucagaagggugcccaccagugguagaauccaaacaccuacagauggguauggaagagcuaugacacuaagcacuagaggaaaguugaagauggaaacguucuuucaauaaaagaacauucugggaucuugcuaugcuauagaaucgguauccaaaagguagugcaaaguuuaauuuccagauggcaccuuuuaaucacauagaugacauccagcaauugccaucuaaggauauacaaguuaggaaaaaguuguguggaaacagagcuuuaaaagcaauuaaaacagcauucuauuauuauuauuauuauuauuauuguuauuauuuuuuuuuuuuugagauggugucucacucugucgcccaggcuggagugcagugacgugaucuccgcucacugcaagcuccgucucccggguucacgccauucuccugccucagccugcugaguagcugggacuacagguacacgcugccaugcccaccuaauuuuuuguauuucuguagagaugggguuuuaccguguugcccagguuagucuugaauuccugagcucaggcagucccccugccucggccucccaaagugcuagugagccacugugcccggccgaugauuuuuuuuuuuuuuuuuuaagagaaaaacccuauccaccccaacugccuguguucuucuacuuuauuaaacuuuuaguuacauuuuuaguauuagcugucagugguuucaguuucauuuaccagaaaagaggaguaagauccuaaugaaggccugucagugccuuccuguuauguagcugcaguauccagugcguguucuuucuggagauugggcagaguucaguggcuccuuccugguucugcacuuuuggugcugguagugcuauuuaaaauucuuggcaucagucaggcgcaguagcucacaccuuuaaucccagaacuuuaggaguccgaagugggcagaucaccuaaggucaagaguuugagaucagccuggccaacauagcgaaaccccaucucuacuaaaaauacaaaaauuagccgggugugguugugcugacuuguagucccagcuacuggagaggcugaggcaggagaaucacuugagcccaggagguggagguugcagugagccgagaucacgccauugcacuccagccugggcaacagagcuagacucugucucaaaaaaaaaaaaaaaaucuuggcaucaagguugcuccuccuucucauucuuuucuguuugaaaagccuugaguuggaacuuggugucacugaugaauugauggaacaccgugaccacacucuauuccaacugcuucuuugauuuauugcacauuuggucugagccagaaguagcuaaucagaggggcugcauaagcacagcagggaacccagagagugcacaccccuuucugcuuuuccuaucaccagcuuuaagaugcuucagguagaguucacuuugcuaguaguggugaugccaguuuuuauucaggaaagaaaguccaaaaagaacaaaaguaaauuucaaaagaauucacauuaugcauugcaaacaauaguuuaaaaacagaauauucaggaaaauacuacuuugcuuguuucuuuuuuuccacccaagcuggaguacuggggugugcucauaccucacuguagcccccaacuccugggcucaagcuaucuucacagguagcagggauuacaggugugagccaccacgcccugcaaauacuacuuucugauauaagcaaggcugguguuuguaugaauuucuuccuacauguuaaaauuucuguggagauacagccaauaucauacugaaugggcaaaaacuggaagcauucccuuugaaaacuggcacaagacaaggaugcccucugucaccacuccuauucaacauaguguuggaaguucuggcugguguaaucaggcaggagaaagaaauaaaggguauucaguuaggaaaagaagaagucaaauugucccuguuugcagaugacaugaucguauauuuagaaaaccccauugucucagcccaaaaucuccuuaagcugaugagcaacuucagcaaagucucaggauacaaaaucaaugugcagaaaucacaggcauuccuauauaccaauaacagacagagagccaaaucaugagugaacucccauucacaauugcuacaaagagaauaaaauaccuaggaauccaaauuacaagggaugugaaggaccucuucaaggagaacuacaaaccacugcucaacaaacuaaaagaggacacaaacaaauggaggaacguuccaugcccacggguaggaagaaucaguauugugaaaauggccauacugcccaagguaauuuauagauucagugccauccccaucaagcuaccaaugacuuucuucacagaauuaaaaaaaaaaacuacuuuaaaguucauauggaaccaaaaaagagcccacauugccaagacaauucuaaguaaaaagaacaaagcuggaggcaucacgcuaccugacuucaaacuauacuacaaggcuaccaaacagcauggugcugguaccaaaacagagauacagaccaauggaacagaacaaagcccucagaaauaacaccacacaucuacaaccaucugaucuuugacaaaccugacgaaaacaagcaauggggaaaggauucccuauuuaauaaauggugcugguaaaacuggcuagccauauguagaaagcugaaacuggaucccuuccuuacacuuuauacagaaauuaauucacgauggauuaaagacuuaacuguuagaccuaaaaccauaaaaacccuagaagaaaaccuaggcaauaccauucaggacauaggcaugggcaaggacuucauggcuaaaaugccaaaagcaauggcaacaaaagccaaaauagaugaaugggaucuaauuaaaccaaagagcuucugcacagcaaaagaaacuaccaucagagugaacaggcaaccuacagaaucggagaaaauuuuugcaaucuacccaucugacaaagggcuaauauccagaaucuacaaauaacucaaacaaauuuacaagaaaaaaacaaccccaucaaaaagugggcaaaggauaugaacagacacuucucgaaagaagacauuuaugcagccaacagacacacgaaaaaaugcucaucaucacuggucaucagagaaaugcaaaucaaaaccacaaugagauaccaucucaugacaguuagaauggcgaucauuaagaagucaggaaacaacagaugcuggagaagauguggagaaauaggaaugcuuuuacuuuguuggugggaguguaaauugguuccaccauuguggaagacaguguggugauuccucaaggaucuagaacuagaaauaccauuugacccagccaucccacuacuggguauauacccaaaggauuauaaaucauucuacuauaaagacacaugcacaccuauuuuuauuguggcacuguucacaauagcaaagacuuggaaccaacccaaauguccaucauugauagacuggauugagaaaauguggcacauauacaccauggaauacuaugcagccauaaaaaggaugaguucauguucuuugcagggacaugaaugaagcuggaaaccaucauucucagcagacuaucacagaaaaccaaacaccacauguucuuauucacaggugggaacugaacaaugagaacacuuggacacagacagggaggggaacaucauacaccagggcccgucagggggugggggacugggggagggauagcauuaggagaaauaccuaauguaaaugacgaguuaaugggugcaacaaaccaacauggcacauguauaccuauauaucaaaccugcacguugugcacaugugcccuagaacuuaaaguauaauaaaaacaaaccauuaaaaaauaguuaauacaauauaaaacaaaauuucuguggggauaaauuucuaaagcuugcuuauuaccaacaaggggaauguuuaaaagccagacauuuuaguauaucuuuuaggauuuuuuuuuuuuccagacagagucucacucuguugcuggagugcaguggugugaucucggcucacugcaaccuucgcccccuggccucaagcaauccucucaucucagccucucaaguagcugggacuacacaugugcaccaccacgcuccgcuaauucuuuaaauuuuugguagugaugaguucucacuauguugcccaggcuggccucaaauuucagggcucucaugauccucuucagccucccaaagugcugggauuacagcugugagccaccaugcuuggccaguuuuaccuuuguaauggucauguucauagcucaucagcuaguaaguuugcacuguucacuugucuuggauagugguaauugcuggaauauuacauuuugagauccauccuuaguuucuuuucaucuuucucccuuuuugagagugguuuaagaaaauucuaauugaagaucucugccauuuuuuucuccuucccacuuguucuuauuugaguuauuugauuuacuagaaauuucugguugcaaacagaauucuguauuuuacauuuuugcccuauacuuuuggcaagcuucaugaaaguaacaugauuuccccccuuauuucucuguuuccuuauccccuuuauggcacauagacuacugauguucauuuguugauuuuguuuagccuuguauucuuguucguuugcucauuuauucuugcaugcauauauuuacgcauuauuauuucccuccuuccuaaaugcacauuuacuaacugccuacugugugccaggcaccgcaccagucacaagaguaguaauaaaaacugggcucugacaguuaacagugcuuuacugaagauguguacauugcagaaaucauguuggcuuuguguggagcuaggcagcaucgagccccaacuaagauaagaucacuauauaccucagacuacugaacauauaauguguauuaucccuugaggaaguaaaaaaaccagaaaaccaaaaaauguuuugcaucaaugaacaaaaaccuagacacuaucagugaugcacaaacaucuccagagaagaucaguuuggcacgucggagagggaacucgccuugacaccuuguggccacuugguuuucugugaaguuuggaaucgguagaauguaggguuuguaucuaccuugccguaccuugaccccauugguggagagcacauuuguuugcacaucauuuucaggaccaagcuucgagucuccccucuaaugguaugcccgauuuucuauaaauguaugcugugacaagaagccacagcugcuccguuagucucaaaggacaugaccugaaaaagaauaaaaaucagauugcacauauuugcucuaauuuuugacaggaaggcuaaacaaaacauuuaaaaauucaaauuacucuguaugucauuugcccauuuaaaucacagcucuguagaauacuguuuuucaaaacuaaaaauaaaagaaaaccuaaugagaugagaaggcaaguuggaugcguauuuuuuuuugugcagaaacauauuucauguccauuggguugaauaggagggggaagaggcagagaaacagauaacuuaagauuuacauuguagugucagacagguguauucaagggacauuauggacguccuaauuagucuaauauuauuuuagaguuuucagcuaagcucauagugugcacaaaaacaaacagaacagacucacaagccaacaguggggagagcaauaaaagcaagaaaucugcuggauacuuacagaaaugaucuuggcauuggugggaaaagguuuuguuauacugacagagauuaaaagacuagcauuauuugaauaaugugguuuuagaguuuuugaauuuauaugucauuuaaagucuuuguaguacagcagucaaaaaagaugcccauuuuuaugauuuuguuaauagauuuuucauguuuguauuuagaaaucuggaagauguucaaaauauuaaaugauaauuuucugaaagauauuuucaaguauauacaaauuaaaauaauaauuuuaaaauaucuguaagacguacaucucaccugaguuauaugaaaauagcaaaaaagaauuccaggcugggugugguggcucaugccuguaaucccagcacuuugggaggccgaggcagguggaucacgaggucaagaaauugagaccauccuggccaacuuuagcugggcgugguggcaugcgccuguaguccuagcuacuuggggaggcuaaggcaggagaaucacuugaaccagggagucggagguuguagugagccaagaucgcgccacugcacuccagucuggugacagagugagacuccaucucacacacacacacacaaaaaaagaauuccaaaaguauuuuccauaggcaauuuaaaauuaauauuaaucacacuggauauaaauaaauauuaaauauauugacuauaaaacauuaacaauaauuugauuggaguuacauugacuauaaacauuaauauugacaucuuuacaguuguaaaguuucauccaggaauguuccacuuuuccauuuauaccucuguccuuaucuuuaccuuguucacauuuuaugcucuaguaacagcaaauugcuugcacaucccacaguaccugcauuuucuccuuucugauuuuggcccuucuuuuaguuaccaucuccuucuggcuuuuugccugggcagcucuuuguuuuccgucggaucaggugucacuucuccuaggaagccucacugacucugccccaaccuggauucacuaugccccccuucccccugccacacacacacacaaugcucccauaagacuuugugucugucauugcauguucuguaacugcuuauuuaugugauccuuaacucauuaggguauggcacuaaucuauuuaauuuuauauuuucagcacuuaauacaguaucuggcucuuaacaaauuuuuguuaaaugaauaaucaaggaucuuucuguguagcuuuauauuuuuuuucauauaggucucacccauucuuaagguuuuguugcugucacggagggguuacuuuuuucuccuuaaaguuauuacuuguuuauauugguaguaugugggaaaguucuuucucaucugcucucccugagggugaacuaggugugguugcaagauugcugaugguguuguugggcuuucaacuccaggcauuggacccggaagcuuugauuauuuguauggugguuuucaccaacaaaguuaacuaauacucaacauuuuaggugucagacaaguuauuaguaagacacauaagcuucuugguggaccaaaucuuuucuaaauaaauuaguaucacgagcauaucauuguguguauaaaauaauaaagggagagaaugugacccccucuaaguccuugaggaaagaauucagauuuccuuuaaguuucuuuuuuucuguuucauguagucuucucuugucuuguucaacucagagucugucugagaauaaggagagcaggaguguaucuucuauauuuauguuauuaacauacaauaguguuuggcacauaguugugcuaaaauguaugaaaaaugaaaauuaauaaauagaaucaucacuccugaagucauucccauuuuccccuagaaagguaguaaacaauauuuauuuugguaaaagcuguuacauucugcuggaaacuagaauuuuaccccauaauuacccuauguuagaacugaaaaaaauguugaaaggcacauugucuaaaauuccaguuugagaagucugaauauuacaaguuuucaaaaugguugggagacaacucaugguuuagugagcacaaucccuccccuagaagcugacccuuauuaacuagcuauuucucaaguaguuuggucccauaacuugucacagagaguauuugcuuccuaaccccauagucauucucccuuuuucucugugguaauagaaccucugauucuuaucuggacucauggccacccgaaaaaaauuaucuuacauacuuugugguuugauagaacuaugauguauuucuuauacuuacaauauagcucuguccaaaagagaaaugagugcaaauguucuauuguaguuucuagaaaaccuuaauugauagaugcugcaugccuucugcccccuuuucuucaacuauuuuuccaucucgcugccuggaauuuugaugggauagcaggagcucugguucucauauuggacuguggcaagaagggccuccccaggcauggcagagcaauagggggagccugggccaccauaccagccuuugacugcuggacucuguacuucauuuaguugacaaauguauuagucaauucucacacugcucuaaggacauacccaagacuggauaauuuauaaaggaaagagguuuaauugacucacaguucugcagagcugcggaagccucaggaaacuuacagucaugguggaaggggaaguagacauguucuucuucacaagguggcaggagagagaagaaugagagcugagugaagggggaagccccuuauaaaaccaucaacucuccuuugggaggcugaggugggcggaucacgagguuaggagaucgagaccauccuggcuaacauggugaaaccccaucucuacuaaaaauacaaaaaaauuagccgagugugguggcacaugccuguagucccagcucuuugggagggugaggcaggagacucacuugaaccugggaggcggagguugcagugagcugagauagugccaguacacuccagccugggcgacagagcgagacuccaucucaaaacaaaaaaccaucaaaucuugucagaacuuacuaucaugcgaauagcauggggagaccgccccccaugauuccguuaucucccacugggucccuuucaugacucguggggauuaugggaacuacaauucaagaugagauuuggguggggacagagccaaaccauaucaacagagauagaaucuuuuaucuuguuugggccgugauauacagguacaggucuuuguuacaugcagccagagcuuauccugacacacuauacuacagaucaguucuaagaucuuaugacuucauugcccauccaaagacugaucuuuguauucccuuauuuauucagcuuugucaagucaucuacucucaucuuggaguucugugccaggguuugaugcuggccuuguucugaaggugauugaucugacaauuuuuacuaggucauauacagugguacaggguuaacagaauagucaccaacuguuuuggggaaaacagcuggguucuaaauuccagaaugucaucauccuuuucucauaaagccuagaaucccuuuaagguaccuuaguguauuuggcauuuccuucaacauaauccaugcagauggggaagcagcuuuuuaauggcauugggaagauaggcacaaccuauuauguagugcucaguguggauguucgaugcucaggggcuuuuugggcccuacacuuggugagaaagcuaauuauaagucacuguugagcaggaggagagauuuuuauuauuauucucuuguucauuuagcucagccuaacuuuuaaaauaaucaccguagugacuugcauagucuuccucacaaagacaaaguguuaggugucgcuuguuuuaggguaaauauugaggugaaggacaucacaucugcaucuacaaaggcugaaucauggaagcuagaaauuggaaguggugaagaauuuuuauguccuguaggcugagcuguggauuuucccuggauugaucugugucagcguggagacuuaggauccaccuugacccuccaaauaugucaucuuucauagaugagauuagagaaguucagagaaaugaaagaggacauuuuauuuuugguagcagccauugcggugacuauuggacauucucuccuccucugugaagauuggggucuucucagccuuugucgaccuauaaaguucauuugugacuuuucaguaacuugguguccugguugaggacauguucugcaggggcugugggauagauaaaggaagaugaucaugaugaagaggagccaggaaaauggagcuuaaaaugaaguacuuaugcagaauuggugacacauuccucugcuuucuagaguugguuuccuaaaggagacaccacaaagauucaggucaauuauaugauuugaaagauccaaauagccaggaugaaugaguuaugggaauugcuacuaucaaaugaucagaauugggugguaggcuugggaagauuuuccaucuuucacauucacucuucacauaugccugaucuguauuguucauucugaaagucuuugcagguuuccuucugccugaguaaagauuguuccuuguaaucucugaacucucacuggauagcuuuguuaaguacuuuugcuugacugaaagcccuuuuuuuguugauagggcugaaaggguaagcuuaaaauuggcagcuguauuaucuaugacuagaugguaagcuuuuugaaagcauauuaguacugaggaguucuagcaaguuuaauguccacuuugccacugaccauaagacauguguuaggccaguuugggaaguuaggcagagugaaaauccuggauauuauaaacacagugauggaauugguacgacaccuuuauuucacuaauacuaucauuauuagaauacuuagaguucuguaagacagacuauuuuuaaaaguacuauaggcauaauuuuaggaaauuccugaggugauuuccuaaaaagaggaauucuuuauuucuuaguuuggacuuccauaucuucaaacaugucaacaaaucaaauauuaguaugucaacuaucauaaaauauuuccugagcauuugcuuuuguucuggggaacucaagauagccaagaggccuagcagaaacaguggaaaaaagagcuuuacuacuuaauaauuuauuauuguaaaugcucucugggcaugguggcaugcaucuguauuucuagcuacuugggaggggaggcugaggugggaggaucccuugagcccaggaguuugagaaaaaucgaugccagguugucuuuuggagaagcaaaguuaaaaaauaaaauaacaaaugcugugagccaagagucuaggugucuagccauuaaauggcuguguggucuugguuagaacauugaacuuucuagagcuaagguucuucacagcucuauaaagugaggguuagaaugaaugaugucugcaguuccaacuuuugaagucucugaauauuuugucucaaauacauucugagaaggucccugcccucaagaaaauugagcuuuuucucuagauuuucuuccauuuuguuucguuccaaaaggaaaaauccuuguuguuuacaaaggaugauucaacuggaaaauguauugugucaaaaggaaaaguuuccuucaaucccacauucugagagauaaucauuuuaaaaauagguauuaauuauuuugacuaauuucuaugcauaaauuaguauuuuuugugauauacauacuuauauaucuuuauaucuauauauguaucauucauacuauacugaagcgugcuuuucucauguagcaguugagauaauggguaucuuucugugucaguacauacagaccuaccaaauggagugccacugauugaauauugugguucaccaaaacacauuuuggccaaaugaucaauauuuagcugaaguuaaagcuaaauaucauuguuguaaaauggacuacugggauacaagaaaaaaacucaaauuaaagacuauauuaaaauuuuaguagccagauuuagacaaaugggcauacugauuucugaccaccgucagcuuuuugguuauuccuguagucaccauacacuacacuacacauuugcaauacuaaaguugcuaccuuuuaacugaggugucuagaggaacaagauguuguuuggcuggcucugccagaauagaguacugaugaugguaaaguuguuccucagcaacuacgcuugucuucucaaauaguaacugacuagguaagaacuugaucuccuuaucagccccuacccuuggagauuuguuuuauggucaugaguuuaaugaagcaauccuagaaauugaagcauuguauacugcuugaaacauucuuucugaauauuuucagaagcauguguaagauugcugcuaucucuuauauuuauuucuaauuuucuuccguuuuuguuucuuuuguuuguuuguuugagacagggucuugggucuuguuccgucacccaggcuggagugcaguggcaugaugucagcuccacugcagccucaaacuccugggcucaagcaaucucccaccucagccuccugaguagcugagacuauaggugcgggccacuguaccuggguacuuuuauuuuauuuuuuuuaaauagagaugaguucucauuuuguuacccaggcuugucuugaauuccuggccucaauugauccuuccaccucagccucccaaagugcugagauuacaggcguaagccacuguacacccagccuuauuucuauuuuuuuuuuuuaacauuuuugcuucuucacacaauuauuugauuuaaaaaucucuuauuaauuuuggcucuagaaauguggcaauagagcaauguaguugacuuucaaaauacaacaaaauugucucaauaucuccugugucucagcuuugauugcaugugugccaacuucagcauuguugcuggaauaggaugagaugaggcuuuuuaucauguaaggaaaaugugaacucuucauguacaucaguuuugcuacccccuucccccuuuuaaacagauuccaguaaaugccuucauaauaagcagucauuggauuuuguaggccuaauauuuugguauucuuaucuauaaaguaguagaauauuaugggauuuuuauuguuuuuuaagcaggcuauguaauaggcacuagcugcucuuccaucuuguuugaggauauuauauaaguacacaacaaggccguucuacaauauucuguaagucagacaguugucuuuacuugaagaagagggaagacagugguauacucccuuugagcuuccuaguucuuucuaguucuauuccuuucacuaugccccaauuaauucaggacacacagcuguugaaucuuaugacuccuaagacacacuucuccauguuuguucccuugucaacuacaguuggcugucacuguucuuuucugguuuucuucuauaccuuuuagucagauccaccauguguuuaguaugugagagaccaggaacucuucuggcaaacaaauaaagcuggaguggaauggaaugugcugugaauaccccuugcuaucuuacuuaaaguagguuucuaauuguccaugcauguccauaugucugguauauaagauauaaaaguagcacauuuggugaaucaccauacuuuguguguauguaacaacacaacgcagaagaauuuugguaauauguuuucuagaaagacuuuuaguucuaggauucauaguuucagguuuguacacuuucaucuucaaugugagaaucagagugguugguauucuauaguagucauuuuaccaaguuuacuacuuaaaauuagccaggaagaucaguugagccucagaggucauggcugcagugagcuaugauugugccacugcacuccagucugggugacagagugagaccuuaucuaaaacauaauaauaaaaguagccucuaggccacaugcagugucucauaccuguaauccuagcucuuugggagguugaggugguggauuguuugaggccaggaguuugagaccagucugggcaauauagcaauaccccaucucuacaaaaaauaaauuugcugggcaugguggugugcaccuguagucccagaaacuugggaggcugagaugggggagaucacuugagucuaggaguuugaggcugcagugagcucugauugugccacugcacuccagccagggugacagagugagacccaaucuccacuaaaauaaaaaaauaaaauaaaauuagcuucuauauucuuuaucuguaaggauuuuuaaaagccuucuuuaaauuguguuauauuuugaaguuuuauuccugaaaacaaaaugugguaacuuuugugguauuuagguaacucauuuuucucuaacauuuucuucuuuauauucuuuauguguauuuuauuuugugugcaucaaagaugccuucauggaugucauuguuuaugauguuccuaguuuuuccuguucuugaaauuuugacauggcaaaauuauaaaauccaugucucauguccccaauaucuuaaucucuguggaucuuuuucaguuaacucuuguuucuuuuuucuuuucucuuuguuuucuacuauuuuggucucaucuuuugguaggccugaucguuuuuaaugaauauuggacauuguaaauuaaaaauuauagagaucauuggaggcuauugauagugucauuuuccuccaaaaaugauuuacuuuugcuuguaggcagaaucagagauugagcucacucacagcuggaccucagacuuggugagggcuggucaauuccuacuuuacuccuaacuuacaggaugcagucaucagggggucccgccugaaagccuugguuuuccaagacucuuccucauccauuggcccugaacucuaguuuuuguccucccagugcuguaagacuagcagagcuuucuucagcuuuacaaccuccuggguuguuuuuuagccucucaauaccaccuuuugaaaauugauaaaugccuuagggggauaagcagcccuaaauguuacccugaccuccuuguuugcuucucuucucuccaggaauuucauccaaguccucacugccuugggaacucucaugucuucagauaagacuuuucaggucuuuuuggguaggggcgccugguuccucguucucagcaagacugggggaauaagauagucauuguuggauuuuacccauuuuuuguuuguuuguuuguuaagaggguuuuauuuuaaugguuguuuuaggguauacaguaaauacauaacuuaccaaaaucuaccuucaggugcuauuauauauucacauauaguacaaaaccauuauuacauguucuucacccaccuucgcuuuucugcuuugucauauaguuugcuuuuauuuuuauugaaaaucauaauguauucuuauuaauuuuucucugaauaguucucuuuauagacauuacuguucucuuuauagacauuacauaauacagagguuucuaauugauccagguagcuacuguaucugauuuuucauuucuuuuugucaaaccacauuucaaugugggaucauuuucuuucauuuagggguguccuuuaucauuucuaauagcgagagucuaauggugaucaauuccguaggauuucacaugucugaaaaagucuuauuuugccuccaguuuugaaagauguuucugguggauaaagaauucaagguuguuggauuuugcauguuauuauuuucgagacauugcuucacuaucuucuuuuuuuuauuuuauuauuauaccuuaaguuuuaggguacaugugcacaaugugcagguuaguuacauauguauacaugugccaugcuggugugcugcacccauuaacucgucauuuagcauuagauauaucuccuaaugcuaucccuccccccuccccccaccccacaacaguccccagagugugauguuccccuuccuguguccauguguucucauuguucaguucccaucuaugagugagaacaugcgguguuuguuuuuuuguccuugcgauaguuuacugagaaugaugauuuccaauuucauccaugucccuacaaaggacaugaacucaucauuuuuuauggcugcauaguauuccaugguguauaugugccacauuuucuuaauccggucuaucauuguuagacauuuggguugguuccaagucuuugcuauugugaauagugccgcaguaaacauacgugugcaugugucuuuauagcagcaugauuuauauuuuacccauauuuuuaagugaacauucagauauuaaaaauaaguauauauagcaugccuuuuuuacauuacugaaucuuguaccaauuauauauuaaucugugaaaucauaugaucauuucuaauauagaaguucaggaaugucaaaaacaacacugaauaaggcauucagcaauuuggacaguuuuaaaaaaaucuaucagauuuuaaauucauacaucugucauuuacuucauauauauuagcaaucauauuucauauauucuccccuuuuccuauuuuccuacuggauugcuuuauucuaauggauuuguggauguucuuuguaucuaauacacaaagaucuaauauauuauuagauuaauacguauucuuugccaauaauaugugcuacaaacguuacuucucagccugucaucuuuugaguuuguugauaauuucuguaauucaaaaaaauuuucuuuuuauguauuaaaauuuuuucaguagccaaaauuugcccuaccugcuuucuuguaauaguguuaugauuuccuuuuuuucugaacacuuaaauaucugauucauacaaaauauguuuuacaucugagaaaugagauauugguaacuagccuaguuucucacauggcuggugaguugcuuuaacacuguuaaagugauuucugcacagauaucaucugccgcucuuacgauaucuaaguuuccauauaccuggggcuguuucuagacacucuucuguucuuauguuuuucaccaguggcuauccauuuuauuuauugagacuuuugaauacauuuuuauaaucaauaagacaacuucuuuaccauuuaaaaaaaagcauaucuucguuucauauauuuuaaaaaaugaauuugaguaauuuggacaaauucaaaaaucuuuuugggauugaauagugaauuuauagacuucauuaggugaaauugguaucuugauaacuguugaguuuuuugucuuccuuuuuaaguuuuauuuuguaaaguuucuuuuaauaaauguuuauuccugauucauucccaggaauuuuuuguauguuauugcuauuaugaaugagauauuuucuuccauuuuguuuuauuuauuuauuauuuauuuauuugagacagagacuugcucugaugcccaagcuggagugcaguggugugauuuuggcucacugcaaccuccgccucccggguuuaagcaauucuccugccucagccuccugaguagcugggauuauaggcgugugccaccaugcucggcuauuuuuuguauuuuuaguagagacgggguuuuaccauguuggccaggcuguucucgaacuccugaccucaugauccgccugccucggccuccgacaaugcugggauuacaggcaugagacaccgugaccagucuaacuuuuguauuucuaguagagaugagguuucaccauguuggucaggcuggucuugaacuccugaccucaagugauccacccuccucggcuucccgaagugcugggauuguaggcgugagccaccgcgcccggcccccuuuuguuuucucacuggauuuuguuuguguauuagagagccauuuauuuuuuaagauaaguuuuauaacugggccaccuuucugagucccuuucacucauuguuuugguuuuccagacacacagcauuguuucuucagauuaucaugcuguuguccccugcuuuucaguguugaugccuuuuaauucauccucuuuucuaaucgcauugguugcucuuuuuaaaaaaauguuagaugaccaugguguuaguuuauauuuuuagguauaauccuggcuuucaguuauuuagaugagaagauugguguguuuguuucuuuaauuuaaaaagaagaaaaaacaacccacaacucuguugguucuuuuccucaguuucucuguuuggcuuuuuaggaaguuaggaaacuuuauaaaacugcuuuauuucuucuuaaaguucuuucuuugcuuaguaaugaaaguauuugacuuuaacuuuuucucugagaacaaccacuuauuucuuauggauugguuuauauuaauuuauuacucuuuucuguauucuaauucuacaguuuuaguucuguuuuuuucugaucaaaaagucaugugggaaggagauuaaauuuauaaaaauguggggagcuuuuacuuuugugguuaauuucugcuugcuuacaucagugaauaugauuuguauggcugcuacauuuuagaauuaauuuuuucuuggucuuauacaguccuuuuuaaaaauuaguguuacauugauauuuauaaaguaaguacacacaccuaucaaaauauguuugacauucugaccaggugauuuuuggagugacaguagaggcugauaaccucuucuaaagagaaaguuuaagucuguugugguaugcacauauacacauguauauccacaaauacaaggucuuauuaauuauauuauucagaggcuuuauguaauaauuuuuuuuuuuugagauagggucucacucugucacccaggcuggagugcaguggcaugaucuuggcucacugcaaccuccgccucccggguugaagcgauucuccugccucagccucccaaguaggugggauuauaggcacgugccaccacgcccagcuaauuuuuguauuuuuaguagagacacgguuucacuauguuguccaggcuggucuuguacuccugaccucaaguaauccacccgccucagccucccaaagugcugggauuacaggugugagccagugugccuggccuaugucauaacuuuuugagggaucaaauuuauuuaccaaugacuaagaguagugauuuuauccuuuuuucuugguccuuuugccuuacauuuaaucuuaucaaauguuaacauugucaucuguguguuuuguaauuuuggaaauggaguuggagguauguuccaguuuuauccuugccucucccuuugaguuugagcacuucagaaauggcacuuuugcucuagcagggaaauuuagagaacugagaguuuccguuggcuuuugcauaaauuuuuuuuuuuuuccuauuccuaggggacucauucucacaguuccgguuugcugaggagaaagaaugggauagugaagcuucuuguccaaaacagguaagauaagaguuguguuaaguguggacuggcucuucuucaaggcugaaggcuaacaccuuuuacguucuugagauagagucuucauguagaaaagaguaguaauucuuacaguguacccucagcuaaacuuuucagaaaauuuucagggggcugaaauuccacagguccuugaagcuagaguucaccuuucuaccuggccaucugugugaauuaugcagcccacauggacggggucucgagguagaaacuugauagccgugauuuugacagaguggauuacuuugccauuuggucuuccuccuuugccacgcuuugacaauucccuugagaguugaaaauuaguuuucugucucucacuguuuuugguguuagguugagaaaacccuuaaccuugcagcuuuaaauaacacuucuccuacaauuaggagaauagaaguauaaaauaagggcaaauauuauagaagucuuucagcaagucucucaaccccaaaugccuuauuuucuuuguguguauguaauauuuucuucccaaggaguucugauuauuuuccaagcaggcuuccucuaauucuuuucauauaagagaugacagauauucucccccuuuuaggaugcacauagggacauaguggugacuugugauaugcuccccaacuccaggccuagagcauacugucugauaaacugauuaccaucugcccccagcuucagagagguggcugaagcugcagacccgaagcccguaggcacuguccucccuguucugcucccacaucagcguaugugcuguggguggcucguuugaucugugggcugguuuuaggcucaauuguuugggauggccuuugacgcauacggauuacgaggaggggagucucuuagaaaaugacugccuggcacuuuacaaagaacguguuauauaugccauagaaaaaggugagaauuacaaauauuugucuuugcuuaagucugggccuacgccugagguacuguuuaguauucuaggacacaucgaagauagauuguugaggaauaugguagaagccgaacaauuuacauuucaucuccuuuugaaccauacugauuaccaaagaauauuucaaguagcuucagaguuucaaauaauucuaagcuucgucauucaucaaaacauagagcacuuguuuacuaaauguuuuuauuaaauggagcuuauucaaagugaaugagacagaccaugccuguucauugcucuaagccccuuaccugggcacacucggugaccuguagucuguaguaugguagaugcucaguagauauuuaccuaauacaugaaaaagaauacaaccuaaaauaaggggugugaugaaugaauuaacaauacugagagagauagcuacuuugcacuggaagugauuagaauugguaccauggggaaaagaucauuugaacgggucuugguggacaagugugacucugguagguccugucugaggaaacaacaugaaaaugguaagaucaggaaaacgagguuaugcucagagaaggguguggccagaguguaguauucccagaggaggaggccucaggggcaggugugggcuaguuaguaccagcaguuucagaccugagugugaauucuagaucugagacuugggcaaacuuuuuccuucucuauugcuucaccuguaaaauggagguaauaacaaaauauaacucagaguuauaagaaggacuaaauuagauaauaaauaaaaagcccuugagugcaguuccugaugcauaugaaacacucaaaaugagcucuuuuauuacuaauauuaucuguuaacaaaguuuuguuuagcaagaacauggaaaugguuagaucuaacuucagcaguauugggaaggauggggagggauugaacggaugagaugagagguuagaggcagggaaaccgauuaggaggaugugauguuggacgaaugggaaagaacgagagccugagagggucaggcagugagcgugggacagggguuacucauagacaagacuugaguggaggauggggucaacugugcucacuggccagaugugagacacaaggacaagaaagauuugcaauggcacuaugcuuucuagcuugaguaacuaggugaguggugaugccaugaauggaaaaaaauaagagcagaaagaaguuaaguuugauuuugaacaguucgaguuggagguguugguaggacauggcugaaacugaauucauuucaccaucaaaacgauuuccugucugacuuaacuccucacuaaauuuucuuccuuguugauguaagagaaaaaacuggauauauauaauauauaauacguauuauauauaauuauauguaauauauaauacguauauuauauauugagugcauauauauaauauauauuauauguugaguguauauauauauuauauauuauauauauguacacacacacauauauguaauuuguuguuccuuauaccaucccauguccucagugugaccagugacgcaagacaauagagagggggcgggcgcaguggcucacgccuauaaucccagcacuuugggaggccgaggugggcagauuaccugaggucaggaguucgagaccagccuggccaacauggugaaacccugcgucuacugaaaauacaaaaauuagcugggcgugguggggcacgucuguaaucccagcugcuugggaggcugaggcaggagaaucgcuugaaccaagaaggcggagguugcagugagccgagaucgugccauugcacuccagccugggcaacagagagacuccaucucaaaaaaaaaaaaaaaaaaaaaaaaagaaaaggaaaaguagaaauauguuuugucuuugcaguuaaagggagugggaguuugauagggagacauguccaaaauccucaagggaauccuggcaggagagggaccgggcgucacggcuuggacuuggcguucguugcucuguggcugauacgcagggugaagggacacaggucggcggucagggugcucugaucuagcuauguuggccuccaugaccacaggggugucggucucuuagauccacaagugggauucucauaccuuuccuuuggacaggguggguaccauguaaagagaggaugagugggaagguaauuucccugggugaacaaacagauuuauuauuuuuuaaaucaccuaaguuuuuaaaauuccacauuaaauuucuguugacauggugacuuauccaguaggacuuccuugggcaauauacuggcugcugagcaaacugcuggcugcugagcaaacugcuggcugcugagugauaugcggccguuccugagggccuggcuuuuaaaggcacagauucccggcuccccccacgccacccagagaguucaguucugugggugaggccugugaaccuguaucuuaaaaagcugcccagcuuauuacuccaccauaccauguacacauggucucugggccccaggcucauauggacaguaauugcuguagauucugaggaggauguaauagucugauugaaggguauguuuuuuagcugcaaagugaaguauauagcggguucuuuucuuacuaaagagugugccuuuauacagauacuggacacucagagucuuaugauuccuggccagagaggaagcuucaggcuugcagauucucagcacacagacaggguccugugcacacugauggcagagaagugggacagaaaggcuuuguccuacagucaggacuggcuccccucuccccagcacuggagugucuccuuucucuuuacaccccacccccauagcauccuuaguggguguugucugcuccugucugcagccagaugucguaggccaggcccucuacuucaacugccaaguggcugccaggguugaccaggcugacaugggagcuggguuacccaggcaaaaauaaugcaccgaauacuuuaaaacauguacaaaaugcugauuuauuauuauuccaauuaaaccuauuuuuaaaauucacaguuuaguauuaaaagcaauucacugcagcuaacuuuauaucuaaggccuucuucagcuuuagcccuuuauggggcaaacuggugaccaaaaaagaaagccuucuuacaaaguggcuuuuuuuuuuuuuuuuugaggagacuagcucguuugaaaccuucgcaacaccugucagucccuucucacugccuaaauagcccuuuccucuucugaggccagcagucugaauuuagagaagagaucagguuagauuucauuaaaugcuugcuuuucuuucagcuugucagucauugcaaaagccuccaccguuuccagguuacuggacagucuuuuuuuuuuugagauggaguuucacucuuguugcucaggcuguuuugcaguguugcgaucucggcucccugcggccucugccucccagguucaagcgauucuccugccucagccucccgaguagcugggauuacaggcaucagccaccauacccaguuaauuuuuuguauuuucaguagaaacaggguuucaccauguuggcuaggauggucucaaacuccuaaccucaggugauucacccgccucggccuccugaagugcugggauuacgggcaugagccacugcgcccagccuggacagucuugaugggaggaugaucauugcccuguuguugcucugacagugugagcuguggcucaagaagguagcuuugguuuuacugaucauaauguggagaugcagaaacucuaacacauaagugugauguauggugugacuuauuccuagccaaauguaacuccaguggauuauuuacaguuucuucuuuuauuuccaaaaggucauaaucaucaccugauauuuuauuuucuuuuauauauauauauagaauucagcauuuuauguggauagugaguuauugguucgagcccuucaagagcugccucucugccuccgacucaacguugcugccgaacugguccagguaaaaaucccgaagcccucuugaagcggguggauuagggcaggaggagaaaaagaggggaacacuucccucagcaggaugucucagugucagcuucccuuuauaaaagugaggguuucauaucaagguagcauuuuguaaaguuuaaaggagaauccaaaaauuuuuugaaguuacuuuuuuauauuuuauauuugaaacauuuuaaaggaucaaauguaguggaauugagugaaauguaaaauauaaagucuggcuauuuuacucaaaauauuuacgcaucacgcucuauguucggcacuagggacacaguggugaacagacagaugucguuccugccuuucuggaacuuaaucuauugggaaggaugaauauuaaucaaauagucacacaaacauauacaaauuguaauacauccugugaaguacagugugcuuuuagaguaaaucaguuucugguguggugugguuaggaauggcuuucugaagcagugauagaugagcugaggucuaaagcauaaggacauuugagcuggcauuuaaacgagaaagacccagucagcuuugcguuaauaaaaacgauggggcugccaaguagagaagacugugggauuggagugcauguguggggguaagucugcaugugcacauacacaugcacagagcaggugagggaggcacauggggaggcuguuguacaggugcaggugaguaguacuguagcuuggacuacaguaaugacgguggagauggcagaggagagggcuguacugagguacuucaaagguacaauuaacaggauuugacgguauauuggaaauugggagagaguggucaagaaaaaauucaagacuuuguagauugugcaacucagugguaggaucaggaagggugaguuuuggacuuuaugaguuugugccucugagauauccaaguggaaauaacagucaacugaaugcugaacuuuauaguucuacaucaagggcuagaaauacaaauucaggagauaacaggaugaagugauaauugaugaacuaagagagggggaggcccaaagauuaugccaugaagaacuucaacauucuggcacgaucaaaaaaaaaaaaaaaagugaaaccuugggacguacugauuuuaaguagaauccuagcaacugaaauuaucaacuuccuucugugggugaaugugaugcuaagcuugagcauaguaaugaauugguuacccauucauuugcuguauagcauuuacuagucuaaaauuugggacagcaggcagaguucagggauggaggacaguuagggacaggguagagaacuagaaagaauuacauuugccucugaugggggauugcccuggggguucuuuggaaacauuuggggguguuugggagagcacuaguggcucuucugcugauguccagugauguucaaaguucugaagugcuuggcuugaucucauaugaugaggaauguuuagcagaacucaccagggaaaugcugagauaaaggauucaggacucaggacagagaggaagugguugugaguguuugaagugaagguuguaaugucaguggcaggcauuaaagguauaaaauaauuaugugacauugaaauccuggcuaaaucacuuagaaacauuucucccccacccaugcuguagagcaguauucucuaccuuguuugcacauuagaaucaccuggggaguuaaaaacaaacaaaaacaaggccagacacccaccccagaacaauuaaaugacucuaagauuagaauagaggaccaugucccagcuuugcccuguacaacugacugacucugcuggauauuuauuccuguuuguauauaaagccauaccgucuuacaugucugcucaggauguuuauguaaaaauaaggggucaggaccuccaguagagguugaacuucugaaccugcccacugugaggccuugcucaucccuggagccuucccucgagagcggugauucucagccuuagauuauaaccuuguauuacaaucaccgggggaguuuguaacuuuuauuaaaguauaacaucgauucagaaaagugcacauguaaguauacauggaaugagcauccggauaaagacuuagaauauugucagcaccucagaagccaccauucauacacacuccacgucacucucuccccaaaaggcacucgcucaccuaacuucuaauaccguagcuuuugaacuuuuuacaaauacaaucaucaaauaguguauuuucuuuugugucuggcauuuuuuaccaaggagagucuuggugaauuuguuacugcaccuuuauauuagugcacuuaaauacaaugaacagaucugauuugcuaauuacuuccuggugacuuuuuuuuuuuuuuuuuuuuuuuugagacggagucucauucuguugcccaggcucgagugcagugguacaaucucagcuuacugcaagcuccgccucccagguucacgccauucuccugccucagccucccgaguagcugggacuagacacucuccaccacuccuggcuaauuuuuuuguuuuuuguuuguuuguuuguuuguuuguuuaguagagacaggguuucaccauguuagccaggauggucucaaucuccugaccucaugauccacccaccuuggccucccaaagugcugggauuacaggcaugagccacugcgccuggccacuucuuggugacuuuuuauagauguucaugucuuaauacagauuuaaguguaaagccaaauagaccuaugguacuggcaguuuucaggccagggcuaggaagacauggaucuuuucauuccaaaucugagcuaguuagcacauggucaagguagggagagugggaggcacagugcuggcauguuucagugaggucucccacauuuaccccagaugucaggaagggugcccccaccagggccuggaaaggagccacuuugugaacuaucugaauugaguuuccucugucacaaaguuugauggcuucguuuagccuccuauguauuuacuuaagccaauauggcaagacucacauuuuuaacucaguuuuuauacuucucuuucaggguacaguuccuuuagagguuccucaggugaaaccaaagagaacugaugauggcaagggauuagggaugcaguuaaaggggcccuuggggccuggaggaagggggcccaucuuugagcugaaaucuguggcugcuggcugcccuguguugcugggcaaagacaacccaagcccggguccuucaagggauucucagaaacccacuuccccacugcagucagcaggagaccauuuggaagaagaacuagaucuguugcuuaauuuagaugcaccuauaaaagagggagauaacaucuuaccagaucagacgucucaggaccugaaauccaaggaagauggggaggugguccaagaggaagaagguauggcuuucauuuuauuccccgugaaucuugauucugguguuuuuucaagaacagccccgcccgcaucacauccgcacacaucccucugggugucugacauugauccaguguuguccacugacaucuauuucugugcucacgucucugcuucccccugagcugaccuuucugacaaccuuccucucacgcgacacaccaagcuuccaaagcugcuaccugccugacugcaguagaaaccuggggcugcaaauggaauuuccgcuaucagaaggcauuaggauaccuguagccuucagcuuuuuggcaguggcccuuuuaaucgacugacaggccaccucuucauaccuuuuucuugcuauuucugucuuauauuuugacaaaagaacaccacauucugauuucugcauguccugugagauaguggcccaucugauguagaggggccuaaggugauugccacaugcauguauuacauuugagauccuuuaauuuuccaggacugcugcaauaauaauaguaaaaaggaaacugagcuguuggucuuugaaaaaaaaaccaacuagcaaggugugaaguucaacuucagaauaaagagcaaauccucuacccagcuuuauuuguuuagauauuacuguaucaucuuagggaguaagaauaaugagaauguuuccccuuguuguaaggaaaguaauaaauugggcugaauuauaccuucaauuuuaggacucaucugaggguguuaacauuguuuuuuuucccccaguuugugcaaaaccaucugugacugaagaaaaaaacauggaaccugagcaaccaaguaccuccaaaaauguuaccgaggaagagcuggaagacugguuggacagcaugauuuccuaaaaaggggaaaaaaagugccugaagcaaaucuugguugccuucuaacggcaggugggcauaaggcuguccuucaggaccagccaguuuacaagcaugucucaagcuaguguguuccauuaugcucacagcaguaaaugccuaccucuguguuugacaucugaaagaauacauugaagcagcuuguugcauuuguuuuucuggcuuaguaaucuaauagauuuccuuaagggcaggagauagacucuggcccuuguuucuagccuccuuccuugcaguguuuacaacauagccaguguuuacagcauagcagaugcugcugcugauuaagagaauagaugcaaacaaggcaugcauuuggccaaaauaaacaaaugcuggucugucca

SEQ ID NO: 191218 - RNA, 11568 nt, Homo sapiens
auuagcuccauucaagccuacaaauugcaucacccuccuccucugcccagaccugggggcuccaacaccuuucgcuaggucuggcucuggccucugagcgaaccuuccguacaguauggcggcucccgaagccccgccccuggacagaguuuuccguacaacauggcugucuacagagugcgauucccacccacuuccgccuagcuaccggaaguuucuauuugaaacccaggcggccgacuuagccgguggcacgacaguugcugcagggaaucuuuuaaacgagagcgagaaggacugcgggcaggaccggcgggcuccuggguucggcucucccggggcgagggacugggcuggaugggaggaaggacggaaugagcugggaaaggaggauuuucucuuuuccaaccccgagccggggccugucgggucgcgcuauccccgggcccuccacucucucgggcccaguggcccagcgcuggguaacauucauccuguaccuuccaggguucagccgugccgccucguuacgaugaccagugugguuaagacaguguauagccugcagccccccucugcgcugagcggcggccagccggcaggugaggguccaagccacgcccggggcacugcggccuggccggggauggucucgggaguguggagaucgaauggguggcgcgggcacggggaagggcgucccgucggcccugaaaaccugugagcccccuauaaccaggcuauguagguuuaugaugggaguuaagggaaggaccaugugguaggauuuuagacgugcucugcacuuuucugcccgcauguguacuguauucaucaguuagauucaaguuguugguuauuguacaauguuauucccauuaagcuaggaauccccuucuaaucgguuaucgucuuauuuccagacuugggcuaucuugagggauuggguuuguuuucagggaggaaagaggagaaucauuugagaagugggauacuuaggguucuuuguucaccuuuauaucugcaccguguuucucauuaccacauucucaauacacguuuguugagugaagugggagagagggguuagaccuaggcacaguauuugagaaacuugggcgaagagagagacaugauuaaaaauaguuuuuaauugcuuugccaucugcuuuguguugcuuugcuugugguugaaagucaucucauggggucugcagucggggaacugccuaaucuagagauuauaguacagaguaagcuucagacaucagaaaacuguugugggagauuauggaguagcuauuuaugaucccuucccagaugauuccacucagcugguacauaaaccuuggcaagauggagcgcugaaguggccaggcacgguggcucacgccuguaaucccagcacuuugggagggcgaggugggcagaucacgaggucaggagauggagaccauccuggcuaacacggugaagcaccgucucuacuaaaaaauacaaaaacuuagccgggcgugguggcgggcgccuguagucccagcuacuugggaggcugaggcaggagaauggcgugaacccgggaggcggagcuugcagugagccgauauugcgccacugcacuccagccugggcgacagagcgagacuccgucucaaaaaaaaaaagauugagcucugaaguaaauaggcuuuucuccaaaggcuuaauggguuguuuguugucuuguguugccgcagaacaccugaaugguaauccuggcaccagcggggacuaggaguugcuggaagaacuggagccaggucucucagcugcugugucuuucccuuagaugcggugccccugagucagugggcagugacuagcucucucagccaaguuggaaguguucaucucuuugauuucuaucucugucccagcuuuaugaucauauguaacuggaacaguuucaaauuuuuaggcugccucccaggauuuuuguuuugauuuugagcgugggcuggauaaguaauauaugcacaugugaaaaaaaaaaagguggaaaaccauauacaaugauaaacaaguuuccuucccuuccuugacaccagccauccaguuccucucccagugucucccauuuuuaagagacagcuuuguuaaauccuacugaauuuuuccuacagugcaauccuagauuuuagcaaauacaaauuauuggaaccaauucuagucaaugaagaguguuaauuuugaucaauugacuguuaacuccauuuuacauggaguagauuuguuauuguuuaaaacuuacuaauacuugagagaggagaagaugauauuccuccaagauuaccuuuuucuucagacagacaccucagaaagaacccuuuuaauacuucauuuguacugcauuucuucaauuugauuugauuguaauggcucuuaaguuaggucaaacuuaaaggggccauuuuacagugaacaaagugagaguaaguccagaaaagccugcaugugagggugggggugcuuaacuccagauaaguuacuugaauuugcuguagaacacaaaugauagauugugugguugcggggcuggcacaaggauagaggaaaaugcucuccuuuggggaagaagaguguuauggcagggccauuucucugguuaucuggcaagaagaucagauuagaaugccuaauagggaaacucuaaacuuaacaaaggguaaacaaaagggcuagugguagaggcaggcagcauggaagaggaagggaccagacaggugguuuagagauggucugugaaacaacccauggaacugugaaguguuucauuuauucaacaagcaguuauugaaccccuguucauaugccagauacuuuccuaggugauggggacacaaagaugccuuagaaugguuaggaagacauucuaguaaaaacaacgaaguaacgguuuaaaaaaacucagagcagcucagucaugccuuaggagagugugcagagugcuuggaggagcuuaaugagaugguacaaggauucaggcauguuuuaccugcuaacuuccacccugcucucugcugguguccaucuccauguucacuuuuacagccuacaccuuucaguucaaugaaacuuuuggcuacccucaaacaugcuguacugucacguuuaaauaauuuugguuuuuauugccaauuagccuggaaguuuuauucuuuugaauuaaucuucacauguugaaauuugccagaaugaaaauaaagauuuggccaggcaucguggcucacgccagaguggccaaggcaggaggauugcuugagcccaggaguucgagaccaggcugggcaacauagugagacccugucucuauuuuuaaaauuuuaaaacauauuugaggugccuauaguccagcuacucgggaggcugaggcaggagaaucguuugaacccaagagguggagguugcagugagccaagaucacaccacuguacuccagccugggccacagagcaagacucugucucaaaaaaauaaauaauacuuuuuaaaauaaaguaaaauaaagauuuaugacaacuucgaauggggcucuguuuguuacaggguugcaacugucgggucaugaugccagaagcuuuaccucucauuuuccuuugcagacacacaaacucgggccacuucuaagagucucuuaccuguuagguccaaagaagucgauguuuccaaacagcuucauucaggagguccagagaaugauguuacaaaaaucaccaaacugagacgagagaaugggugagaacggaucauuaguauccaguuagaacaucuuccuagaaauugcucaauacaaagaauuagaaaacagaguuuuggacaacacaagucuccugaacaacuggccuucaaucaguggcccagagcagugcagcauugcugagcucugugccagaacccucuguguugaucuuucugaagagacacagccagaguuauaagagguguucuuuccucuuucaucgcuugcucugagcauacaaguggcagcacuguagucauacagcaacccugagggguagucaugcaggguggggacuaguuguuauccuagguugcugcucugaccacacaguccagcccuaguguguguguauguccccagccagcagucaguuccaggugagugagguugacaugagauagccacgccaucuugagaggaacagcucugucagguuguuaggguggucggaggcaugccccuuugcuacuaaaaagccuuuucaauaaucugugccgaagcaguaaugcauagucucucagagcucuuaagcuugugccauuugccuuuuaugucugguucuuuccucagaaacucaagcucuuuguucugccuguucacagcacacuuaacaguacuguaagucucugauucauuucuuuguuucugcccuccuaggcaaaugaaagcuacugacacugccaccagaaggaaugucagaaaagggugagcaucaggguaaaucaacuuggccacuauucuaggguaguggaucucaauccuugguucugcaucagaaucauuugugggacuuguuuacuguguuagggucuggguuccaccucaggaaccugaguggaauuuucaggggugaggcacagcuagguguaagaaccauugucagugcaagaaucacuggugcuacuaucuugugucucaagcaagagcuuuuuggacuccacgccaggaccacugcugauuggaaaucacacuuagcuauggcccaucaacaggaggguaaagccuucaggagaggaagggcuggguguauguaguuagugaucucgagaugaagauucuggugguggugguggugaaaaccuggagaaggauucaugucucaucuuugaggcuaguuuggaaguuuugcacuaucagaaauagaaauaauaagcugaaaagucuguacaaauagguuuuaguuccagaucuauuauuugggcauaucuuaaaaguuuugaagacagcagggcacaccagcucacaccuguaaucgcaacacuuugggaggccaagguggguggaucaccugaggucaggaguucgagucuagccugggaaacaugaugggaccccaucucuacuaaaaauacaaaaauuagccaggcaugguggcgcaugucuguaaucccagcuacucaggaggcugaggcaggaggaucacuucaucccgggaggcagagauugcagugagccaagaucacgucauugcauuccagccugggugacagagcaagacucugacuuacaaaaauaaaaaaguuuugaagacaaaauacuagcaaaaaagacugagaacuuuaagaaaaaacucuaauauugguugcugagaccagcuuggucggggagacccuaacccagcggcgcuagaggaauuaaagacacacacacagaaauauagaggugugaagugggaaaucaggggucucacagccuucagagcugagagccccgaacagagauuugcccacguauuuauuaacagcaaaccagucauuagcauuguuucuauagauaguaaauuaacuaaaaguaucccuuaugggaaauggaugggcugaauuaaaggaauagguugggcuaguuaacugcagcaggaacacgcucuuaagacacagauugcucaugcuauuguuuguggcuuaagaaugccuuuaagggccggcgcaguggcucacgccuguaaucccaggauuuugggaggccgaggcggguggaucucaaggucaggagaccauccugguuaacuaugguguuucaccgucucuacuaaaaauacaaaaaauuagccaggcaugguggcgggugccuguagucccagcuacucgggaggcuggggcaggagaauggugugaacccaggagguggagcuugcagugagccgagaccacgccacugcacuccagccugggcgacggagcgagacuccaucucaaaaaaaaaaaaaaaugccuuuaagugguuuuccgcccuuggcaggccagguguuccuagcccucauucccguaaacccacaaccuuccagcaugggcauuagggccuuuaugaacauguuacagugcugcagagauuuuguuuauggccaguuuuggggccaguuuauggccagauuuggggggccugcucccaacaauuggugauauuagaguuuauuagaugauaaacuaacauuagauaauagcccagcuacugggcuaagaaaugcacacguguuuucucucuuauuacucauaauaauaauacuaugagauguggguauuguccugauuucaaaaaugaggaaacaaggccucagggagguuaugcaacucacugaaggucauauaccacuguguaauagccaggauagaaugggacguguuuguguaacucuguaggccguauuuuucuuucuuuuuuuuuuagacggaguuuugcucuuguugccacccaggcuggagugcaauggcgcaaucucagcucaccacaaccuccgccuccuggguucaagcgauuauccugccucagccucccaaauaccugggauuacaggcaugcgccaccacgccugacuaaucuuuuguaauuuuaguagagacaggguuucucuuaucuuggucaggcuggucuugauuucccgaccucaggugaucugccugccucagccucccaaagugcugggauuacaggcaugagcuaccgcaccuggugugggccauacuguuaacccuuuuaucuuuucauguaaguacaacuauuauuacagcuacaaaccacugaguaagcaaaaaucagaggaagagcucaaggacaagaaccagcuguuagaagccgucaacaagcaguugcaccagaaguugacugaaacucagguaagagacccaccagagcucuguuaccagcugccacugggcgauccacauggaauccugauggguggccccuuggaugagcaagcuuguuaaugcacagaugcccaagggcagaaaaaaaaagccaggcuuuugcuauggcuguccaagagcaagggcaagaaagggcaaccaccccuagggaguuggacaauuccugaucugucugugcugugcuccaauagggagagcugaaggaccugacccagaagguagagcugcuggagaaguuucgggacaacuguuuggcaauuuuggagagcaagggccuugauccagguaagagacagcacacagcuagccuccuuugaaggaauuggugcaugugccccuuccgggguugaucuuggcagcauggcaucagcuggcccaguaugugcagggguuacuuucauaaagcccuaaagauuuuggaaagcuucuguuuguuuucaugugauguugauuuuugccuggccaauaggauuucagaugauuauagagagaggguuaucucuuucuuaccugaacacuuuaugccauucauuuagugccaacagguaugaccuugcaaauagaugagaaacacuuuguuccuuucaagggagaacauuuucugucucuuccuauuugggaaaguuacuagugugcuugaaaggaacauuuuguuugaacaugcucuuccuuucaagcauacuaguaaucccaaaugggaagagaaagaaaauacuauuucaagcauucuuaaaccugguuaaucaucagaauuacagugacuaaaauaugacuacuauucugacccugucccccagaaagcaguaucuguagcaaagagagcagaagaaggaauugcccaaagacuguaagagggccucagacugagucaaagagccagagaaugcccaggaaaggggcccaggccuuuuuguauuaaggaauacugacuuugaauguuacugguuaaucuuuagguuacaguugaggauauucuuuuuuuuuuuuugagaugaagucucauuccauugcccaagcugaagugcagaggugugauuucggcucacugaaaccuccuccuccuggguucaagugauucuccugccucagccuccugaguagcugggauuacaggcguguaccaccacacccagcuaauuuuuguauuuuuaguagagaugggguuuugccauguuggucaggcuggucucaaacuccugaccucaagugaucugccugucucggccucccagagugcuggguuuacagacaugaguuaccaugcccagccuaggauauucuuuauagucaccauaaauauauauguuuuuaaauuuaaaauuguuuauuuuuuugagaugggaucucgcuauguugcccaggcuggccuccaacuccugggcucaagcaauccucccaaauagcugggacuacaggugugcaccaccacauccgacaccauaaauauuuuguaugauuuuaguuuauuacaugcaugugauauuaccgaaaguaauaauuuuuuaaggccugaaaggcucuuaaaaauagcuuugugaauugugaacaaaaccaaaaaaaauccaaccuauacauuuccuuuggacaaauuguccacugaccuaaggagaaaguauaccgaauuuuuggccauaucaaaaccuagauugaaaggagauaaaauacaguuuugcagggcagauaugggugacccugccaaggugaaaacuuaggagaaaguccaggaugagacacuuaagagaaauuccccucaugaauauuucuguacuuguccacggaggguuuuuauuuucuuuuguuuaggguguguaguucccuaagugagauugacuuuguuguauccaucagcuuuaggcagugagacccuggcaucacgacaagaauccacuacugaucacauggacucuauggugagggcaugggugugaaagggcgcaagggcugagugacuguggggcucuguaaaucuaagaaggucucugcuauauauuccauaaacuccaagaaacagccuuugauuaucugugaugcuagaaaagagaaaugggauguguacucaaaauagcauauuuuacuugaaagguagcuuugugcuuacaaauauaagugagucugaauugaaaauuuaaaacacauaauagguaaaccuguagagagagcuuucucguucuucuguucuauacuuuaucaaauuucucuccugacuccuuuguugagaacuguguggaaaggauguuagccaucaucuaaugcaagucugguuuuauaugaagauuuguuuacuacauugugcuuuccucuuaguugcuguuagaaacuuugcaagaggagcugaagcuuuuuaacgaaacagccaaaaagcagauggaggaguuacaggugagaggcagacaucacccugaccauuuccuaccaugauagguagauuuauaguggggucuuuucuguuuuucuauuuauuuuuaauaaacuuucuaaauaauuuuagauuuauaggaaaguuacaaagauaauacagaaaauuuacccugauaguaacguguuuuuuuuuuuccaacuuuuaaguucagggguacacguacaggguguguaggcuuguuacacagguaaacgugugccauggugguuagcugcacagaucaucccaucaccuagguauugagcccagcauccauuagcuauucuucuugaugcacuuccuccuccacccccaauaguaacaucuuacauuauccugguacauuugucaaaacuaagaaaucagccaggcaugguggcucacgccuauaaucccagcacuuugggaggcugagguggaaggauuacuugaagccaggaguuugagaccagccugggaaacauaacaagaccccaucucuacaaaauaaaauuuagaaaauagccaggcguggugguacauaccuguagucccagcugcucaggaggcugaggcaagaagaccacuugggcccaggagggcaaggagauaaagucucacuguugucccccaggcuggagugcaauggcgugaucucggcucacugcaaccuccgccucccggguucaagcgauuuucuugccucagucucccaaguagcugggauuacaggcauuugcgaccaugaccggcuaauuuuuauauuuuuaguagagacaggguuucacuguguuggccaggcugguuucgaacuccugaccucaggugaucugcccgccuaggcuucccaaagugcugagauugcaggugugagccacugcacccggcaggaaaaaaauuuuuuaaaaaacagaccaacaucaguacauuacuauuaacuauauuccaagucuucauuuggauuuuagcaguuuuuuccacuaauuuuuuuuuuucuguuaccgaggcuucuugcaaauguucacaucaccaaggcaugaggcaauguguaacacaguagguugcucagaguugggaauugagaacuauauguaauccauucuauggaaacuugauaacucaaggagaagaccuguaguaagcacagauucuuuggucuggacuguuucagauugcuuggaugaaucaugggauauugcaccaaauguagaggauuucaucguuccaguuuagauacaggagucuagucccucucuacuacuagagggacaauuccuaaaaccagugcauagaaauaaaaucuaaaauagaagauacagucuguugauacuccaguggucuuccuuaguggaauaggagcauaauguucugaugugggaauuguguuuccuguuagucaagaguuuuguguauguguuguuuucuuuuggaaugucuuuccaugcaggccuuaaagguaaagcuggagaugaaagaggaaagaguccgauuccuagaacagcaaaccuuauguaacaaucaaguaaaugauuuaacaacagcccuuaaggaaauggagcagcuauuagaaauguaagaagaagcaaguggccagauggcucccucuugggcauaaaaucucagaggaagcuacuuaggacaucaucuuggccaugaucuucugggacucaccaucuccagaaugaaaacaauuucuacaguagacuuaaggacaguuuaugcugaaauggcaauuccucauuuaagcaaguuuucccaaccuucagguuggucagcccuccugagccucacagguggauaauugaggccuacaagagaggggagccuaggagcuuggauugaccuucuagucaaccaccugacuucagcacaccauuacaaucgggagacuaaaccaacaaccagaggaucuaaaaugucacauucagauuuucaggaagaaaaucuucauuacaguggagcacaaauguuccauacaagacaucauugaggagccaugcuguccccuucuaaccugaaacacauucuuucccauccugguugggcuucuguaccuccuuauuaauuuaugaaccugaaguugcuugaaguguuuugggcuuaauaaauggggugaaaguauagguagcaguaacaccuacaugaaacaauacaccuuggaucuuuuaaucuaaauuacuuuucuuuuuuaagucuacuuuuaaaauaaauacuucuguaaauauucugacuguaacauugaggaaugaaaauagccuuuuaaccua

SEQ ID NO: 191219 - RNA, 11568 nt, Homo sapiens
uagguuaaaaggcuauuuucauuccucaauguuacagucagaauauuuacagaaguauuuauuuuaaaaguagacuuaaaaaagaaaaguaauuuagauuaaaagauccaagguguauuguuucauguagguguuacugcuaccuauacuuucaccccauuuauuaagcccaaaacacuucaagcaacuucagguucauaaauuaauaaggagguacagaagcccaaccaggaugggaaagaauguguuucagguuagaaggggacagcauggcuccucaaugaugucuuguauggaacauuugugcuccacuguaaugaagauuuucuuccugaaaaucugaaugugacauuuuagauccucugguuguugguuuagucucccgauuguaauggugugcugaagucaggugguugacuagaaggucaauccaagcuccuaggcuccccucucuuguaggccucaauuauccaccugugaggcucaggagggcugaccaaccugaagguugggaaaacuugcuuaaaugaggaauugccauuucagcauaaacuguccuuaagucuacuguagaaauuguuuucauucuggagauggugagucccagaagaucauggccaagaugauguccuaaguagcuuccucugagauuuuaugcccaagagggagccaucuggccacuugcuucuucuuacauuucuaauagcugcuccauuuccuuaagggcuguuguuaaaucauuuacuugauuguuacauaagguuugcuguucuaggaaucggacucuuuccucuuucaucuccagcuuuaccuuuaaggccugcauggaaagacauuccaaaagaaaacaacacauacacaaaacucuugacuaacaggaaacacaauucccacaucagaacauuaugcuccuauuccacuaaggaagaccacuggaguaucaacagacuguaucuucuauuuuagauuuuauuucuaugcacugguuuuaggaauugucccucuaguaguagagagggacuagacuccuguaucuaaacuggaacgaugaaauccucuacauuuggugcaauaucccaugauucauccaagcaaucugaaacaguccagaccaaagaaucugugcuuacuacaggucuucuccuugaguuaucaaguuuccauagaauggauuacauauaguucucaauucccaacucugagcaaccuacuguguuacacauugccucaugccuuggugaugugaacauuugcaagaagccucgguaacagaaaaaaaaaaauuaguggaaaaaacugcuaaaauccaaaugaagacuuggaauauaguuaauaguaauguacugauguuggucuguuuuuuaaaaaauuuuuuuccugccgggugcaguggcucacaccugcaaucucagcacuuugggaagccuaggcgggcagaucaccugaggucaggaguucgaaaccagccuggccaacacagugaaacccugucucuacuaaaaauauaaaaauuagccggucauggucgcaaaugccuguaaucccagcuacuugggagacugaggcaagaaaaucgcuugaacccgggaggcggagguugcagugagccgagaucacgccauugcacuccagccugggggacaacagugagacuuuaucuccuugcccuccugggcccaaguggucuucuugccucagccuccugagcagcugggacuacagguauguaccaccacgccuggcuauuuucuaaauuuuauuuuguagagauggggucuuguuauguuucccaggcuggucucaaacuccuggcuucaaguaauccuuccaccucagccucccaaagugcugggauuauaggcgugagccaccaugccuggcugauuucuuaguuuugacaaauguaccaggauaauguaagauguuacuauuggggguggaggaggaagugcaucaagaagaauagcuaauggaugcugggcucaauaccuaggugaugggaugaucugugcagcuaaccaccauggcacacguuuaccuguguaacaagccuacacacccuguacguguaccccugaacuuaaaaguuggaaaaaaaaaaacacguuacuaucaggguaaauuuucuguauuaucuuuguaacuuuccuauaaaucuaaaauuauuuagaaaguuuauuaaaaauaaauagaaaaacagaaaagaccccacuauaaaucuaccuaucaugguaggaaauggucagggugaugucugccucucaccuguaacuccuccaucugcuuuuuggcuguuucguuaaaaagcuucagcuccucuugcaaaguuucuaacagcaacuaagaggaaagcacaauguaguaaacaaaucuucauauaaaaccagacuugcauuagaugauggcuaacauccuuuccacacaguucucaacaaaggagucaggagagaaauuugauaaaguauagaacagaagaacgagaaagcucucucuacagguuuaccuauuauguguuuuaaauuuucaauucagacucacuuauauuuguaagcacaaagcuaccuuucaaguaaaauaugcuauuuugaguacacaucccauuucucuuuucuagcaucacagauaaucaaaggcuguuucuuggaguuuauggaauauauagcagagaccuucuuagauuuacagagccccacagucacucagcccuugcgcccuuucacacccaugcccucaccauagaguccaugugaucaguaguggauucuugucgugaugccagggucucacugccuaaagcugauggauacaacaaagucaaucucacuuagggaacuacacacccuaaacaaaagaaaauaaaaacccuccguggacaaguacagaaauauucaugaggggaauuucucuuaagugucucauccuggacuuucuccuaaguuuucaccuuggcagggucacccauaucugcccugcaaaacuguauuuuaucuccuuucaaucuagguuuugauauggccaaaaauucgguauacuuucuccuuaggucaguggacaauuuguccaaaggaaauguauagguuggauuuuuuuugguuuuguucacaauucacaaagcuauuuuuaagagccuuucaggccuuaaaaaauuauuacuuucgguaauaucacaugcauguaauaaacuaaaaucauacaaaauauuuauggugucggaugugguggugcacaccuguagucccagcuauuugggaggauugcuugagcccaggaguuggaggccagccugggcaacauagcgagaucccaucucaaaaaaauaaacaauuuuaaauuuaaaaacauauauauuuauggugacuauaaagaauauccuaggcugggcaugguaacucaugucuguaaacccagcacucugggaggccgagacaggcagaucacuugaggucaggaguuugagaccagccugaccaacauggcaaaaccccaucucuacuaaaaauacaaaaauuagcuggguguggugguacacgccuguaaucccagcuacucaggaggcugaggcaggagaaucacuugaacccaggaggaggagguuucagugagccgaaaucacaccucugcacuucagcuugggcaauggaaugagacuucaucucaaaaaaaaaaaaagaauauccucaacuguaaccuaaagauuaaccaguaacauucaaagucaguauuccuuaauacaaaaaggccugggccccuuuccugggcauucucuggcucuuugacucagucugaggcccucuuacagucuuugggcaauuccuucuucugcucucuuugcuacagauacugcuuucugggggacagggucagaauaguagucauauuuuagucacuguaauucugaugauuaaccagguuuaagaaugcuugaaauaguauuuucuuucucuucccauuugggauuacuaguaugcuugaaaggaagagcauguucaaacaaaauguuccuuucaagcacacuaguaacuuucccaaauaggaagagacagaaaauguucucccuugaaaggaacaaaguguuucucaucuauuugcaaggucauaccuguuggcacuaaaugaauggcauaaaguguucagguaagaaagagauaacccucucucuauaaucaucugaaauccuauuggccaggcaaaaaucaacaucacaugaaaacaaacagaagcuuuccaaaaucuuuagggcuuuaugaaaguaaccccugcacauacugggccagcugaugccaugcugccaagaucaaccccggaaggggcacaugcaccaauuccuucaaaggaggcuagcugugugcugucucuuaccuggaucaaggcccuugcucuccaaaauugccaaacaguugucccgaaacuucuccagcagcucuaccuucugggucagguccuucagcucucccuauuggagcacagcacagacagaucaggaauuguccaacucccuaggggugguugcccuuucuugcccuugcucuuggacagccauagcaaaagccuggcuuuuuuuuucugcccuugggcaucugugcauuaacaagcuugcucauccaaggggccacccaucaggauuccauguggaucgcccaguggcagcugguaacagagcucuggugggucucuuaccugaguuucagucaacuucuggugcaacugcuuguugacggcuucuaacagcugguucuuguccuugagcucuuccucugauuuuugcuuacucagugguuuguagcuguaauaauaguuguacuuacaugaaaagauaaaaggguuaacaguauggcccacaccaggugcgguagcucaugccuguaaucccagcacuuugggaggcugaggcaggcagaucaccugaggucgggaaaucaagaccagccugaccaagauaagagaaacccugucucuacuaaaauuacaaaagauuagucaggcgugguggcgcaugccuguaaucccagguauuugggaggcugaggcaggauaaucgcuugaacccaggaggcggagguuguggugagcugagauugcgccauugcacuccagccuggguggcaacaagagcaaaacuccgucuaaaaaaaaaagaaagaaaaauacggccuacagaguuacacaaacacgucccauucuauccuggcuauuacacagugguauaugaccuucagugaguugcauaaccucccugaggccuuguuuccucauuuuugaaaucaggacaauacccacaucucauaguauuauuauuaugaguaauaagagagaaaacacgugugcauuucuuagcccaguagcugggcuauuaucuaauguuaguuuaucaucuaauaaacucuaauaucaccaauuguugggagcaggccccccaaaucuggccauaaacuggccccaaaacuggccauaaacaaaaucucugcagcacuguaacauguucauaaaggcccuaaugcccaugcuggaagguuguggguuuacgggaaugagggcuaggaacaccuggccugccaagggcggaaaaccacuuaaaggcauuuuuuuuuuuuuuugagauggagucucgcuccgucgcccaggcuggagugcaguggcguggucucggcucacugcaagcuccaccuccuggguucacaccauucuccugccccagccucccgaguagcugggacuacaggcacccgccaccaugccuggcuaauuuuuuguauuuuuaguagagacggugaaacaccauaguuaaccaggauggucuccugaccuugagauccacccgccucggccucccaaaauccugggauuacaggcgugagccacugcgccggcccuuaaaggcauucuuaagccacaaacaauagcaugagcaaucugugucuuaagagcguguuccugcugcaguuaacuagcccaaccuauuccuuuaauucagcccauccauuucccauaagggauacuuuuaguuaauuuacuaucuauagaaacaaugcuaaugacugguuugcuguuaauaaauacgugggcaaaucucuguucggggcucucagcucugaaggcugugagaccccugauuucccacuucacaccucuauauuucugugugugugucuuuaauuccucuagcgccgcuggguuagggucuccccgaccaagcuggucucagcaaccaauauuagaguuuuuucuuaaaguucucagucuuuuuugcuaguauuuugucuucaaaacuuuuuuauuuuuguaagucagagucuugcucugucacccaggcuggaaugcaaugacgugaucuuggcucacugcaaucucugccucccgggaugaagugauccuccugccucagccuccugaguagcugggauuacagacaugcgccaccaugccuggcuaauuuuuguauuuuuaguagagauggggucccaucauguuucccaggcuagacucgaacuccugaccucaggugauccacccaccuuggccucccaaaguguugcgauuacaggugugagcuggugugcccugcugucuucaaaacuuuuaagauaugcccaaauaauagaucuggaacuaaaaccuauuuguacagacuuuucagcuuauuauuucuauuucugauagugcaaaacuuccaaacuagccucaaagaugagacaugaauccuucuccagguuuucaccaccaccaccaccagaaucuucaucucgagaucacuaacuacauacacccagcccuuccucuccugaaggcuuuacccuccuguugaugggccauagcuaagugugauuuccaaucagcagugguccuggcguggaguccaaaaagcucuugcuugagacacaagauaguagcaccagugauucuugcacugacaaugguucuuacaccuagcugugccucaccccugaaaauuccacucagguuccugagguggaacccagacccuaacacaguaaacaagucccacaaaugauucugaugcagaaccaaggauugagauccacuacccuagaauaguggccaaguugauuuacccugaugcucacccuuuucugacauuccuucugguggcagugucaguagcuuucauuugccuaggagggcagaaacaaagaaaugaaucagagacuuacaguacuguuaagugugcugugaacaggcagaacaaagagcuugaguuucugaggaaagaaccagacauaaaaggcaaauggcacaagcuuaagagcucugagagacuaugcauuacugcuucggcacagauuauugaaaaggcuuuuuaguagcaaaggggcaugccuccgaccacccuaacaaccugacagagcuguuccucucaagauggcguggcuaucucaugucaaccucacucaccuggaacugacugcuggcuggggacauacacacacacuagggcuggacuguguggucagagcagcaaccuaggauaacaacuaguccccacccugcaugacuaccccucaggguugcuguaugacuacagugcugccacuuguaugcucagagcaagcgaugaaagaggaaagaacaccucuuauaacucuggcugugucucuucagaaagaucaacacagaggguucuggcacagagcucagcaaugcugcacugcucugggccacugauugaaggccaguuguucaggagacuuguguuguccaaaacucuguuuucuaauucuuuguauugagcaauuucuaggaagauguucuaacuggauacuaaugauccguucucacccauucucucgucucaguuuggugauuuuuguaacaucauucucuggaccuccugaaugaagcuguuuggaaacaucgacuucuuuggaccuaacagguaagagacucuuagaaguggcccgaguuugugugucugcaaaggaaaaugagagguaaagcuucuggcaucaugacccgacaguugcaacccuguaacaaacagagccccauucgaaguugucauaaaucuuuauuuuacuuuauuuuaaaaaguauuauuuauuuuuuugagacagagucuugcucuguggcccaggcuggaguacaguggugugaucuuggcucacugcaaccuccaccucuuggguucaaacgauucuccugccucagccucccgaguagcuggacuauaggcaccucaaauauguuuuaaaauuuuaaaaauagagacagggucucacuauguugcccagccuggucucgaacuccugggcucaagcaauccuccugccuuggccacucuggcgugagccacgaugccuggccaaaucuuuauuuucauucuggcaaauuucaacaugugaagauuaauucaaaagaauaaaacuuccaggcuaauuggcaauaaaaaccaaaauuauuuaaacgugacaguacagcauguuugaggguagccaaaaguuucauugaacugaaagguguaggcuguaaaagugaacauggagauggacaccagcagagagcaggguggaaguuagcagguaaaacaugccugaauccuuguaccaucucauuaagcuccuccaagcacucugcacacucuccuaaggcaugacugagcugcucugaguuuuuuuaaaccguuacuucguuguuuuuacuagaaugucuuccuaaccauucuaaggcaucuuuguguccccaucaccuaggaaaguaucuggcauaugaacagggguucaauaacugcuuguugaauaaaugaaacacuucacaguuccauggguuguuucacagaccaucucuaaaccaccugucuggucccuuccucuuccaugcugccugccucuaccacuagcccuuuuguuuacccuuuguuaaguuuagaguuucccuauuaggcauucuaaucugaucuucuugccagauaaccagagaaauggcccugccauaacacucuucuuccccaaaggagagcauuuuccucuauccuugugccagccccgcaaccacacaaucuaucauuuguguucuacagcaaauucaaguaacuuaucuggaguuaagcacccccacccucacaugcaggcuuuucuggacuuacucucacuuuguucacuguaaaauggccccuuuaaguuugaccuaacuuaagagccauuacaaucaaaucaaauugaagaaaugcaguacaaaugaaguauuaaaaggguucuuucugaggugucugucugaagaaaaagguaaucuuggaggaauaucaucuucuccucucucaaguauuaguaaguuuuaaacaauaacaaaucuacuccauguaaaauggaguuaacagucaauugaucaaaauuaacacucuucauugacuagaauugguuccaauaauuuguauuugcuaaaaucuaggauugcacuguaggaaaaauucaguaggauuuaacaaagcugucucuuaaaaaugggagacacugggagaggaacuggauggcuggugucaaggaagggaaggaaacuuguuuaucauuguauaugguuuuccaccuuuuuuuuuuucacaugugcauauauuacuuauccagcccacgcucaaaaucaaaacaaaaauccugggaggcagccuaaaaauuugaaacuguuccaguuacauaugaucauaaagcugggacagagauagaaaucaaagagaugaacacuuccaacuuggcugagagagcuagucacugcccacugacucaggggcaccgcaucuaagggaaagacacagcagcugagagaccuggcuccaguucuuccagcaacuccuaguccccgcuggugccaggauuaccauucagguguucugcggcaacacaagacaacaaacaacccauuaagccuuuggagaaaagccuauuuacuucagagcucaaucuuuuuuuuuuugagacggagucucgcucugucgcccaggcuggagugcaguggcgcaauaucggcucacugcaagcuccgccucccggguucacgccauucuccugccucagccucccaaguagcugggacuacaggcgcccgccaccacgcccggcuaaguuuuuguauuuuuuaguagagacggugcuucaccguguuagccaggauggucuccaucuccugaccucgugaucugcccaccucgcccucccaaagugcugggauuacaggcgugagccaccgugccuggccacuucagcgcuccaucuugccaagguuuauguaccagcugaguggaaucaucugggaagggaucauaaauagcuacuccauaaucucccacaacaguuuucugaugucugaagcuuacucuguacuauaaucucuagauuaggcaguuccccgacugcagaccccaugagaugacuuucaaccacaagcaaagcaacacaaagcagauggcaaagcaauuaaaaacuauuuuuaaucaugucucucucuucgcccaaguuucucaaauacugugccuaggucuaaccccucucucccacuucacucaacaaacguguauugagaaugugguaaugagaaacacggugcagauauaaaggugaacaaagaacccuaaguaucccacuucucaaaugauucuccucuuuccucccugaaaacaaacccaaucccucaagauagcccaagucuggaaauaagacgauaaccgauuagaaggggauuccuagcuuaaugggaauaacauuguacaauaaccaacaacuugaaucuaacugaugaauacaguacacaugcgggcagaaaagugcagagcacgucuaaaauccuaccacaugguccuucccuuaacucccaucauaaaccuacauagccugguuauagggggcucacagguuuucagggccgacgggacgcccuuccccgugcccgcgccacccauucgaucuccacacucccgagaccauccccggccaggccgcagugccccgggcguggcuuggacccucaccugccggcuggccgccgcucagcgcagaggggggcugcaggcuauacacugucuuaaccacacuggucaucguaacgaggcggcacggcugaacccuggaagguacaggaugaauguuacccagcgcugggccacugggcccgagagaguggagggcccggggauagcgcgacccgacaggccccggcucgggguuggaaaagagaaaauccuccuuucccagcucauuccguccuuccucccauccagcccagucccucgccccgggagagccgaacccaggagcccgccgguccugcccgcaguccuucucgcucucguuuaaaagauucccugcagcaacugucgugccaccggcuaagucggccgccuggguuucaaauagaaacuuccgguagcuaggcggaagugggugggaaucgcacucuguagacagccauguuguacggaaaacucuguccaggggcggggcuucgggagccgccauacuguacggaagguucgcucagaggccagagccagaccuagcgaaagguguuggagcccccaggucugggcagaggaggagggugaugcaauuuguaggcuugaauggagcuaau

SEQ ID NO: 191220 - RNA, 68435 nt, Homo sapiens
agauuugaauacuucacugaggcgagccgggcguugugagcggacugcuagaggcggcugucuguuuccgcucuaaggaaacucagagcguguggaccccaaacaagucugcgcaaaauuugucgaggagguuugccgcggcagguaaagagaaugacucuuucguucugggcuucagggaaggcuucggguuuugucugggcgcccugaaguuccugcggugggagguaggguacgcucccucagccuggcggccuccguuagcgccgggccgaguagacgccccugccccgggccgggcacacugugcccuuuuuccccuccucggccuguacguugugccgccucccgcuucccuaacacuucuccgccugcaccucggccccuccggccacccggcucggguugcuuguccgucgcucucuuggcguccucuuccgccccgcccugccguccucugucagggcucgcggacucuucuugcaccccugccgcucuucccuagggaccucucggcuguuuguauuucucacuuaagcuuuuuuuggcucuaaaugaagugacagcaaugagugauuuuaaaauucucagcucuucgugguuuaaggugucugcucggagugcuggccgcacguaacagauuuuucguuuucugcaaguauaauaaccuuaacaaaugaagucaauauuaguacugcgcaaauuaguuuuuaaaaauccucuucuguucauuauuccucaggauuuaagcccuuauucuucacguuuauuuaaauacucaaguuugagggaggaaaaaguauugccgauuggaauuuuacagauagguuuaauaggcauuaacagauaaaggauguggaugaagaccaaagcagaagcuuauuccagucuagauauuaaaauugauguuuucacuuccgucgaauccuguagauauuuauuggguuccuuauccugugauagggccggggacagaugauucccaaaccuagagggguuuacaaagggaaauaacuaauauacacaaauaacuagaauacaagacagaauguaaaagauuauaggacauucuaaaguggugugggagcacggaaaagggagagcuuauuugaugcuuuuggugauggauuuguggagaagaccgcauuugagguggacguugguuggagagaugauuuacagaugggaguuaauaugugguaaaauuuugguaauuaaagguuagggucaaagcaguauaauucuugacuuugcgaauggcuggaaaucuuuacaagaugauaaauacauguaaauugaauuaaaauguuuggaaugguaguauuaaugauguguucgauguuaaauaauagacuguaaaagauacugacucuagauauugccaguaaagcagugcuguccaacagggcuuccugugaaaaugguaauguuuuauaugugcacuccaacauacuacccauuagcgacaugggacuauggagcacuugaaaugucauuauugugaccaaagaacugauuauuaaauuuuauuuuauuuucauuaauuuaaauguaaauaacuacuauauuggacagcacaggucuagagucucugucauuucacucuuauccuccuacaaucccggaaaauacuaacucuagauaucggucguauaaauguaggagugggcaaagagccagauaguaaauauuucaggcuuugcaggcuacauggucuuugucacauauucuuuguuuaguuguuauugcuugccuuguuuucuacaauccauuaaaaggguaaaaaaacacucuuagcucaaaggcuaauugggcucagucgcuguuugaggaccuacggauuauuuagaguagugguucccaaauuuucuugaugcauggcacccugagaucaaagaaauaccuaacagucuauuuauugaguacagugguuggguccaaacauuaaguauauaugucccaaacuuaguagccauuuaaaaaaauacagaaauugaaggaaaauaugauauuuuaaauuuuauuuauuuauuuauucuuuuuugugagacggagucucgcucugucacccaggcuggagugcaguggugcuaucuuggcucacugcagccuccgccuccuggguucaaaugauucuccugccucagcuuccgcaguaacugggauuauaggcacccgccaccaugcgcagccaauuuuuauauuuuuaaguagacacgggguuucaccacguuggccaggcuggucucgaacucuugaccucgggauccgccugccuuggccucccaaaguccugggauuacaggugugagccacugugccuggccaaaauuuuauuauuaaauaaucacacuuacugauuggauaucugugccuguuggacacugcacaacuucugaaacuuuggaaucaguuuauacccugucacccucauuuccuguaguacuuuaauaaaaaauacuugcuuuugggccgggcacgguggcucacaccuguaaucccagcacuuugggaggccgaggcaggcagaucaccugagaucaggaguuugagaccagccugaccaacaugcagaaacugcgucucuacuaaaaauacaaaauuagccaagcgugguggcgcaugccuguaaucccagcuacuugggaggcugaggcaggagaaucacuugaaccugggaggcagagguugcagugagccaagauugcgccauuguacuccagccugggcaacaagagugaaacuccaucucaaaaaaaaaaaaaaaaaaaaagguacuugcuuuuuaucacagcaacugcaaacaguuuaucuuuacagugauguuauuaaaacuaauguaaugcaaauguacuguuuugaucuaguaguucacacaguaccugacagguguucagaacugcugugcaucucucaaaauuuuuaaauaucccaggacaccauugugaguaugcugcagcacccuugggugccagguacacaguuuggaaucaguaacuuuuuuguuuuuuuuucuuuucgagacagagucucacucacuguguugcccaggccagaaugcaguggugccaucucaguucacugcaaucucuaccuccuggguucaggggauucuccugcuucagccucccaaguaccugggauuacaggaacacgcuuccaugccuagcuaauuuuuuugcccugcuaauuuuuuuguaauuuuaguagagacagagguuucaccauguuguccaggcuggucuugaacuccuggccucaagugauccacccaccucggccucccaaagugcugagauuacaggcuugagccaucgcaccaggccccgggaaccaguaacuuaaugugucaauaaucaagaguuuggccguaccaguguuuuauaaaugaggcuuaacuugugagucuggagucuccuauuuguguugaaaguggaacuuaacaguuacagaauauuuuaaaagggggacuucaguaaguuugaauuuuaucaguuaauugcuaacugauuggucuacagauuggacaggaauuaugcuuaaugacuguuuuaaacaacaaagauauuuaggugaucuugaguugauaguaguuauuaucugugaauuuugaacaugugcacugaauuugaaaauauuuccccugggcgcgguggcucacgccugucaucccagcacuuugggaggccgaggcgggcagaucacuaggugaagaguucgagaccagccugaccaacauggugaaaacccgucucuacuaaaaguacaaaaauuagcugggcgugguggcaggcgccuggaaucccagcuacucuggcgggugaggcaggaaggagaaucacuugaacccaggauggggauguuguggugagcugagauggcaccauugcucucuagccugggcaacaagagggaaacuccgucucaaaaaaaaaaaaagaaaaagaaaaaaaaagaaaauauuuccaaaggagaaaaaauaugcgaguugguggucaaauaauuguuucuuaauuacucauucagcaaauguuuauugaggcugggccugcuggcuuauaccgguaaucccaacacuuugggagcagagcuggaaggauugcuugaggccaggagcucaugacaagccugggcagccuaguagacuccagcucuacaaaaaauaaaaauaaaaaaauuagccaggaaugguggcaggugccuguaaccccagcuccucaagaggcuugaggauuacuugagccuaagaguuugagacugcaguaagccuagaucacaccacugcacuccagccuggacaacagagcaagacccugucucccugcccccuccggccccccaaaaaaaacaaaaaaaugaguggguuggggauauuggggauauauauuggaaaucgaauuagauguuggauugaauagaaguaaauggcugucauacuuuuuggaucuuggaaaguuuucaaaguuuaacuauuaaguugaucuuuccuauuaguuuuuugaauauauacuguuaacuuaccuucuauuucucguuugcuguauuaaaaagaaauuuuuuuaaauuuguuuucgagacagggucuagcucuguugcccaggcuggagucuaguggcgugaucacggcucacugcaccaccuaccuuccaggcucaagcuauccuccugccucacccucccaaguagcugggacuacaggcaugugcuaccauaccugguuaauuauuuuuauuuuuaguagagacaagaucucacuauguugcccaggcugcugucaaacuccuggagucaagcaguccucccaccuugacuucccagagugcugggauuacaggcaugagccaccaugccuggcccauuugaaaaaaaaaauuuuuuuuaaacaacuauagcuuuaaaaaaagaguauuuuucaaaaaauuagcugagcaugguggcgggugccuauagucccagcuacuagggaggcuacuugggaggcaugaacccgggaggcagagguugcagugagccaaaauugcgucacugcacuccagccugggucacagagcaagauucugccucaaaaaaaaaaaaaaaaaaguuuuguuuuguuuuguuuuuuuaaacaggaaaggauguuaaaauucauuaagcauccucccccaccccccgagacagggucuuucucuguugcccaggcuggagugcagugguuugaucucugcucacugcagccucugccucccagggucaagcgauccucccaccucagccuccagaguagcugggacuacaugugcgagccaccauacccggcuaaguuuuguauuuuucguagaggugggguuuugccguguuguccaggccccuuuggacuccugagcucaagugaucagccugccucggcugcccaaagugcuaggauuacaggugugagccacugcccccagcccuuaacuuuuuucuucaucuguugagaugauuauaugauuuuuaccuuuuaaucuguuaguaagguaaauugcaagguugauuuucugauauuaaaccgauuauguauuccuuuuuuuuuuuuuuuuuuuuuaaagagacggggucucccuauguugcccaggcuggaguacaguagcuauucacgguugcaaucauaguacacugcagccuggaacuccaggguuccagagauccuccugccucagccucccaaguagcugggacugcaggcacauugccccauaucugcccacccaauuuugcauuucugcaauaaaaccaacaugaccgugauauauuauccuucuuacaaauugcuggauucuuuuugcugauauuuauuugggauuccuuuuuuuuuuuuuuuuuugcaauggaaucucacuuuguugcccagguuggagugcaguggccccguguuggcucacuguaaccucuguccccuggguucaagcaauucuccugccucagccuccuuaguagcugggauuacaggcacccaccaccaugucgacuaguuuuuauauuuuuaguagagacgggguuucaccauguuggccaggcuggucucaaacuccugaccugaggugauccauccaccuuggccucccaaaguguugggauuacaggcaugggccaccacgcccggcuauuugggauuuuuauacuuuugagaauggcauguaaucuuuccuugguguguguguaugugugucucagaggugguugcaggaaaggaaguuaaauuuugaucucccauggugggaagacagacaguuuaauggcuaaaacuagaaaaauagcugggcacaguggcucaugcuuauaaucccagcacuuuggaaggcagaggcagguggaucgaagcacaucaaauaucuuucagguaccuguuuacuuauugcuaaaagcaagaacauugauccuguuuauguguauuguauuaauuuaguguugugguggaaaugcuaauaugguugagucaaaaucucuagcuauucuuuuuugaaaucugcaguggcauuuuuuucuuauccaaggaugagauucuaaaguuaauacauaaagugaaaaucaaauauagggaggcaggaacugagaccaguucaggaaacuucacguuaugccucuaaguucauauucuuuccagggcaaauacucacugagugaaauuuaaagcauuaucagcuaugcuaauaaggugcuauuuucauguguuaaauuuuuuugcugaguacuuaucguugacuuucccucagauaaauauacauaugaugcaaauucacuauauuuagauaucuaauucagguguccccaacccccugggccguggaacgguauagguccacugccuggauggcacagugggagaucaguagcagcccagcauuagcggccugagcuccgccuucugucggaucagcaguggcauuugauucucacgggagcacaaacccuguugugaacugcgcacacgagggaucuagguugcgggcuccuuacgagagucuaaugccugaugaucagagguggaacaguuucaucccgaaaccaucccccaucacacccuccuggucuguggaaaaauagucuucccuaaaacugaucccugguuuggaaaagguuggggaccacuuaucuaauugauguccacuuugggaguggauuauuaaauaaucugcaaacucuuauaagcuaggccaaauuuuuauuugaaccaguaaagucccuagcauccugaucaaaguuagucacugauuuuuaucuugagugugauaauuuuccaggaauauuaauuauaauagugguuuaaauuuauuaaaaugggccaggcgggguggcucacgccuguaaucccagcacuuugggaggccgaggcggguggaucaugaggucaggagaucgagaccacggugaaaccccgucucuacuaaaaauacaaaaaaaauuagccgggcgcggucgugggcgccuguagucccagcuacucgggaggcugaggcaggagaauggagaauggcgugaacccgggaggcggagcuugcagugagccgagauggcgccgcugcucuccagccugggcgacagagccagacuccgucucaaaaaaaaaaaaaaauuccuuaaaaaugcaucuuuuuuuuuuuuuuuuuuuuuuuuuugagacagauucucgcucugucgcccaggcuggagugcaguggugcaauuucggcucacugcaagcuccgccucagccucccuaguagcugggacuacaggugcacgccgccacgccuggcuaauuuuuguggguuuuuuuguuuuguuuuuguuuuuuuuuugagacggagucuugcucuuucgcccaggccggacugugguggcgcuaucucggcucacugcaagcuccgccucccggguucacgccauucugccucagccuccugauuagcugggauuacaggcgcccgccaccgcgcccagcuaauuuuuuuuuuuuucuauuuuuaguagagacgggguuucaccguguuagccaagauggucucgaucuccugaccccgugaucugcccgccucggccucccaaagugcuguauuuuuuuuuuuuucaguagagacgggguuucaccguguuagccaggauggucucgaucuccugaccuugugauccacccgccucggccucccacagugcugagauuacaggcaugagccaccgcgcccggccaaaaugcaucguuuuauaucuucauaauguaguuuuuuuccuuccuuuuuuuuuuuuuuuuuuuuuuggagacagaguuuugcucuugucgcccaggcuggagugcaauggagugaucucagcucaccgcaaccuccgcguccuggauucaagcgagucuccuaccucagccucccaaauagcugggguuacaggcaugcgccaccacgcccagcuaauuuuguauuuugguagagacgggguuucuccauguuggucaggcugaucucaaacuucugaccucaggugaucugccugccucggccucccaaagugcugggauuacaggcaugagccacugcgcccggccuuuccuucccaucuuuggucuucccucagaaaguaacccugaagucaccaucuguacucuuaaucuuuucuuagacuguaguugcucuuccuuuuuccucauguuuucuaauauuguauauuuguuacagaaaaguuuucuucaaaaauggauggggugucuucagaggcuaaugaagaaaaguaaguucauuuaaugcagcuaaaaauauuauauucuaucagagaaagauauuuuucuaauuaguaagaccuauccauaacuucugagaucuuuuuccauuguguuccaagaaaaaguaguaguuuuuuuuuuuaaauuauacuuuaaguucuaggguacaugugcacaacgugcagguuuguuacauauguauacaugugccauguugguuugcugcacccaucaacucauuuacauuagguauuucuccuaaugcuaucccucucccagucccucacccccuggcaggccccggugagugauguuccccaacccuguguccaagugaucucauuguucaauuuccaccuacgagugagaacaugcgguguuugguuuucuguccuugugauaguuugcugagaaugaugguuuccagcuucauccaugucccuacaaaguacaugaacucauccaaaaagaaguagauguuacagacucauagcuuuccuugccauugccauaacuuuguauaaacucaucuacucugggcaugguggcucacaccuguagucccggcacuuugagaggcuuaggcccaguaacuugagaccagccugagcaacauaguaagacacccccgcccccccaucucuacaaaaaauaaauuuuuuuaaauggagggcucuuggcuuuaccagccagggaggaugcuuggcuuugcccaggaaagaauucaugggcuagccagcgguguuaaacagcacuuuuauugaaguggcauagcguaaagcagcagcacugguauagcuccuugcagagcagggcuacucuguaggcaguaugcccagaguagcagcucagaggcaguucugcacucauauuuauacccauuuuuaauuauaugcaaauuaagagguguuuuaugcagacauuuuuagaaugaggguaguaacuuccagcuugucaggucauugccauggaaagggcagguaacugcuggguuuuugccauagcaaugguaaacugacaaggcacccuggugggagugucuuguggggaggugcuuuugccccagaccuguuuuagcuaguccucaauuugguccuguguccaagccccaccuguggagucaaguucugccuccuaccucaagacccugucucacauaucaucaucaucaucaucaucaucaucaucaucaucucaucuagggucaaaucugagagggacuuuagauacuaucuccuaucucuucaauuuaaggaugagaaaauugagaaccaggaaaauugagaaccuaucucuucaauuuaaggaugagaaaauugagaaccaggaagaaaaaugauuugucuaaaauugacaucacaaccugguggcuuguuugcagccugcagucauaaguuuuuggcuuauacauaguauuuuuugauuguuucuuuuuaagagacugugucuugcuuuguugcccaggcuagauuuggacuccugggcucaagugauucuccugccacagccuccugaauagcuggaaguauagacaugggccacuguggcuggcuuuggccuacacauauuuuuuaguuuuugaauuaguugccaaaauuuuaaaaucucaaaauuuuguacaaucggguuuucagcuucucuugaaaaaucaagcguggcaacacugggcuccuauucuuguuuggcaacaacuaaccacagcagaggaaugacugaccuuuaggugagagaggaauucucuagauuauuauaaucucaacacuaccuauuuuucuugcuccuaaaaaauuaucuguuuagccucauaggcauuugaauuuucaaaaccuggucuaaaaaucguauaguaguaaaaccaaagcuagcgucucuugacuuauagcccauuuaucuuauuauuauaccucuauaaauaugguaaauuauguuguacugauaauuauucaagagauagucucguaguacacaauauguauuuuaaaacacugaauuccuaacugaauuuaaagucuuguauauaaauuuugcuugccagagugcuaagagaaagugaugaccaguuugaaagcauguaaggggugcugugaugaugccuuuugugaauucauuuuuuuaaaucacuguguauauaauuuuguuuuccuuuuucagugacaauauagagagaccuguuagaagacggcauucuucaguaagaaagacuuucuugaauuaauaauugucagcuuuuauuuaaugauaaccauauaucacaguaguuuugacuguggcuucaccauccuacccuuacuggcuuccuguugcucucuagauaaagacucaaauauuuaacgugguuauacaauucuguaaauauaccaaaauucauacuuuaugaauuuuguaguaauuuuaugaauuuuaugcuauguaaguuauacuucaauaaagcuguuuaaaagauauguuuaaccugugguacaaagcuguugcaagagacagaagaccuacccaaacugcuuuuguguuuuugagauagagucucgcucugucgcccaggcuggagcgcaguggugugaucucggcucacuguaaccuccgccuccuggguucaagcgauucucguguuucagccaccugaguagcuggaauuacaagcauguaccacguguggcuaauuuuuuuauuuuuuagaagagaugagguuuugccauguugcccaggcuggucucaaacuccuggccucaagugauccuccugccucagccucccaaagcgcugagauuacaggcgugagccacugugcccagcccaaacugcuuuaagcacaaaauguguuggguuaugauacuaaaaaauccaacgaagggauggcuuuaggcacacuuacugaccagagauucuaaccaugacaccaguacuaggauuuccuuuugcuuuuucuacucuuagugcuuccucuggguaaucuccagcagauagauucuuucccuauaauuacugugauacaucuagcucuuuuacuuccaggcccaaguccuacgugaagaauagugucuuuuuccugaaaacagaaaagacucagaauugaaucauguuagcuugauuauccugauaugggucaaguccucauuccugaacaaaucaucauugacaagagaauaucagauuguucuagacagagcuauguguuuuacccuagaguugguguggcauucacucagaccaugugggaugagagcggguagaauaauuggagaggaugggcagguagaagggaauagaugucagauauuuaaaucugccacacgguauagcauugagcagaaugaauuugaggaguuucagaguuuuuaaugaaaauuuuagcuuucuaccuaugauauaacuugaaauaaacugauucuuaauagauaugccagauuuuuuuugaauaauucuaauuguuacccuagauauugaaacccccaaggaguccucuucaggaccucagaggugggaaugaaagaguucagguaagucuuuugugcaaauacuuuauagaugacuauuuucaguuauauuuuuaagucaagaaguuuauuagcuauuugaagaggaaauguguaagcaucccaugaguuuccaaacacuugaauauacuggcauucuugauuuuucauuuuucuucuuuuuucuaggaauggcaucucccucucuuacccagguuggaguguaguggcacaaucauaagucccugcagccuugcauuccugggcucaaucaaucuucccgccucagccuccugaguagcugggacuacggcacaugccaucauacuuagcuauuuauuuauuuauuuagaaacagggucugacuguugcccagacuggaguacaauggugcgaucauggcucacugcaaccuccucccccugggcucaagagauccucccaccuuagccuccugaguaacuaggccuacaggaacaugccaccaugcccggcuaauuuuuuauuuuuuauagagacaggauuucgccauguugccccacgcuggucuugaacuccugggcucaaguaauccacccaccuuggucuuccaaagugcuggcauuacaggcgugagccacuguacccagcccuuaaaaaauuuuuguuuuuaguauagacagggucuugcuauguuggcugggcugguuuugaacuucugggcucaagugauccucuugccugggccucccaaaguguggguauuauaggcaugagccaucgugcugggccuuucuuuuuucaugucagauguauaaugugccaacaucguaacaaaguuugaagaaagcacaucucacacaugcgugugaaaacccaaucacacuuaugaacuacgaaaagaucaguauucuuuuuuuucaguaagaaauauauuagucucuguuagucccaguguuuaccaugucaguauugucauauuaagcucaaggcuaccuguagcaucuucuagggccuuaaucacaucacugcuuugaugcagagggguuaccauuucugauucuuuauuauaauaagacuuaugguuagguauucagaauuaacccaguaaaacucucuguggauuuuguuucugucuuuugauuauuauuauuauuuuauguuuuuacuugacagcaagcucauccuuaaugucuuuuaguuuuuguguaugguauuuaugugaguagaaauguuugcucuuguuaaagaagguggggaaggaagguaaaaauaguguauucuaaugaagagaugcucaacaucauugaccauuagggaaauguaaaucaaaaccuaaaugagauaucaccucacacccauuaggaugguuaaaguaaaagacaauaacaaguguugaugaggaugcagagaaauuggaacacuugugcuuucuugguggggguauaaaaugguacagcugcuauggaaaacaguauggcaauuccucaaaaaauugaaaauagaauugccauaugauccaacaauuccacuucuggauauauauccaaaagaauugaaaggagaguuucaaagagauauuuguacacccauguucauagcggcauuauucacauuagcuagaagguggaagcaacucaaguguccauugauggaugaauggauaaacaaaaugugguaauauauacaugcagugaaauaucauucagccuugaaaaaaagaaggaaauucugacacauacuacaaaaugugaagaaguaauucagaauaagacuugaucucuggccgggugcaguggcucaugccuguaauccuagcacuuuggaaagcugaggcgggaggaucacuugaggucaggaguuugagaccagccuagucaacauggugaaaccccaucucuacuaaaaauacaaaaaauuagagguugagacaugaaaaucacuugaaccugagaggcagagguugcagugaacugagaucgaguuacuguacuccagccugggcgacagaacaaaaccgucuuggaaaaaaaaaaaaaaaaaaaaaagacuugucugggugcaggggcccauggcuauaaucccagcagcacuuugggaggccgaggugggccgaucaccugaggucgggaguucgagaccagccugaccaacauggagaaaccccaucccuacuaaaaauacagaauuaguuggucguggugacguaugccuguaaucccagcuacucgggaggcugaggcaggagaaucgcuugaauccgggaggcagaggcuguggugagccaagaucacaccguugcacuccagucugggcaacaagagcgaaacuccaucucaaaaaaaaaaaaaaaaggacuugaucucugucuauaguacucuggagauguaauucacagugauuuuauuaagaauuauaccauauauucucugcccuuaggaauccaaugcuuugagaaauaagaaaaacucucgucgagucagcuuugcagauacuauaaaguaaguugaaagcagaaauaacuaaaauauuauagguacugguauuuuguguaucaaaccaaauguauugguacugacuugaauaaucuguuuugauuaaacauuaguuauucuucaaaggguuauucaguauuauguuuaaaagagaaacaaagcauucccucuaaagucaggaacaaaacaaugauauccaacuguuauuugacauuguacuaggggccgggugugcuggcucacgccuguaaucccagcacuuugggagguugaagccagaggauugcuugaggccaauaguucgagacuagcccaagcaacuuagcgagaucccaucucuacaaaaaaaaaaaaaaaaaaaaauuagcuaggcaugauacccugcaccuguagucccagauacuuaggaggcugaggcuggaggauugcuucaguucaggaguucuaggcugcagugagccaugauagugucauugcacuccagccugggcaacagagugagacccugucucaaaaaagaaaaaagaauagcuucuauauagugagugauaccuaauauuagcagaauuagaaugaacuggucggauucaaggcagaugucaaaugcuccuugaagcuuauucuuaaccagcccagugaaaagggaucccuuccuauggaguccaugcuaccauaccugaacuguuaauaacaaaagccagugaaauaauguuuauaaucacuguucuagcucuauuuauaguggaagcuccuugagucaaggaucauguguuuguaucccaggcccuaguaugauaccagguauauagugaguguuuaauaaauacuuguugaauuaaaugaauauuuuaggugauugagagggauauaauaauuacuaagucagagcucauuuaaaaauuauaaccucugcaguaacaaauggcucagaaucuuaguuaaaaauaaauaaauaaauaaauaaacuauaacagcauugucucuacuagaaauaaaaaauauuagucaggcuuguuggugaggcuacucgggaggcugaagugggaugaucacuuuaaccugggagauugaggcuacagugagcugugaucgcaccacugcaaucuagacugggcaacaaagcgagacccuguuuaaaaucaaaaauaaaaacaaaacuauagcagauuuuauugugguaaacuacuuuuggcauuugaaauacuaggaguauauggcauagcaaagaggaagcuaaaaucaaaguauuaucuugaccuaucucaacacagacuauaaaucaacaccaaaagauaaugauuacaaauugcagguuuucaauaaucuuuauuuucucuucuaggguauuccagacggagucucauaugaaaauagugagaaagucagaaauggaagguaaguauguuacuauaauuccugcuaaaucugcuuuuuaaaaaauuuuacuguagcuaucuaaccagacaacuaauauaacuuauugucuaucuuauugcuuaaaaaauauaugaugggccaugcauagugguucacaccugugaucccgacacuuuggcagucugaggugggaggaucgcuugagcccaggaguucaagaccaaccuggauagcauagugagauucugucucuacaaaaaauaaaaaauuagccaggugugggggugcauuccuguagccccagcuacucaggaggcugaggugagaggaucacuugaguccagaagauugagacugcagugauugcaccagugcacuccagccugggcaacagagcaagacucugucucaaaaacaaaaaaaguauaccuugagucuugggaguagagaguagaguggauaguaaguaaauuuauuuauuuauuuauuuugagacggauuuucacuguuguuccccaggcugcagugcaauggugccaucucagcugcaacuucugccuccuggguuuaagcgauucuccugccucagccucccagguagccgggauuacaggcaugcaccaccacacccagcuaauuuuuguauuuuuaguagagacaggguuucaccauauuggccaggcuggucucgaaccccuggccucaagugauccgccugccuuggccucaaaaugcuaggauuacaggcgugagccaccacguccagcaguuaauaauuuuuuuaaauguuguuaauguccuuaaguaauuuuuuaaaaauuuuauuguauuuuuuuuuuuuuugagacagagucuugcuugcccugucgcccaggcuagagugcaguggugcgaucucggcuaacugcaaucucugccucccagguucaagcaauucuccuaccucagccuccugaguagcugggauuacaugugcacgccaccacaccuggcuaauuuuuguauuuuuaguagagacaggguuucaccguguuggucagguugaucucgaacuccugaccucgugguccacccgucucggccucccaaaguucugggauuacaggcaugagccaccgggcccagcuguccuuaaguaauuuuucuaaugcuuuaucaguguauccuuggacaaauuuaauuuuaauuuuauuuuuagaaacagaaacaggagaaaaucuucuuuugauacaguaaguaauauucaaauuauauuuaaaaaguuauaaauuaauauuauuuuuauuucuuauuuuuguguuccuuuuguggaauacuuaggauuaauucagaaaaccaguuauuugcagaauuuaguauacugcuauaucugauuaauauggccauuguacuguuuauaguuuuaauagugaugaaacaauauaauauauaaaccuuuauauuuauuaacuaauauaaaacaauagauagcaagucuuuaguuuuuuuauuaaauuaaucuuucuuauaauauuauuacauagaaaggcaaauaccaguagcucuucaacaaaugaaaagaugguuaucuuuauucaucauaagagaaguacagauuugauuauauugagauauuuuuggcuggacgugguggcucaugccuguaauccgagcacuuugggaggccgaggcugguggaucaccugaggucaggaguucgagaccagccuggccaacaugaugaaaccccaucucuacuaaaaaaauacaaaaaauuggccgggcacaguggcuuacgccuguaaaccaagcacuuagggaggcugaggcggguagaucacgaggucaggagaucgagaccauccuggccaacguggugaaaccccaucucuacuaagaauacaaaaauuagccagguguuguggugggcgccuguagucccagcuacucaggagguugagguaggagaaucacuugaaucugggagguagagguugcagugagccgagaucaugccacugcacuccagccugggcgacagagcgagacuccgucucaaaaaaacaaaaaaaaccccaaaaaauuagccagguaugguggcacugugccuguaaucccagcuacucaggaggccaaggcacgagaaucgcuugaacccgggaggcggagguugcagugagcugagaucaugccccugcacuccaaccugggcagcagagcgagacucugucuccaaaaaagagguuuuuuugcuguuguuguuguuuguuuguuguuuagacggcaucuuccucugucgccaggcuggagugcaaugguacgaucuuggcucucugcaaccuccgccuccuggguucaagugauucuccugcuucagccucccgaguagcugggacuacaggcgccugccaccacgccuggcuaauuuuguuguauuuuuaguagacacgggguuucaccauguuggccagaauugucuuggucucuugaccucgugauccgcccacuuuggccuccuaaagugcugggauuacaggcgugagccacugugccuggccuaaaaaagagauauuuuuauccagucaguuaaggaaauagguaaaaagucacuccgugcuagugggaguauaauuuguagaaggcaacuugguaauaucguucagaauuuuaaaugcacaugcccuuugacuucaguuuuaugucuggaaauuaucucaccaauauacguguaaauguuugaaaugaugaauagauaagguuauucacagcagcguuuauuauaauaguaaacguugugaaagguccugaagguccaucaguaagggccugguuaaauaaauuguacauuuuccauauaauugacuaugcagccggaaaaaaaauuuuaugcuaaauagagaaaucucuaagcuauauuacuuaagauaaaaagcaagacgcaaaacaaaguauaucauguauuaccacuuggguaaaacagggaagaagaaaagcguguguguguguguguaucuucucguguguguacauguauaauguauguauauguagugacuuaugcauauauaugcauaauaucucuggaagaaacuaguaagauugccuacagagaaaagaaccuugcuauagguuacauguuggcuuugugguuuauuaauuuaaaaccauaugaaaguauuaccuauuacauucuuaaaauuguugaaacgaagaaauggaaguaauaguagucaugguuuagaaaagguacagaaucaacuccaacagaacuuaaaggaaaaauaauuuuuuaaauaaaaagguacagaaguauauacauugaaaaguaaaaauuauucccucuuucccucuucuuucuuuuuugugagacgggguuucgcucuuguuggccagacuggaguauaauggcaugaucuuggcucacugcaaccucagccuccuggguucaagcaauucuccugccucagccuccugaguagcuaggacuacaggugugcaccacuacaccuggcuaauuuauuuuauuuuuauuauuuuauuuuauuuuauuuuauuuugagauagagucucgcuccgucacccaggcuggagugcaguggcgccaucucggcccacugcaagcuccgccuccugguuucacgccauucuccugccucagccucccuaguagcugggacuacaggcgccugccaccacgccuggcucauuuuuuuguauuuuuaguagagacaggguuucacuguguuagccaggauggucucaauuuccugaccuugugauccacccgccucggccucccaaagugcugggauuacaggcgugagccaccacgccuggccccccuuuuuuuuuuuuuugagauggagucuugcucuguugugcaggcuggagugcaguggccuaaucuuggcucacugcaaccuccgccucauggguucaagcaauucuccugccucagccucccgaguaccugggacuacaggugcacaccaccacgcccagccaauuuuuguauuuuuaguagagaugggguuucaccacguuggccaggcuggucucgaacuccugaccucaguuuaucugccugccuuggcuucccaaagugcugggauuuuaggcaugagccaccacacccggccuaauuuuguauuuuuaguagaagcgguguuucaccaugucggccaagcuagucucaaacuccugaccucgggugaucugccugccuuggccucccaaagugaugggauuacagacgugagccaccacacccagccuauucccucuucuucaggugacucacuccuuacagauaaccacuguugacaauuuuugguguacuugcagaaauuuuuuuuguauguccaagugcauguuuagcuuuuauuuuuuuaaacaagacaaaaaugggauugccuaguaauaugucuuauagcacuuucuauguuauuacauaaagauuuaccucagucuguuacaaucucuuguauggcugcaccaacauuuagugaacucccuauugauggacacuugagugguuucuuucauguacuuuuuguuuuaaggcucaaguuuuagaaaaggaauugcuuuauaggucauuuuuugaaaaaauaagcaagcaguauauauuaagcauauuuuucuaguuuauuuuuuugagauggggucucacucugucacccaggcuggagugcagugacaugauuauaguucauugcagcccuggacuucaggucucaagugauccucccacuucacgcucccaaaguguugggauuacagaugugagccaccacggcuggcugauaauauucuugaaauuagcaaaccauuaagaccaaucugaaaaguauccuuuaguugccuuguaauuccuucagccaguauuagaugagucuuuuuuuaaaaagaugucuuuauaauuuucugcauuagaugagucuuuuuuaaaaagaugucuuuauaauuuucugcuagucauucuaugaaagucuuucaccuucuguacucuuucagcuguuauugaaagauucuugguaauuguuugggguauagauuauaaaaauacuuuuuaauuuuuaggaauaagaaauuagaagauaauuacugugaaauuacuggugaguaugacuagaauacuuuucuuauaguaagauagucuauucaucuagguuucuugaucacuauuauguacaagaaaccaugaaccacgaaaaaaaagcaaacagaggccaggcacggugcucacgccuguaaucccaguauuuuggcaggcugaggcaggcagaucacgaggucgggagaucgagaccauccuggccaacauggugaaacccagucucuacuaaaauacaaaaaaguagcugggcgugguggugcgcuccuguagucccagcuacucggggcugaggcaggggaaucgcuugaacccaggaggcggagauugcagugagcugagaucgcgccacugcacuccagcaauggcuccaaacagagcuuuguucuuuuuuuuuuuuuuucuuuuugagauggaguuuugcucuuauugcccaggcuagugcaguggcacaaucucagcucacugcaaccuccgccuucugguuucaagcaauucuccugccucagccucccaaguugcugggauuacaggcgcccgccaccacgcccagcuaauuuuuuuguauuuuuaguagagacaggguuuuaccauguuggucaggcuggucucgaacugcuacccucgugaucuaaccgccuuggccucccaaagugcugggauuacaggugugagccaccgcgccuggcccagggcuuuguucuuuacacauugucuucaauuuaaaauuucacaggcucacuauuacuucuuuuuuuuuuuuuuugagaugaauuuucauucuuguuguccaggcuggggugcaguggugcaaucugggcucacugcagccucuaccucccggguucaagcaauucucuugccucagccuccugaguagcugggauuacaggugcccaccacuacacccagcuaauuuuuuuuguauuuuuaguagagacaggguuucuccauguuggccaggcugcucucaaacuccugaccucaggugauccacccgccucggccucccaaagugcugggauuauagguaugagccacugcacccagccaacucacuguuacuucuuucaaaccugcuguuucuccuguuuucucugucuuggacucccacucauucagucauucacugaagucaggaaucaagaagucauuuucaauucuuccuuuaugucuaauggccauuuggccuacuuucuguuuugucuccuaaaugucuugaaaaucguuaccuauucuguauuccuucugugacugcuuuaauucaaguuguuauuauuuuuucuugggcuacuguauuucauuucuuauccuuccaauccauucuccauauuucuaaauuugauuauguuaccucccagcuuaaaaugguucaaugacacuguuuugcuuacagaauaaagcccauacuccuuagcaaugaguuagaauguccuuuaucacuuggccuguuuucuucuccaaacuuaucuccuacccauuauauagguaucccaugcucuagcccaugaugaauuauuugcaguucacuauauaaacucuuuuucugccuauaugcauuuauuuuucauuuuauuucauuuuauuuuuuugagacggagucucacucugucacccaggcugaagugagguggugcgaucuuggcucacugcaaccuccgccucccagguucaagcgauuuuccugccucagccucccgaguagcugggauuacaggcacgugccaccaggccgagcugauuuuuguauuuuuaguagagaugggguuucaccauguuggccaggcuggucucaaacuccugaccucagaugauccaccgccuuggccuccagagugcuuggauuacaggcgugagccuccgcacucagccccuauaugcauuuauaaaugcuauuuucucuaucuaaagugaucuuucuacuccaguuugccuaucaggcuucucauuuuucacuucacuuaguuuaacuucagugcuauccaaaguguccaguccacaaacuaacugcucaguccaugacagaaaaggaauuuguaccauaaugugccuuaacuguggcauuaagccacaguuuaguuuaguuuacacuuuuuuccuagcaauuauuauuauaugauuuauguuugccgccagcuccuuaucucguuaugaauagguaacaagcaguucacagucuggcaccauacuucaaguagcacuggcuuaaauggaacccucucuggcaaaacuaaggaguuagucagauguucugugcucccauaacaccucuuuuauuuuucaguauauuuuagaauuuaucacauuguacuuuaaguauuucuggcugucuuauuaaagaggccaaacuuuuuuugcaggcggugggagauacuccuccuugaggagcacagcuaccccauaggcagugugcucagaauagccugaacuaccaucucugagaguccagaaauucagaaauuuugucuuguucuucuuuauaccuuaguagacauuugagguguguucguuuguuuguuuuguuuuuucauguaauagguucugaaccaacauuuguugaaaaaaugaauggaagccugaaauauaaauaaggcuuuuaguaaaaaaaaaaaaaaaaaaaaaaaaaaaaaaaaaaaaaaagcuuauaauuauuucauuauauguacucaagcucgucauacauucuuuaauguguucuaaagauuugccuuuaaacuuuaaauguaaguauuuuuaaauguauuuccuguuuuaauauagccuuuugaaucccuuccuuauuuacaaagucugauuuguaguucuaaaauaagucuugagucuaauccuuuauuuccauuuucauugcucuguugcccuaacaugaccucuugcguuaaucugaacuauuguaguaacuuccuuauugguuuaucuucucuugaaucaacuucuccuuauuacuuuuuacuauuuuucuaaaaugcauuauauuuuauaaugggauuauuuuuauaaagcacaugugucuuaucaugggaauaucuagauuccuuaacauagaauaaaagacccuucagaauccuacccuaaccuuucagucucaucauuugauacucuucuccaugggacuucuacuauccaggaaauaaaaauagagaagugaauaauaauaauaauaauaaguaguaguccaaacuuuccaucuuuaaaaucaccaccacauuauaaaaauauuucagccacacagaggauacaauaauuauuggucucucugucacuaacauaggauaauuaagucuuaugaaauuuuauauguucccaacacaaaagauaaauguuugaggugguggauauuccaguuacccugauuugaucauuacacaauguauacaaguaucaaaauaucacauguaacacaaaaauauguacaacaaugauguaucaauuuuuaaaaaauuaaaaaaauuuaauacguaaguucuuaagggcuuaguuacugguaaauucuaguaaauacuuguaacugaugaagaaccuaagaaaaggaaaaucaggcucaguguuauauuuucugacuacaguuuuuucuuuuuucuaaauagggaugaacacauugcuuucugcucccauucauacccagaugcaacagaaggagguaugaguucaugcaaauaccuucauauuguaaugucauuugauuguuaaaacagaaaacacaauucaaugauaauggcauaguuuagggaugacuuaaaaaaaugaaucagcauaaacuggaaaggcuuccuaccuuuccaguuaacuuaaggauaguuaagucacagccaguuuaaguaaugggagauacaguauaccaguaccucucaaaguuuaaagagcacaugagucuuuauuucuauuuccuuagugauacuaguacacaaguccauaggccauacuuucaguagcaaagaguuaaucuguguccucacugagaaaacuguuguagcacacaguguaauauauauauauauauauauauuuuaggcuaucuccuacaagaaggauuuuuuuugguuguuguuagacacagucuuacacuguugcccaggcuggagugcaguggcacaaucuuggcucauugcagccucaaucuucugggcugaagcgauccucccaccucagccuccugaguggcugggacuacaggugcaugccaccaugccuagcuaauuuuguucauuuuuuuguagagacaaggucucacucuguugcccaggcuggucuugaacuccugggcucaagggaucuuucugccuuggcuucucaaagugcugggauuacaagugugagccaccaagcccagucuagaauguaauauagauuagccaucaugggcuuaugucuuuccuagacuuuuaaaauuuaggauaagaaugaccuauucaauauaguaauuagaauuuuugucauguuuacauuuggugcugucaguguuuuuaauuuuuuagucauucuaguggguguauaauuaaccuugaauuuuuaauuugucccaaaacacuaaaaaguaaauuacucgcagacuuuagauuucuuuuucuuuuccuaauagauuggguauuacucuguugccgaaguuggagugcaauggugugauccuagccuaugacagcucaaacuccuggacucgagcaguccucccaccucagccuuccuaguagcuaggacaacaggcaugcaccacugugccuaauuuuuauaauuuuuuguagagacaggaucuuacuuuguuacuccuggcuucaggcaaucccccugccucagccuuccaaagugcuuggauuacaggcgugagccacugugccuagccuagaauaauuuuuuuuuuuuuuugagacagagucuugcucuguugcccaggcaguggugcaaucucagcucgcugcaagcuccgccucccagguucacaccauucuccugccucagccucccgaguagcugggacuacaggugcccgccaccaugccuggcuuauuuucuuuuuuguauuuuuuaguagagacgggguuucaccauguuagccaggauggucucgaucuccugcccucgugauccacccaccucggcuucccaagaauaauuuuuaaugacaaauuauaugcaacaugcuacaccauugauucaagcaaaccaacguguuaugaaaccaucacugaggauuuuuuauauaauacauguuguaaaaugccuuuuuaaaaguuugcuuuuguucugaucucuuauauuuugcuuucauuauaguuuucaauuauagaacauacccgugaaaggaaacaugcaaaugaccagacagucauuuuuucagaugaaaaccagauggaccugacaucaagucacacuguaaugauuaccaaaggccuuuuagauaaucccauaagugaaaaguccaccaagauagauaccacaucauuucuagcuaauuuaaagcuucacaccgaggacucaagaaugaaaaaagaaguaaauuuuuccguggaucaaaacacuucuucagaaaauaaaauagauuucaaugacuucauaaaaagauugaaaacaggaaaauguagugcuuuuccugaugugccugauaaagaaaauuuugagauaccuauuuauuccaaggaaccgaacagugccucuucuacacaucaaaugcauguaucucuuaaggaagaugaaaauaacaguaauauuacuaggcucuuuagagaaaaagaugaugggaugaauuucacccagugucauacagccaauauucagacauugauucccacauccagugagaccaacucacgggaaucuaaagguaaugauauuacaauuuauggcaaugacuuuauggacuugacauuuaaccacacuuugcagaucuuaccugcaacagguaauuuuucugaaauagaaaaucaaacucagaaugccauggauguaacaacagguuauggaacuaaagcuucaggaaauaaaacaguuuuuaagaguaaacaaaauacugcuuuucaagaccuuuccauaaacucugcagacaaaauacauauuaccagaagucauauuaugggggcagaaacucacauagucucacagacuuguaaucaggaugccagaauauuagccaugaccccagaaucuauauauucuaauccaucuauucaagguuguaagacuguuuucuauucuaguuguaaugaugccauggaaaugaccaaaugucucucaaauaugagagaggagaaaaauuugcuaaagcaugacaguaauuaugcuaaaauguauugcaauccagaugcuaugucuucucucacagagaaaacuauuuauuccggagaggagaacauggacauuaccaagagucauacaguugcaauagauaaucaaauuuuuaaacaagaucaaucaaaugugcaaauagcagcugcaccaacacccgaaaaagaaaugaugcuccaaaaucuuaugaccacaucagaagaugggaaaaugaauguaaauuguaacucaguuccucauguaucuaaggaaagaauacagcagagccugucaaauccuuugucuauuucauugacugauagaaagacugaacucuuaucaggugaaaauauggauuugacugaaagucacacaaguaacuuaggaagucagguuccucuugcagcuuauaaucuagcaccggagaguaccagugaaucucacucucagagcaaaagcucuucagaugaaugugaagaaauuaccaaaagucguaaugaaccauuucagcgaucagacauaauagccaaaaacagcuuaaccgacaccuggaacaaagacaaagauuggguuuugaagauuuugcccuaccuugauaaagauucuccucagucagcugauuguaaucaggagauagcaacaagccauaauauagucuacugugguggaguucuugauaaacaaauaacuaauagaaauacaguaucaugggaacaaucuuuguuuucuaccacaaagccauuauuuucaucaggacaguucucuaugaaaaaucaugauacugcuauaaguagucauacagugaaaucuguacuaggccagaauucuaaacuggcugagccacugaggaaaaguuuaagcaaucccacaccugacuauugccaugacaagaugauuauauguucagaggaagagcaaaauauggaucuaacaaagagccacacugucgucauuggauuugguccuucugaacuacaagaacuugguaaaacuaauuuagaacacacuacuggccagcuaacaacaaugaacagacagauagcuguaaaaguugaaaaaugugguaaaagucccauagaaaaaaguggagugcuuaaaucuaacuguauuauggauguguuagaggacgaaaguguacagaaaccuaaauuuccaaaggaaaagcaaaaugucaaaauuuggggaaggaaaaguguugguggaccaaaaauugauaagacuauuguauuuucagaagacgauaagaaugauauggauaucacuaagaguuauacaauagaaauaaaccauagaccuuuauuagagaaacgugauugucauuuggugccauuggcaggaacuucugaaacuauuuuauauacauguaggcaggaugacauggagaucacuagaagucacacaacugccuuagaauguaaaacugucucaccagaugaaauaacuacuaggccuauggacaaaacuguaguguuuguagauaaucauguugaacuagaaaugacagagucccauacuguuuucauugacuaccaagaaaaggaaagaacagacagaccuaacuuugaacuaucccaaaggaaaagccuaggaacaccaacagugauauguacuccuacugaggagaguguuuucuuuccaggaaauggugaaagugaccgucuaguagcaaaugacagccagcuaaccccucuggaggaauggucuaauaauaggggcccuguagagguagcugauaacauggaauugucuaaaucagccacuugcaaaaacaucaaagauguacaaaguccuggauuucugaaugaaccucuaucaagcaaaagucagagaagaaaaagccuuaagcuaaaaaaugacaagaccauuguauuuucagagaaucauaaaaaugauauggauauuacccagaguuguaugguggaaauagauaacgaaagugcccuggaggauaaagaggacuuccauuuggcaggggcuucuaaaacuauuuuguauucaugugggcaggaugacauggagaucacuaggagucacacaacugccuuagaauguaaaacucuccugccaaaugaaauagcuauuaggcccauggacaaaaccguauuguucacagauaauuacagugaucuggaagucaccgauucccauacuguuuucauugacugucaagccacagagaaaauacuugaagaaaacccuaaauuuggaauaggaaaaggaaaaaacuuggguguuuccuuuccuaaggauaauagcuguguucaagaaaucgcugaaaaacaagcacuggcuguaggaaacaaaauaguucuucacaccgagcaaaagcaacaacucuuugcugcuacuaauagaacuacuaaugaaaucaucaaauuucauagugcugcuauggaugaaaaggucauagggaaaguuguagaccaggccuguacauuggaaaaagcgcaaguugaaagcugucaguuaaauaauagagauagaagaaauguggacuuuacaaguagucaugcaacugcuguuuguggauccagugauaauuauuccuguuuaccaaauguuauuuccuguacugauaauuuggaggguagugccaugcucuuaugugauaaagaugaggaaaaagccaauuauugcccagugcaaaaugaucuugcuuaugcaaaugauuuugccagugaauauuacuuggaaucugagggacagccucucucugcuccuuguccuuuguuagagaaggaagaaguuauucaaaccaguaccaaaggacaguuagacuguguuauaacacugcacaaagaucaagaucugauuaaggauccacgaaaucuauuggcuaaucaaacuuuaguauauagucaagaucugggggagaugacuaaacuuaauucaaagcgaguaucuuuuaagcuuccaaaggaucaaaugaaagucuauguugaugacauuuauguuauuccucagccucauuucucaaccgaccaaccuccauuaccuaaaaaaggacagaguaguaucaauaaagaagaaguaauacugucuaaagcuggaaauaagaguuuaaauauuauagaaaauuccucugcacccauaugugaaaacaagcccaaaauacucaauagugaggaaugguuugcugcagccuguaaaaaagaacugaaggaaaauauucaaacaacuaacuauaauacagcucuagauuuccacaguaacucagacguaacuaagcaagucauucaaacucaugucaaugcuggagaagcaccagauccuguaauuacaucuaauguuccauguuuucauaguaucaaaccaaaucugaauaauuugaauggaaaaacuggagaguuuuuagccuuucaaacuguucaucuaccaccccuuccagagcaauuacuugaauuaggaaauaaggcacacaaugauaugcauauagugcaagcuacagaaauacauaauauuaacauaaucuccagcaaugcuaaagauaguagagaugaggaaaauaaaaagucucauaauggagcugaaaccaccucucuaccgccaaagacaguuuuuaaagauaaaguaaggagauguucuuugggaaucuuuuugccuagauugcccaacaagagaaauuguagugucacugguauugaugaccuggaacagauuccagcagacacaacugauauaaaucacuuagaaacucagccggucucuagcaaagauucaggcauuggaucuguugcagguaaacugaaccuaaguccuucucaauauauaaaugaggaaaaucuuccuguauauccugaugagaucaauucuucagacucuauuaacauagaaacugaggaaaaggccuugauugagacauaccaaaaagagauuucaccauaugaaaauaaaaugggaaaaacuugcaauagccaaaaaagaacguggguacaagaagaagaagauauucauaaggagaaaaaaaucagaaaaaaugagauuaaguuuagugauacgacacaagaucgggaggugagcucugucuugaaccaaagaauguucuugaauuuuggguuuuguuuuguuuucuuaaauuguggguauucucaaauuuuaaucuuagucucggguaggcagaaaauaauuauuuccacuuagagggcuggagaaauauucuuauguagaaccuucagaaauuaauugacuaacagcuagacuucaaagcaauuuaaagugacaaauagucacaaaaaaauuaaauggaaaauuguacaaaaaguagccaaaguuaaaauuguauaauuucaaaaauuucaaaagguauguauacugucaccucuagugauuugucaauuuggcuuuauauaagaaucucuagggagguuauauauagcuugaaaagucaucuucaguguuguuauauuuggggaguaaaaagcuuuuuauuuugccaacugcaugaaguaaagcuugacugaauuuccuuggcugacaaggauauguagaaguugagaguccauuuucuuuauuauuuaauuuuauuuuuauuuuauuuuauuuuugagacagagucuuguucuguugcccaggcuggagugcaguugugugaucucagcucacugcaaccucugccuucuggguucaagugauucuccugccucagccuuccgaguagcuaggauugcaggugccuggcaccacacccggcuaauuucuuucuuuuuuuuuuuuuuuguauuuuuaguagagauuggguuuccccauguuggccaggcuggucucgaacuccugaucucaggugauccacccaccuuggccugccaaaguccugauauuacaggagugagccaccacguccagccugcauucuauuuucgauaaauauauagauuaucugcuaugucuuaggcacuguuuuaugugcugggaaugcagagaaaaaucugcugucauggaguuuacauaauauuuauucauuuauuuauuuuugagacagacccucgcucuguugcccaggcuggagugcaguggcgcgaucucggcucacugcaaccuccaucucccugguucaagugauugucgugucucagccucccaaguagaugggaguacgggugcacaccacaaugcccagcuaauuuuuguauuuuuaguagagacgagguuucaccacguuggccaggcuggucucaaacuccuggccucaagugacccacccaccucgaccucccagagugcugggauuacaggcauaagccaccacggcccauaauggcguuuauuuauuuauuuuuguuuuguuuugagauuaagucuugcucuguugcccaggcuggagcacaguggcgugaucucagcucacugcaaccuccgccucccagguucaagcgauucuccugccuuggccuccugaguagcugggauuacaggcaugugccaccacacccggcuaaucuuuguauuuucaguagagucaggguuucacaauguuggccaggcuggucuuaaacuccugaucucaagugauccaccuuccuuagccucccacaauguugggguuacaggcgugagccacagcgcccagcccccuuaauagcauuuacauaaaagaauauauuguuuucagccaggcgcgguagcucaugccuauaaucccagcacuuugggaggccagggcagguugaucacgagaucaggagaucaagaccauccuggcuaacacggugaaacccugucucuacuaaaaauacaaaaaauuagccaggcaugguggcgagcaccuguaguuccagcuacucaggagacugaggcaggagaauggcgugaacccgggagguggagcuugcagugagccgagaucacgccagugcacuccagccugggcaacggagugagacuccgccucaaaaaaaaaaaaaaaaacuuaccaaaagcauguaagaagauagaugaagauggcauuuaaagcugugaagucaaaugguuaaaauaguaaaagcaggaccacauaacuuauucagcuaaagaagucuuggucagcuggggaggaaaguaguaaagccuggaaauaaguuuauugucuggacucuagccagggccaccacauacagccaauauucuagucugguuuucugcagugugguugcccugcuguugguggcuaguaguugaauaauuggauaggugaacauuugauagcuuacaggaucugauuauaacuuagauauauaaugagaaauaauuugcauacacaguauaauccauagaguaauuuucaauaaaauuacuuuuaacucuaauuaaaggcuuaagauguuuguuacuuauucuaauucuucacuaagauauuucauaugaauuauagauuaauuguauguuagaaguaguauuucuguuaguguuugucguaaguauacaguguauauuuuauucugaugauauuccuuaauugacaauuucagauuuuugaucaccauacugaagaggauauagauaaaagugcuaacaguguauugauaaaaaaccugagcaggaccccaucuaguugcagcagcucucuggauucaaucaaggcugaugggaccucucuggacuucagcaguaagagcuucaugaaggcuaaauaauagcagccaucugcuuacuuaacuaauaauaaguaguuuucaguucaggaaauauuugaauguuguauaugccuuuuugggguuauaaaaaguugaucaguaaaauaauauuuaguuuauuuuuaauucuuaguuuguaaugcacugagaagugacauacuacagagaaauagagugauuuccuucaugggcuuauaauuaguggagaaacacuggagccuuaaaacuauaauauacuuugcccugcuacaugacugucuucccagaaagaucccaauggguagcuucaggaucagaaacaaucugaaugauaaccacaauuaaguucacaguuuaguuuugacuuguucgucaccagaauuugcuuuacuucuagcuuaccgcaguagucaaauggaaucacaguuucucagagauacuauuugugaagagagcuugagggagguauguuaaaauucuuuuucuuuuuuuuauuuauaaagaaaagagguuuaaacgucucauuucuaauacacguaauauucuugguuuaaaaaauuuuuuuuaauuacgaaauauuucaaauauacagaagacuacuuuucuuuguuaaagauccaacauaacaauuaauuaaauggaguagaagucaugauuaaaagguauuuguuuuggccgggcauggugguucaugccuguuaucucagcaacauggugccugagggaagagaaucacuugagcccaggaguucaaggcugcagugagccaugaucacacaacuguaccccaggcugggugacagagcaaggucuugucucaaaaaaagagaaaaaaaugauguaucuuuuggguuuugggauuuuuaaaacucuauuuguuauucaauaaccuuaagaaaugaucuuagauaaaaucugcucauguauagccugcagauaucuggauaauauuuccauaaauguauacaagauaccuuaagcuuuuagaaacaaaugaagugguuauaucaaagugaaaucacauugaauggucaugcaaacuuuuuuuucuuuucucagaaacuccaagaugggagaauaacaauaagggaguucuuuauacuucuccagguccacaucuugauacagaaaccccgacagagcaaucucccaggcaauguaagugcaguuucuuggcaaaauguuugcaucaaagcaaacauuuauuuaaaagcacaaaaagaauggaagagagcaaauuuuccuauagagaguuuucuuuuuuuuuuuuuuuugccuuuucuuuuuuuuuuuuuuuuuuuuuuuuuugagauggagucucgcucuguugcccaaacuggaaugcaguggcgccaucucagcucacugcaaccucugccuccuggguucaagugauucucuugucucagccuccugaguagcugggacuacaggcgcgugccaccacacccggcuaauuuuuguauuuuuguagagacaggguuucaccauauuggccaggcuggucuugaacuccugaccucgugacccacuugccucagccucccaaagugcuggguuuacaagcgugagccacugcgcccggccgagaguuuucuuauaguagagagauuugugguuagcauaaacaaaaaccaaaaauuuucacauggauuuuuuuaaucauggauuucgauaagauaaaauuugaauuuucccuucauuccuugccaucuauuuuuuugauacauuuuccugauuacagaacuaacaugggcuuuuuccuccauuauaaaaaucuaaggguagcagagguuuuuaaugaacaguuuucaaaaucaaaaauauguaaacuggauacaguggcaggugccuguaaucacagcuacucaagaggcugagguggaagaaucacuucaacacaggaguuugaggccagccugggcaacauaucaguauccugucucaaaaaauuuaagaucauagaauauuugaauaauacaaucaacgcuuucaauugaaaagauuaauagaaaaacuuauauuccuuacauaggaauguuuuuugucuuaaggcugucagacauuuccaaaaguuaguuauacucuuggccacaaagaaaacauuaauaaauuuuuuaaaauggagguuuuauagagacuacaucaucuaaucuugauccaauacaauuagaacuuauaaaagaaccaaaacauucugagauucuuagaaauuaagaaacacaauaucuuguagaugaagcauccccaaccccugggguuaggaacugggccaaacagcaggaggugaauggugguggagugagcaaagcuucaucuguauuuacagccacuucccauugcuugcauuaccaacugagcucugccuccuuucagaucagcaguggcauuacguucucacagaagcacgaacccuauugugaacugcacacaugaaggaucuagauuguguaccccuuaugagaaucuaaugcaugaugaucugucagugccuccccaccccgagaugggacccucuaguugcaagaaaaucaucuuagggcucccacagauucuauauuaugaugaguuguauaauuauuucauuauauauuacaauguaguaauaauagaaauaaaguucagacugggcaugguggcucacacuuguaaucccagcacuuugggaggcccaggcagacagaucgccugagcuuaggaguucaagaccagucuggccaacauggcugaacccgucucuaaaacaauacaaaaauuagcugggcaugguggcacacaccuguaguccccgcuacucaggaggcugaggugggaggauggcuugagcccaggaagugaagguugcauuaagccaagauugcaccacugcacuccagccuaggcaacagagccggacccugucucaaaaaauaaaaauaaaaauaaauaaaaauaaaauaaaaacaaggaaguucacaauaaaugugcuugaaucauccugagacuauccccucuuccugguccuuggaggaauugucuuccaugaaacuggucccuggugccaaaaagguuggggacugcuguuguagacaacauaguuggguaaaaaaaaaacaggaaacacuucuagauaacuccuagaucaaagaagucgaaaauauuucuuaguaaaggagaauauuuaauggcuagucugugggacauacagcaaaagcuauacuuagcaggaauuaaaagccuuagauaucuuuguugucguggagucuaaaauuaaagaaauuuuuauuuauuuauuuuuuauuuuuagagacgagaucuugcuauguugcccagacuggucuugagcuccugggcuuaagcaguccacccaccuuggccuccuaaagugcuaggauuacaggcaugagccaccgugcccagccaagauauuaauacucauaauauccacaaaaaagauaggaagauagaauuaauauagguaaaaaguagagcuaaugaaauagaaaacaaaaauuguuggagaggauaaauccaggccaggcaugguggcucacaccuguaauuucagcacuuugagagaccaaggcgagaggaaugcuugagcucaggaguuugagaccagccucgggaaaauagggagacccuguuucuacagaaaauuuuaaaauuagccaaguguaguggccugugccuguggucccaacuacucaggaggcugucaugggaggaucucuugagcccagggguucaaggcugcagugagcuaugauuguaccacugcccuccagccuggucaacagaacaagacccuaucucaaaaaaaaaaaaaaaagaauaaauccaaaagcuauacuuugaaaagacaauaaaauaagaaaacuccugaagagucuaauuaagaagaaauaagcagcugcgcacaguggcuggugucuguaauucuagcuaugugggaggcugaggagggaagaucacuugaaaccaagaguucaagaccagccugggcaacauagcgagacccccccccacccacaucuuuuaauuaaauaagugaaugaaaaaagagaaagcuaaaauauagaagauuaagaaagaaaacguacucauagauuaaaagagacuaaaauaauuuuuuguugggugccauggcucacaucuguaaucccaacacuuugggaggcagaggcaggaggauugcuugacccuaggaauuugagaccagaccaggcaacaggugaaauccuguacaaaaugaaauaauuagccaggccugguagcaugugccuguagucccagcuacucgggaggcugaagugggaguaugacuugagcccaacaggcagaacuugcaaggagccaagauuguaccacugcacuccagccuuggagauagagccggacccugucucaaaaaaaaacgaagaaagugaaaaggcaacccacagaaugugagaaaacaguugaaaucauacaucugauaagaagcuuuauccaaaauauauaaagaacucuuacaacucaauaauaaaaauacaauccaauuuaggccuggcuugguagcucaugccuguaaucuuagcacuuugaggggccuagacuagaggauugcuugagcucaggaguuugagaccagccugggcaacauagugagaccccaucucuauuuaaauaaauaaauaaaacauagugagacucugucucuauuuaaauaaauaaauaaaauacgacccaauuuaaaaaugaucaaaggaucugaaaagauauuuuuccaaagaacagucauguacugcguaaggacguuuugguuaacaacggaccacauauacacagggggucccauaggauuuuuauggaggccaggcaucguggcucacaccuauaauuccagugcuuugggaggccaaggcaggugggucauuugaggccaggaguuugagaccagccuggccaacauggugaaaccgcaucucuacaaaaauuacaaaaguuagccaggcaugauggcgcgugccuggagucccagcuacugaaucgcuugaacccaggaggcggaggcugcagugagcugaggucacgccacugcgcuccagccugggcgacagagcgaaacucugucucaaaaaaaaaaaaaaaaaaaauuguaauggagcuggaaaauuccuauugccuagugacauuguaauguagcacaacacauuacucacauguuuguggugaugcuaauguaaacaaaccugcgcugccauuccuguuaaaggguaguacauauaauuauguacaguaacauaauacuugauaaugauaacagaccauuagguugcugucuuauguauuuacuauacuauacucuuuauuguuauuuuauuuuuuugaaccagaaucucacuuugucacccaggccagagugcagugaccuuggcucacugcagcuucaaccuccugugcucaagggauucucuugccucagccucccaaguagcuaggauuauaugcacaagccaccacaccuggcuaauuuuuaaauauuucuuagagauggggucucgguauguugaccaggcuuggucucaaauuccuggccucaagcaauccuauuuugccucucaaagugcugggauugcaggugcaagccaccaugcccagcccuuaucguuauuuuagaguauauuccaacuuauaaauaaaacaaguuaacuguaaaacagccucaggcaaguccuucaggaguuauuccaaaagaaggcauuguuaucauaggagaugauagcuccauggguguuauuauuucucaagaccuuccaguaggacaagaaguggagguggaagacagugauauuaaugaucuugacccuguguaggccuaggcuaauguguguguuuguauuuuagguuuuuguuguuguuguuguuguuuguuuguuuguuuguuuugagauggaguuucucucuuacugcccaggcuggagugcaguggcaugaucuuggcucacugcaaccuccgacucccagguucaagcgauucuucugccucagccucccaaauaccugggauuacaggcacaugccaccacaccuggccaauuuuuguauucuuaguaaagacaggguuucacccuuuuggccaggcuggucucgaacucuugaccucgugacccgcccaccucagccucccaaagugcugggauuacaggcaugagccaccacgccuggugcgugaauauacuuuaaaauucguuuaauuguauacuuaaauggauggauugcauuguguguggauuauaucuccauaaagcuguuuagaaacaaaucaauuacuggagaauuauauauuugaaugugaaagguaaaucaaggauagaaauugggaagaugggcacacaacucuuuugggccucagccucauuaccaugauagcugccaguagaauccucuugccucagcuauagauagggaggagaaaggagcuuaggugugcauccaggggcugauacucuuucuacuuuucuuauaaagggaaaguagaaagaguauuaggagaccaagaccaaacagaggagagcagaggggaaggauaggaacagggaggauauuggcagggugaaggagggagaggaugcuuuaggaauugauccuugacaaauugauguuaugaaucuuccccuuuccucccaggucuugcugaagucaggagggguagugauaggaaaauauaucugggaacaaaccuaucaaaauggaaagaguucaggguacuucgggaaagaaguugaaaaucccaaaauaggaaaaggccaaagagauggauuauauguggaccauggaaaaugagguucguggcugugggcaucuguuucaggauuuuuuuuuuuuuuuugagauggaguuucgcuuugucauccaggcuggagugcaguggcacgaucucggcucacugcaaccuccaccuccuggguucaugccauucuccugccucagccucccgaguagcugggacuacaggcaccugccaccaugcccgacuaauuuuuuguauuuuuuuuuaguagagacaggguuucacuguguuagccaggauggucucgaucuccugaccucgugaucugcccaccucagccucccaaagugcugggauuacaggcuugagccaccaugcccggccuguuucaggauuuguuuuuugagauggaauuucacucuucuugcccaggcuggagugcgguggcaugaucucagcuuaccgcaaccuccgccucccagguucaagcgauucuccugccucagccucccaaguagcuaggauuacaggcauacaccaccacgccuggcuaauuuuguauuuuuaguagaggcaggguuuccccguguuggucaggcuggucucaaacuccugaccucagaugauccgcccgccucagcuucccaaagugcugggauuauagguguaagccaccacacccaccuggggaauguauucuugaggcagggggagagaugugugccagcccucauagacauguacacaccucccauauauacguacaguugcaggaacucaguuggcggcacuagcagaaggugcuauuguagaggcccaugacccccugcaugcucauguagugacucaggccaaagcacuagaacucacaucuccuaguaagggugaggaucuguuuuuguuuuuuguauuuuuuugagacggagucucgcucugucacccaggcuggagugcacuucccggguucaagugauucucccugcuucagccuccccaguagcuggggauugcaggcaccuaccaccaugccuggcuaauuuuuguauuuuuaguagacaugggauuucgccauguugaccaggcuggucucgaacuccugaccucuggugaucugccugccucggccucccaaagugcugggauuacaggcgugagccaccgcacccagcugguugagaaauuauugcaagugcuccugcuaggcuugaaguucucaggugcugauuauguauaaguuggacacuacuuaaucauaguaaguccaggagaggaggguggcuuuacacauggugcugaauucaaggugcagcaauuaaucuacccacugcauacagcauaggcaacugcauucaauaugugcuugcugugcaugagccuaauauucacuggcacuuuucuuccuggcagaucucugggaauguggucuugugcuucacuuuauguguuaugaaaguuuaugaugaaaccuuuuuaaaacaauuuuaguauuauagaaaauuucaaacauaucagaaaauagagaauaguuuuauuaacccccugugugucugucacccaacuucaaaaauuaucaacucuagucuuggugcuauggcucauaccuguaaucccaguacuuugggaggccuaggcaggaggaucacuugaggucaggaguucaagaccagccuggccaacauggugaaacccccccucuaccaaaaaaauacuaaaauuagcugagagugguggugcaugccuguagucccagcuacucgcgaggcugaagugggagaaucacuugaacccgggagauggaggcugcaugagcugacaucgcgccacugcacuccagccugagcaacagagugagagcuugucucaaaauuaucaacucuuguuuuuucucuaccuaacccuccauuuccccucccccgcauuauugugaagcaaauuccaagcaucaucaaucuauaaguauuucaauauguauucccuaaaaaggugaagacucuuauuuuaaaaacauauccaauauaaucauaccauaaaaugguuaauuauucagucaguguuuacauuucccugaucgucuuaugccuuuuuuuuuuccccaguuuguuuucuugggauccaaaugagauucaaacauugccgauuaguugaaaucucucucuagucuuauaaucuauaagguccuuuuccaucucucuuuuucuuuuuucuuucuuuuuuuuuuuuugguauuuaaaaaauuuuuuuaaucuucacuuuuuuucuuuccuuccuuccuuuuaaugaagaaaccagguuuuucuguagaguuuaccacaguccagauguugcuaauugugcaugcccaaauauuucucugcccuuuuuuuuuuuguaaauuaauauaggcuugauuagauuaacagcguuuuuuuuuuuuaaguuuacuuuaccguuguaauuccauuaggaaauagauaaugucuggugaugacguguaugcagccauuaauucauuagagguuguaaagaagugauauacuccagguugagcaucccuaauccaaaaaaccacaaaucugaaaugccuuaaaacccaaaauguuugagugcugacgugacaccacaaauggaaaauuucacaccugaccucauguaauggguugcuguuaaaauguacugugagucaggaaugguggugaugcugaacagccacagauaguccacauggguggccaagguagugauaccuuugcuuuaugaugguucaauauauauaagcuuuguuucaugcagauuauuuaaaauauuauaugaaauuacugucaggcuaugaguauaagauauauaugaaacauaaauuuauuucauguauaaacagguuccauccccaagauaugucauuauguauaugcaaauauuccaaaaaucugaaaaaaaaaauccaaaauacuuagcugggcaugguggcucacaccuguaaucccagcacuuugggaagccaaggcaggcagauugccugagcucaggaguucaagaccagccugggcaacacggugaaacccucucucuacuaaaaauacaaaaaaaaucagccgggccuggcagcauaugccuguagucccagcuacucgggagacugaggcaggagaauugcuugaaccuugaacccaggaggcagagguuacagugagccaagaucacgccacugcacuccagccuggaugacagagugagacucuaucucaaaagaaagaaagagagagagagggagggaggaaaggaagggaagggaggggaggggaagggaggggggagggggagggggaaggaagggaagggaaggauaggauaacauaagcuggguucuaguguugucauuauuuagagauggggucucacuuccucaccaugcccagcuaaaguuuaaaaacuguuuuaaagacaagcucuugcuuuguuucucaggcuggucucaagugauccuccugccucaaccuccugggauuacagcaugagccacugugcccaggucugccauuucuuuuucuuuucuuucuuuuuuuuuugagauggagucuugcucugucaccuagucuggagugcaauggugcgaucucggcucacugcaaccuccgccucccggguucaagugauuuucucgccucagccccccaaguagcugggauuacgggugcccaccaccacgcccggcuaauuuuuguauuuuuuaguagagaugggguuucuccaggugggccaggcuugucuucagcuccugaucucaggugauccgccugccuuggccucccaaaguguugggauuacaggcgugagccaccgcgcuggcugccauuucuuuuuuuucuuucuuucuuuuuuuuuuuugagacgcaguuucgcucuuguugcacaggcuggagugcaauggcacugucucugcucacugcaaccuccgccucccgauuucaagugauucuccugccucagccuccugaguagcugggauuacaggcaugcgccaccacacccggcuaauuuuguauuuuguauuguuggucaggcuggucaccaacucccaaacucaggugauccgccugcccuggccucccaaagugcugggauuacaggcaugagccucugcacccagccugccauuucuuuuuuaaccaguacauauaguuuugauuuuuauguauaauucuagccuuaaaaauccuuuuuuuuuuuuuggcugggugcaguggcucaugcucauaaucccagcacuuugggagaccagaggaagaggaucacuugaucugggaguuugagaccagccugggcaacguagcaaaaccccauaacuaaaaaaaaaaauuuuggccgggcacgauggcucaugucuguaaucccagcacuuugggaagccgaggugggcagaucaccugaggccaggaguucgagaccagccuggccaacauggugaaaccccauaucuacuaaagauacaaaaguagccgggcgugguggcacacaccuguaaucccagcuacuguggaggcugaggcaggagaaucgcuugaagccacgagguggagguugcaaugagcugagaucacgccacuucacuccagccugggcaacaagagcaaaacuucaucucaaaaaaaaaaaaaggaaaaaaaaaauuuuuuuuaauuagccaagcaugguggcucacaugcaccuguagucccagcuaauuggcaggcugagguugggggacugcuugauccugggaggcugaggcugcagugagccgugaucacaccauuacauugcagccuaggugacagcuagaccccaucucaaaaaaaaaaaggcuagucauagcuggagacaguggcucacaucuauaaucccagugcuuugggagguugaggcaggagaaucacuugaggccaggaauucgaaacuauccggggcaacauagcaagaccccaucucuacaaaaaauuuuaaaauuagccaggcguggugacacaucuguaguacuagcuacuggagaggaugaggcaggaagaucgcuugagccuaggaguuggagauucaguuguaggguuuuguuugauuuuuguaaauaaggagcugacuugauuuuuuucuuuucuuuucuuuuuuuucuuuuuuucuuuucuuuuuuuuuuuuuuuugagacggaguccugcucuguugcccaggcuggagugcaguggcgcaaucucggcucacugcagccuacaccuccugggcucaaguaauucuccugcuucagcuucuggaguagcugggacuacaggugugcgccaccaugcccagcuaauuuuugaauuuuuaauagagacaggguuucaccuauuggccaggcuggucucaaacuccugaccucaagugaucugccugccaccucccaaagugcugggauuacaggugugauccacugugcccggcccugacuugauuuuuucaauacugcaucaaggacaucaaagccauuggauuaguucuauaaaacauuuuuaaauaaccaaauuuucacugccuuauuuuauaauuggaggaugugccagaaaaguuugaguucagccugggauagaguaaggauuauggcuagaaaaugggaauaguuacuaggaaacuggcuuaaaaaaaaaaauuaaaaagggguuccugguaaguugaauuuuuagguaauauuuauuuucuuaacgcauagccauuuucaaacuacugucauucccaugugaguaagaacaaccacaguuccaguaaaaucuauggggaaagggacuuagaagucagagacuugaauucagauuccaauuuuuuguuuacuggcauuaugaacuugaguauucaaauuuuucuuuguagaacauuuuaaaauaggcacucugaaauuugaguuaauucuuauauaugguuuugucugcaagauaccaguucucagggacugaauuuuuuuuuccaguuuacuguaaacacaccaccuacuccagaagaccugauguuaagucaauauguuuaccgacccaagauacagauuuauagagaagauugugaggcucgucgccaaaagauugaagaguaugaaagcuuuaauuuuuauguguguuuuuuugaggggagggaucaguuaauaguuugugugguaagguuuugauuagaauaaugcuggcaugggguaaaauugauggcauuaauuggcagugugaugugggagaaagagcuuuggccucguagucagauugaagcucagucuuggcuucaacacuagcuguguaaccuuggguaagucauuuaaccuucauuuccaaauccuuaaagugaggauaauaaaaccuacucagccaauagauaugaacaauagaaauggcguauauaaauuguuuucauaccauucuuaggaaaagguagguccuuaauaagaauaaacaguaauuuuuagauuaugauaucauaaguugauugcuagagaacaccuucaaaagaaaauauccuuuagagauuuacgcaaguugaguaaccuuaaucuggaaaucggaaaucugaaaugcuccaaaauccaaaauguuuuagccaccaacaugaugcaaguggaaaauuccacacauaaauacguaaguacuuuacacaaacuuuguuucaugcacaaaauuguuuaaaauauuguauaaaauuacccucaaacuauguguacaagguauauaugaaacauaaaugaauuucacguuuaggcuuggguuucacccgcaagguaucucuuauauccaaauaguccaaaauccaaaacacuucuggucccaagcauuucagauaagggauacucaaucuauauauagugccugaaaucagauugccuuugaguuuauaauuuuaccacauuuacgcuuguuuacauauauaaaagaacaugguuuuacguagaagauagcucauugcuaugguauacguaaauacugcagacugauuuacaaauuagauacaucuagauucccuuagguaaaucagacuuuaaaacucaaaguaauguuuaugucauacuuaucugggacuauccaacuaaauuugaaccaaucuaacagaaaagaaauaaaauagucuuuaagaauuaucuggguuuuagaaguagaaggaaaagaauauuaaaaauuuuucaaaagaauuauguaguuuuggcugggcgcaguggcucacgccuguaaucccagcacuuugggaggcugaggcagguggaucacgaggucaggagaucgagaccauccuggcuaacacagugaaaccccgucgcuacuaaaaauacgaaaaauuagccgggcgcgguagcaggcacuuguagucccagcuacucgggaggcugaggcgggagaauggcgcgaacccaggagguggagcuugcagugagcugagaucgcaccacugcacuccagcagcuugggccaaagagcgagacucugucucaaaaaaaaaaaaaagaauuacguaguuuuaaaaucagaaauuuaagauauuucagauuuuccugauucuguucauuuaacaaauauuuauugagcaccuacaucugccagguacuauacuaugcacugggguucaucgcugaacaaaacuggcaaauuuuguaucuucauguuguuggaaagaguuggcugugucaggauuucccugagaauguuuguuuguuuguuucuuuguuuauuuuaaugagacagagucucgcucuguugcccaggcuggagugcaguagcgccaucucggcucacugcaagcgcugcauccuggguucaagcgauucucuugccucagccuccuggguagcugggauuacaggugcccaccaacaugccaggcuaauuuuuguauuuuuaguagagaugggguuucaccauguuggccaggcugguccugaacuccugaccucaagugaucuacccaccucggccucccaaagugcugggauuacaggcgugaaccaccacaccagcugagaauguuuauuuugaaugaaacgggaucuuacacucaaugagcgguagguuuaguugugcuuuacuguuugauuuugcaucuguaugccugcauauauccucuacaagagauauucuaucucuguuagaaauuuauuuucuccauuuauuaacaaaagacuaauauauauugagacuaucauaacuuugcugcuuuuauagaugcuauucuaaaaaugugaaauaugccuuugaacugaauuggaaacuuuuauuuuauuuuuuauuuuuauuuuugagacagagccucacucugucacccaggcgcgaucucggcuuacugagaacucugccuccuggguugacgccauucuccugccucaaccucuacuacuacaggcacccgccaccaugccuggcuaauuuuuucuauuuuuaauagagacgagguuucaccguauuagccaggauggucucgaucuccugacccccgugauccaccugccuuagccucccaaaguccugggauuacaggcgugaaccaccgcgccuggccgggaacuuuuauuaaaauaauacauaaaaaaauuagcugggcgugguggcacgcgccuguaguccuagcuacucgggaggcuaaggcaagagaauugcuugaacccagaagguggagauugcagugagccaagauugcgccacugcacuccagccuggcagccuggcaacagggugagacuccgucucaaaaaaauaaaauaauaauagcuacaacuuuauagcagcgaucauugacagaccuuaggauucuuuauaagcgaaauguuucacauuggaacaaguugguacguugagaugagaauucuguuagugauagaaguuuuuuugauguaugacauucuugaacuacuauucuucaagugaauaaucaggcuuuucuugaaugaauuccccucuuauuauguagaaaaaaacuaggaagaguuaaauuaaacaugauuguagaccugagcugguucauucaagcuggcuucugaacccuacgcuugaagagguggccugccccuccacacuuguggguauuucuagucggaugggacgagagacugagaaaagaaauaagacacagagacaaaguauagagaaacaacagugggcccaggggaccggcucucagcauaccaaggaccugcacuggcaccggucucugaguucccucaguuuuuauugauuauuaucuucauuauuucagcaagaaggaauguaguaggagagcagggugauaauaaggacaaaaacauguaagcaauagaaucuacgucauaguuaaguuuaagagaagguauggugacuggauguacaccuaagccagauuuauguuucucuccacucaaacaucucaguggaguaaagaauaacaaggcagcauugcugcaaacaugucucgccucccaccauagggcgguuuuucuccuaucucagaaucgaacaaauguacaaucgaguuuuauacaaagacauucaguucccaugggcaggcaggagacaguggccuuccucuaucucaacugcaagaggcuuucgucuuuuacuaauccaccucagcacagaccauuuacgggugucgggcugggggacagucaggucuuucucaucccacgaggccauauuucagacuaucacauggggagaaaccuuggacaauaccccgcuuucaagggcagaggucccugcggcuuuccgcagugcauugugccccugguuuauugagacuagagaauagcgaugacuuuuaccaaguauacugcuuguaaacauuuugucaacaaggcacguccugcacagcccuagaucccuuaaacuuugauuucauacaacacauguuuuugugagcuucagguugggucaaaguggcuggggcaaagugguuggggcaaagcuacaaauuaacaacaucucagcaaaacaguuguucaaaguacaggucuuuuuccaaauggagucucuuacgucuuuccuuucuacauagacacaguaacagucugaucucuuucuuuucccuacagugcuaauuaacuuuuccguauuuuagauuaaagcuuucugcaucgaaccaagauaagcuguugguugauauaaauaagaaccugugggaaaaaaugagacacugcucugacaaagagguacuuuugucucauuuucugaaugagaaucagugaagacauucugaacgauguuuauugugaaaugaguaacuguuacuuggucauagugaugaguuauuuaacuuauuuuuuaaguguaaugugguaccaaggucuuauuuaauuacacacaauuguuaauauauaaucuuuucaaaccugagaugaucaauuuaauauaugaaauauaguugaaguuuauuuagaguucccuccuugcuauuugccuuucacuuagauuuagacgaagaaaagauuuacuuuaauugauuaaauagcaagcaacccauuuuauaugugcccuaauauauuaaaaaguuucauuaacuaagagccugucauuuucuaauuuauaauaugaauaagugaauuaaaggcaggaaucaaaacugaaaucuuuuuucuggucuuagacaauuacauggaauuaaauuugcaaaugacaaauauccugccuuaggauaggcaaagccuagccuuccuagaccauuuaccucuucugacucguuuguuuuaguacaguguucucuauaacuuucccuuccagcugaaggccuuuggaauuuaucuuaacaaaauaaagucauguuuuaccaagaugacuaaagucuucacucaccaaggaaaaguggcucuguauggcaagcuggugcagucagcucagguaauuugagacaguuaauaucauagaaagagagagauauuaaaauuacuuucuaaugguuauagaauaugaagaaucuuccuuagaagacaugugaauaagacuugggcaaaaacuuaacaauuaagagguaagguucaauuugucaaaaguggcaaauccugacaucuugaguaauacuggaauauaauuacuaaugugggccuaugucucaucucaaauacuauuauccaucauacauacugaaauaaaauacauaggauucuggucucccauugcuaaggacuauaccauaguauuaucuucuucauaguccauacuaagcuguauauguaugcacauguguuuaaaguagcauuucccaaaaugauuagcuuuuuuaaaaggcucugcauaaaaaaacuuuccauuggcaaguaaguaugggaaauguugcaagcaauaugcccuuucagagaaacauaauuuuuuaaagucuaagcauaaaugcuguaauucuuuuugaccacuguuuccuauguuuaguuuaucauagaaauguuuuuaaguaauaaauauuaauauauuguauuccauggaacaccuauagaaaugcuaaaauaaaguaccagaauuaguuuuaugucaauaugcuuuuuaaauuauuucauuuucuuuuaauaaaauauuuuauuaaauuuauaaaauaaacauuuuauuuuccagaguucuuuuggcuaaaacuuauuuuaauaaaauuuacuuuuauuuuuuaaguuccaaccuaaagcuuugaccuucauuuuaagauuugccuguuuguaggcugggugcgguggcucacgccuguaaucccagcacuuugggaggccaaggcgggcggaucacgaggucgggagaucgagaccauccuggcuaacacggugaaaccccaucucuacuaaaaauacaaaaaauuagccaggcaugguggcaggcaccuguagucccagcuaaucaggaggcugaggcaggagaauggcaugaacccgggaggcggagcuugcaaugagcccagauggcgccacugcacuccagccuggguaacagaaugagacuccgccucaaaaaaaaaaaaaaaaaaaaaagauuugccuguuugugaucaugauagagcgauuaugugagcaguuugaaccauuuauaauauuuucuuuagagguuuaacuugacagucuauaaucuuuuguauuuagaaugagagggagaaacuucaaauaaagauagaugagauggauaaaauacuuaagaagaucgauaacugccucacugagauggaaacagguaaaguauuuuaaauacuuuuccaaaagaaaauuuaauuuuaucuaaaugcucuccuacaguagagaauguugguaccacgauauugaagacuuguauuagcaacuugagauauuaaauuagaguaaauuggcucacgccuguaaucccagcacuuugggaggccaagccgggcggaucaccugaggucaggaguuugagaccagccuggccaacauggugaaaccccaucucuacuaaaaauuuuaaaauuagcugggcguggugacgggcgccuguacuccagcuacucgggaggcugaggcaggagaauaguuugaacccaggaugugcagguugcagugagccaagauugcgccacugcacuccagccuggguggcagagcgagacuccaucucaaaaaaaauaauaauaaaauaaauaaauaaauaaauuagagcaaauuaaaguuccuuuacuauagucauccauaauacaaucaagagcugcucaagauaacccagacuguaauuuuguguuuuuuaauagaugaauuuaucucaguuugaaaaccgucuauccuuucaguuuggucuuucauaaucccaacuuuuuagaguuacucuccugaaacuccuuucucaaagaucacauaauucugcauagucaucaaauuuuguucuucucaguccuuagccauuuugaccucuuucagcauuugacacugaugacuguucuuuucuuccugaaauguucaucucccuuaaucucugugauaaugcacuaucuugacccaguuguuuucuccuggcugcucaauccagcuucucuguuggccucucuuucucuaacugaucccuuguggggauuuagauuuuaucaucuguucuuuucuauauucucuccccuagugcuuucgugugccuuaauaauuaugugacugauucccaaauuuaaauuccucaagcauuuuuugagcauauacugcaugccagauacugugcuuaguaucagaaaauaaauaaaaauauuuaagacacagauuuugcccuaaagguagcuuauaaucauuucaggugagggcaucuuuagccucucuuucuugaauucuagacucaauuucuagcuuccuucugaaccuguaugcaaaaaauauccuuaaacaccuuaaacugugaauacagccugggcaacagagugaggcacuaucucuacaaaaaacaagagauuagcucagcgugauggcacauaccuguaguccuagcuacuugggaggcugaggcaggaagaucucuugagcccaggaggucaagacuacagugaggcaagaucacaccacugcacuccagccugugcaacagagcaaacuaaauaaauaaauuuaaauauauucuccgagcucaaaaauaaaauucaaaaacuuguucucucuuaugauguuucucaucuuuauguauagcagucacaauucuuauacauuguaaaagcucaauacuuucauugucuuugaggcucucuuaacaaguccugucaucggcagcuucagcaucucauguguuuauuuuccuuuccuauuaaggcucaccuuaauucugaacugugcuauuucagucuucuaacuaaucuuuauacauucuuaccauuauuccaccuucuuccauuccaaccugcacauugcugccagauuaauaauuaugaaagacaguuuucauuaauguuacuccucugaaaaacuucugucuuuccauuuauuauaaaguccaaacuuaacuuucuuuuuuuuuuuuuuuuuugagaugguauuucacugucguuacccaggcuggagucaauggcacaaucucugcucacugcaaccuccgccucccagauucaagcgauuuuccugccugagcuucccgaguagcugggauuacaggcaugcaccaccaggcccugcuaauuuuuuuuuuuuuguauuuuuaguagagacgggguuucuccauguuggucaggcugaucucgaacucccgaccucaggugauccgcccgccucggccucccaaagugcugggauuacgggugugagccacugcgccuggcccaaacuuaacuuucucugugguuggcuuaaagaaaaaaaaaaaguccaaacuucugagcuugacauuucauaucuucuacaguuguuuucagauuuacaugauuuguuacuacucccauacaccucuuaaauucuaaccaaacauugcuauuuuuaugcaguucugccacuuuuuugagacagaaucucucucugucacccaggcuggagugcaguggcaugaucucugcucacugcaaccucugccuccuggauucaagcaauucuugugccucagccucccaaguagcugggauuacaggcaugcaccaccacccccagcuaauuuuuguauuuuuaguagagaugguguuucaccaucuuggccaggcuggucucaacuccuggccucaagugaucugcccaucucagccucccaaagugcuaggauuacaggcaucagccacuacgccugccuuuuucuuuuauuuaaaaaaaaaaaaagagaggcagagucucacucuguugcccaggcuggggugcaguggcaugaucauagcucacugcagcuucaaacuccugggcucaaggaauccuccuuccucagccuccugaguaguugggacuauaggcacaugccacuagccugaucauuucuacuuuggucuuugcuacuacauacuacguucucuuucuguuuuucaccaaagaaaguagucucuuuuccuugagcucucauggcucuuuuguuaguacuucuuauauuacccaucacaucuacuuguauuauaguuauuuuguauaguuuaucuuccugauuaaauuauaagcucuguggaggcaggaaucagcucuucuuuuucuccaucuccuucagagucccuaggacuauauuucauacagaguaagugccuaguacauguuuuuugcacugaauugaccaugaguacaugaauuccauagucuaaaguucaccccuuuguugacuaccuuacuuucucuuucacagaaaaaaaaaaaaaaauagaaaccaucagacuagaacuucugaacuuccuacuaccaaagaaacaaucugucguuuaauaaauuguuuuugauugaauuauucuuuuuuuccuuacuuuguuuucuuuuuuuacuauuuuucacugaauuauucuaacaaauacugucuacuuuagaaacuaagaauuuggaggaugaagagaaaaacaauccuguggaagaaugggauucugaaaugagagcugcagaaaaagguaauugaauuaguuaaggagauaaaugggugugggggaagcccuucuguucugaguuuguuuauauacuuuggugagauuaagucagaauuuucaauaaaacagauuuuuguggcaacauucuaauauguuuguucuguuuuuuuuuuuuuucuguuuccaaagaauuggaacagcugaaaacugaagaagaggagcuucaaaggucagccuucaauccaaguguuagaaaauauaaugcuaaaucacagaaggcuagaugacuuccugccuccagagacugacaggauuuggggacaugagucuugauugaggcugacucagggcuucuccacuuugaauggaaaccuagaguccaucuuagucaacaguaguuuugaagcacuuauuguuuacagggcauuuauccacaacaguguuucucaagcuugaauacuaccaguauccuuuuuguuuaauaaauguaaauauaaacaaguauaaaaugaaguauauauuucuuaggccuaugaaucuuauucaacuguaaguguaaaagaaaguaaauagaaauaaugacaaagccacuaaaauucuaguugacaacauuaauuugacaggugauaguguuuggcugaaauuaaauugaugcuagcaaaaugauuaacaaagauauguucuguuuagcucuaacaacuaaacgaaaccaaauacaggcaaaaaaaaaaaaacugugacaugucucaguuuuaaaguauaucuuaugaucuacauuaugcuuauauuuuuauauuuuugcuuuuuaucaaaaauaaaaauguaguauuuaaaaguuaucuuaacaugugaaucccaaggauaucuucauggauccuaauuugaaaaacaaugauuuaugccuuucccagguagacccacuucuagauuaaugcuuauauaaaaaaaaaaaaaaaaacuaaacuaagaaugcagaaauggaugccauacaccuaacauuauuaccucaauggggagucauguagcaugugacuucuuaucauaaaccuuuuauauugauagagugaauucucuaacaaaaaccuuaucucucugaauaccugcuuuuauuugcagaaaucucuuagaacuggagguacaaaaagagcagacccuugcucaaauagacuuuaugcaaaaacaaagaaauagaacugaagagcuacuggaucaguugagguaaggaaaugcaggcaucauuuguuuguguuuuauucuguaccuugugguuguuuaaaccgauuggagcaauugauguauuuuuaauguguugcuguuuuuaaccuauacagugcuguuucaaaaagagucaguguacucaacaguaagcuggaaauagaguagaagaacuauggaauuauaauuuuuccauauuuuauacuuuucauugcguagacuugguguuucucugauauacaacucaagauuggguucuuaguuauuucaaaagcuuaaguuuguacauccacaauauaugaauugaaauauuuucucccaguccaguggaaaaacauuagcagcugcuguugguacuguuugggugguaucagaaguucucuuuuauguuaauuuuaaaaacgcuuuuuaaaaaucuuguuuaucucucuacagcuugucugagugggaugucguugaguggagugaugaucaagcuguauucaccuuuguuuaugacacgauacaacucaccaucaccuuugaagagucaguugguaaggagccaaagugagauaauucuuuuacagaaaaaugaauggcuacacucacuaaagauucaaaucuuuauuuuacuauacugauaacuauuggcaugaugagagcacugcugaaagucuuagaacagucacuuuauugauagcagaauuuuauuuuauuuuguaaagaauaaaauaaaaauggaauuagugaacguugcccuuuguugaauuacauuaaauaaaaauuuugcucugcaaauaauggauaaacaugcuacucaugucuauuuacuaugaguuucuuucuuuucaucuccaucuuucgugauagagaauagagaauuuacccuaauggcuggagauucuuuuuuuuuuuuuuuuucuuuuuuuacuuaagagugaggcccugcagcucacgccuguacucccaacacuuugggaggcugaggugggcggaucaucugaggucaggaguucgaaaccggccuggcccacauggugagaccccaucucuacuaaaacuacaaaaaaugagcugggcaugcaccuguaauccuaguuacucgggaggcugagacaggagaaucauucgaacccaggagguggagguugcagugagccaagaucgugccacugcacuccagccugggcaacagagcaaaacugucucaaaaaaaaaaaaaaaaaagaaugaggcccuaacaaguuaauuggaaguucuguguguauagguggguuuaucaucuaaaaggauaaaaucacuauauaggguggaaaucacuauaugguaacuggacagaggcccagcuguuuuguuggaguuuacuaguugucagugucuuuuagguauuuucucuuuaaccagucagcgucaacauggccaaccaugggcaaacauggccguauuggaacguaggaucuucacaaucucugggccucuaaaccugauucuccuugaaaguuucuuuucucaaugaauagcguuaccuucuguccagguccaaaauuaaaacuuaggaaucacucuauaccucuuucucccucgcuguacauauucaaaucaucaguaagacaugcuuuuuguuuuuauuuauuuauuuuuauuuauuuauuuuuuugagacagucucacucuuccacccaggcugaagugcaguagugcaaucucugcucacugcaaccucugccuccuggguucaagugauucuccugccucagccuuccaaguagcugggauuacaggcaugcgccaccacacccggcuaauuuuuuuauauuuuguggggaugggguuucaccauauguguuguccaggcuggucucaacuccuggccucaagcgauuugcccaccuuggccucccaaagugcuggauuacaggcaugaaccacagcgcccaaccuacugguuuuaauuucuuaauauucauccacuguuuuucaucuguucugucaauaaucaucucuaaccuagaugacuacaguaacauuccaacuggacuuuauggaucuucuccuccuccucccugaagcuauagugauuacugaaaaucugacuaugcaccuauuacucuuaggcuaaugaucaaaguauuugaucuagccuaugaagcguugccugaauugaauuuuucuccuuuuccuaucucauacuaccuuccuaccucugcacguuggccacaguggacuucuuuuauuuccuuaaaugaucaugguguuuccugcucagccauauucauccuaucucaacaccuucaugcugauguuucuuaugcccgaacgcuguuuucccccacuucacuaaugaacuccuacuaauaauuguaagagcucagcucucagugaucaguuucucacccuucuguuguauguucuugcuuucugugguuuuccuuaauagugcuuaucauaguuuguaguucuugcuguguuuauuagugcaguugugugucucccugaguuguaagcuugagggcacagguugaguaugcuguuuuucucaugguauccacagugccuaacacauagaaaauauguaacaaagcauucaauaaagagaaaauaaucaauucaggagacaguuaacucuagagucugggggagcgagcagcuaucucagcuaccuaaaauguauuauagcaaugcuaaaagcauaacucauuuuuacuguauuuauacaaugauaggaguuguagagagaugauagccauuuuccuuauaugauugcugaaaauaaaauuaucuuugcacagaaguuagggguuaaaagaggaggccuuaacaaauauagcuguguacuaccuuuuaaauguccuucaaagacauaccaaucaauguaguugaacagucucaggggagccuuuacuagauacagagaauaaugauucaaggauaacccuucaacuuccuguggaaaaaacucugcuacacagaaggaguaggauucuaaaguacugaguuuuaugugacuucaaaucagguaguuuaaaaaaaaaaaaaaggccaggcacgguggcucaugccuguaaucccagcacuuugggaagcugagguaggcggaucacgaggucaggagaucgagaccauccuggcuaacauggugaaaccccgugucuacuaaaaguacaaaaaauuagccaggugugguggcgggcgccuguagucccagcuacucaggaggcugaggcaggagaaucgcuugaaccugggaggcugagcuugcagugggccaagacugcgccauugcacuccagccugggagacaaagugagacucucugucuaaaaaaauuuuuaaaaaucauuauucugguucuuucuaguugguuucccuuuccuggacaagcguuauaggaagauuguugaugucaauuuucaaucucuguuagaugguaaguagaaaacauuuaagccucuaaaaauuuguuggggcugggcacuauggcucaugccuuuaaucccagcacuuugggaggcugaggcggguggaucaccaggggucaggaguuugagaccagccugacuaacauggugaaaccccgucucugcuaaaaauacaaaaacuagccgggugugauggugcccuccuguagcccuagcuacucaggaggcugagacaggagaaucacuugaaccugggagguggagguuguggugagccaagauuaugccacugcaguccagccuggcaacagagugagaccuugucucaaaaauaaaaaauaaggcugggcacgguggcucaugcuuguaaucccagcacuuugggaggccgaggaaggcagaucacaaggucagaggcucgagaccagccuggccaacaugaugaaacccaucucuacuaaaaauacagaaauuaguugggcgcggugaugggugccuguaaucccagcuacucaggagucugaggcaggagaaucgcuugaaccugggagacggagguugcagugagccgagauugcgccacugcacuucaagcugggugacagagcaaggcuccaucucaaaaaaaaaaaaaaaaaaaaagauuuaaaaaaaauuauuacaugccgggcaugguggcucacgccuguaaucccagcacucugggaggccuaggcggacggauuacaaggucaggagaucgagacuauccuggcuaacacggugaaaccccgucucuacuaaaaaauacaaaaaaauuagccgggcgugguggcuggcgccuguagucccagcuacuugggaggcugaggcaggagaauggcgugaacccgggaggcggagcuugcagugagccgagaucgcgccacugcauuccagccugggcgacaaaaugagacuccgucucaaaaaaaaaaaaaaaaauuauuacugggucuugagcaaugauuaauaguagcuauuuucauaauuuaaaaauuacuguuaugagcacuuagucuguaucaggcauguguauuacuuaaauuaacacuaugaaguccaugcgauuuguuccccauuuuacaaauuaggaaacuacagaucaaaaaacuuaaguauugugucuaggaucacuuagguauuaaagaaagccaggauugcugggugccguggcucacaccuguaaucccagcacuuugggagaccaaggcgggcggaucacuggaggucaggaguucaagaccagccuggccaacauagugaaacccugucucuacuaaaaauacgaagaaauuagcugggcauuguggugugugccuguagucccagcuacucgggaggcugaggcaggagaauugccugaauccgggaggcggagguugcagugagcugagaucaugccacugcacuccagccugggcaauagagugacacuccgucucaaaaaaagaaaugaaauccaggauuuaaacucaggucuguguuacauguaaacccacacucuuacucaaguacuguuucuauaugugauaaagucuugaguuuuuguagaaauguccuaucuucaccauacauguuauaaucauguuugaaaauaaaaauggagagaauacaucugggcaugguggcucaugccuguaaucccagcacuuugggaggccaaggcggguggauuaccugacaucaggaguucaagagcagucuguccaaaauggugaagcccccucucuacuaaaaauacaaaaaguagccggguaugguggcagacgccuguaaucccagcuacucaggaggcugaggcaggagaauugcuugaacugggaaggcagagguugcagugagccaagaucacgccaugguacuccagccugggugacagagggagacaggagacuccagaaaaaaaaagaaaaagaaaaaauggagagaauacuuauguaccugguaguuugagaauauuucuagcuuauauaauauaguauuuuucacuuauauaaaauauaugaaucauaaguaauaaccugcuuuugcuuuuuuuuuuccuuccccagaggaucaagcuccuccuuccucccuuuuaguucauaagcuuauuuuccaguacguugaagaaaaggaauccuggaagaagacauguacaacccagcaucaguuacccaagguaaagcccgauugaaguauuuaaaggaaaauuugugauaucuuuccaaaaaaagcagaacugaaacuuuacauaaauaauaguggauccugaaaugauaaauguauucaauuguuuaacuuuuuugaguucuuuguaagugagccacuaagcauugaaauguuuucauaauuucacuggauuuuuuuucccacuuuuucuagaugcuugaagaauucucacugguagugcaccauugcagacuccuuggagaggagauugaguauuuaaagagauggggaccaaauuauaaccuaaugaacauagauauuaauaauaaugaguaaguguauuaguucccaaggacugccaugacagaguacuacaaauuggguaccuuaacagguucuggaggcuggaggucugagauuaagguguaagcggguguuauucuuucugagggcuguuagaaucuguccaugccuucucccagugucuggugguuugcuggcaaucuuuggcauuccuuggcuuguaaaugcauaaccuugaucucucccuucauguugacauggugucuuucauugugcaugucugcauccacauuuccccuuuuuauaaggacacuagucauaguggauuaggggcccaccuuacucuaguaggacuucaucuuaacauauuacuuguguagugaccagauuuccaaauaaggucacuuucugagguauuggggguuuggaauucaacauaugaauuuugggaaauacaggucaacccaacaguaaguacuuggucagcaguuuauuaaaugaauauauauauauaguaaguucuuggucaaguuggucaacaacuugggugcaguggcucacuccuguaaucccagcacuuugggaggccgaggugggcgaaucacaaggucaggacuucaagaccagccuggccaauauggugaaaccccgucucuacuaaaaauacaaaaauuagacaggcaugguggugggcgccuguagucccagcuacucaggaggcugagguaggagaaucacuugaacccaggaggcggagguugcagugagcugagauuuugccacugcccuccagccugggcacaaagagacuccauauccucacaccuguaaucccagcacuuugggaggcugaggcagguggaucacgaggucaggaguucaagaccagccuaggcaagauggugaaacccugucucuacuaaaaauacaaaaaauuagccgggcacgguggcaggugccuguaaucccagcugcuugggaggcugaggcaggagaaccgcuugaacuuggaggauggagguugcagugagccgagaucacgccacugcacucagccugggugacagagugagacuccaucucaaaaaaaaaaaaaaaaaaagagagaaucugucucaaaaaaaaaaaaaaaaaagaaagaaagaaaagaaauaauauauaccuaaguuggacaugccagugugaaaagaaaaugaaauugggcugggacgguggcucacaugagccuguaaucccaacacuuugggaagugaggcagguggaucacuugaggucaggaguucaagaucaauguggccaacaaggugaaaccccaucucuacugaaaauacaaaaauuagcugggccugguggcacacaccuguagucccagcuaaucaggaggcugaggcaggagaaucgcuugaaccuggaagguggagguugcagugagccgagauuacuccacugcacuccagccugggugacagagcgagacuccaucucaaaaaaaaaaaaagaaaaagaaaagaaauaauguaugccuaacuuggacaugccagcguaaaaauaaaaugaaauugugcugggacaguggcucacuccuguaaucccaacacuuuggguggugaggcaggcggaucaccugaggucaggaguuugaggccacauuggcgaaacccugucucuacuaaaaauacaaaauuuagcuggaugugguggcaggcaccuguaaucccagcuacuugggagaaucgauagaacuugggagguggagguugcagugagccgaaauugugcacugcacuccagccugggcgauagagcaagacuccgucucaaaaaaaaaaaaaaagaaauuguguuucaugcuauuauuuguugcauuuuuaauuguggaucuugucuuuuacagauugagacuuuuauucucuagcuccgcagcauuugcaaaguuugaaauaacuuuguuucucucagccuauuauccaucuguaccauuaccuuccaccauucagaaucacguugggaacacuaggugaguaaagggccaacaggguaagacucugggcuacuucuuuuuuuuugagauggagucuggcucuguugcccaggcuggaguguaguggcgcaaucucggcucacugcaaccucugccucccggguucacgccauucuccugccucagccuccugaguagcugggacuacaggcgccugccaccgcacccggcuaauuuuuuguauuuuuaguagagacgggguuucaccauggucucgaucuccugaccucgugguccgcccaccucggccucccaaagugcuggaauuacaggcuugagccaccgcgcccagcaaggacuacuuuuuaauguucauuuuauuugaaagauuccucaaaguggucagcaaauuaguggaccauagugagagcuaaacuucaguucucuugaguucauuuugaagaauuuauguguguguguguguguguguguguguguguguuugagauggagucucacucugucaccaggcuggagugcaguggcacgaucucggcucacugcaaccucugccuccuggguucaagugauucuccagcgucagccuccugaguaacugggacuuaaaggcaagcgccaccacaccuagcuaauuuuugcauuuuuaguagagaugggguuucaccauguuggccuagguggucuugaucucuugaccucgugaucugcccaccucagccuuccaaagugcuggggauuacaggcgaagaauuuuuucuuaaaguuauugaccuucauugcuaucuccaguggaugcuggagaccacuggucuauucuuuuguaccugcuucacuuuuugaauacuccaaccuaaaacaugaaucaagaaggaaaaaacucaccauuagcuuaguacagaugauauguaaacaacuuuuauggccuuaaaaacagagucagccgggcacaguugcucacaccuguaaucccagcacucugggaggccgagguagguggaucacgaggucaggaguucaagaccagccuggccaaguuggugaaaccccgccucuacuaaaaauacaaaaaauuagccaggcguggcggugggcgccuguaaucccagcuacuggggaggcugaggcagagaauugcuugaacccaggagguggagguugcagugagccgagauugcaccacugcacuccagacugggagacaaagcgaaacuccgucucaaaaaaaaaaaaaaaaaaaaagugcaggauacgauggcucacgccuuuaagcccagcacuuugggaggcugaggugggcggaucacuugagcuugggaguaugagaauagccuggccaacauggcgaauccccaccucuacuaaacauacauaaauuagcugggugugguggugaguagucccagcuaaucuugaggcugaggugggaggauugcuugagccugggagguggagauuguggugagccaggaucaugccacuggccuccagccugggugacagaaccaggcucucucaaaacaaaacagagucuguggaaccagcccuaaaaauguuucauuccuccuagacugugacguauuuugugacuuuuuagaugcacugcugacagauuggaagauaacagaguuaaaaaugugcucaccuaggccgggcaugguggcucaugccuguaaucccagcacuuugggaggccaaggugggcagaucacuugaggccaugaguuugacaccagccuggccaacaugacaaaacucuuuguuuuugacugggcgugguggcucaugccuguaaucccagcacuuuuggaggccgagguggguggaucaugaggucaggaguucaagaccauccuggccaacaugaugaaaccccaucucuacuaaaaauacaaaaaaauagccaggcgugguggcaggugccuguaaucccagcuacucgggaggccgagguaggagaauugcuugcacccaggagaaagagguugccgugagccuagauugugccacuaacugcacuccaaccugggcaacagagcaagacucuggggguggggaaaaauuugcucaccuuauauuugucagcaaacaccaagacuaagauuuuuuaugaccaacaaaaguagcuagguuaagauacuucacaauuacauauagaauugguucuuaggcccuguuuuggaaucccauuucaaacuggauaucugguuauuuccagaaaugcucauuugugcuuccuaggaaacugagagaccaagaacauaaauuccacugaauuagagacaaguguaagauuuuuuaaaaaauugauuaaccuggcugggcgcgguggcucacgccuguaaucccagcacuuugggaggccgagguggguggaucacaaggccaggagaucgagaccauccugaguaacacagugaaaccccaucucuacuaaaaauacaaaaauuagccgggcgugguggcaggcgccuguagucccagcuacucgggaggcugaggcaggagaauggcaugaacccgggagguggagcuugcagugagcggauugcgccacugcacuccagccugggcgacagagcgagacuccgucgcaaaaaagaaaauugauuaaccuuuguucuuuccagccaagaugauauugcuaccauucuaucuaaagugccacuggagaacaacuaccugaagaauguagucaagcaaauuuaccaagaucuguuucaggacugccauuucuaccacuagacccuuggaccaccauuggaacaaccaagcagaauguacuugauauuauuucagggucccauugcuguucagccuuuguuuuuacgucauuacaagcugaguaaaauuccuucugaugauguuauaguuaaucuguauguuuuuuauaucucugcagaaugauggugaugaagucuggaugguaggccucauagccuacuaucaacuuacucaucuuuguaccaaagguuuaaguaauaggacacuuaggaaaaaugucuccuaacuaaacuagugcuuucugcuuuaguacaagcccuaaggauuaacuuaaguauaagaaguguuaucacugacaagaacauuagccauuuucccauaacuagauagagcuaugauuuuuuagguugccuggcuucugccuagcagauauuucuggaguagaaauguaucugucuacaaacuauuauccuuuuucuccguuacuaaaaugcuauuaagagaaaguagggcugg

SEQ ID NO: 191221 - RNA, 50647 nt, Homo sapiens
accaccccuggguucccucccggguccgcaguggaaacacugcccucucccuucuugaccccuagcccuuccuucccucccuccuucccuccugucgccgucucuucuggcgccgcugcucccggaggagcucccggcacggcgauggguucucgggccuccacguuacugcgggacgaagagcucgaggagaucaagaaggagaccggcugugaguucggguugggggugggaacgccgggcgccucaggcuggccucacaaccaagggcggcugucgcuaaggucuggagcucgggugccugugagguugggggguccugggcagccuccagguuuggggaccgagagcuggaagaccuguucuuccagcugcagcuuccuggagcggggcucuagcuacuguggggcuguccuucccuucaaaaucgggacucuugaucacucguagagcgucgacgccccccuuuucugcacccugcccaucaaaguccccgaacuccuuuccuuucuguugccucgcaccacccuucccuaugaagaggcauccugaacaguagguaaagcccgagaagcaaauucaggaacucgagauggauucuguagaaaauccguuucuggguaaggaccuaaaaccucugacaacuaugggaaauuacaaacaaguucuugucacaaauugggaaaaccacccagaaagcaagaccguguaguaaggcuuugggagacaugacccgaugccuggagaccuuuaaacaaucaggggucugggauugugagacuucuuucaaucugaacuucuagagaaaaaacacggauacugugaccaccaguuuuuuacuuacacgacgauacuugcuguccuaaucucauauauguauugauuucuacuaugcugguguacuuuuuuauucgcuauugaaauuggaugugcuccaaaaaucuccgugugaauuuguacuaggaacugauuuuuuuuuuuuuuuuuuuugaaacggagucucccucugucaaccaggcuggagugcaguggcgugaucucggcacacugcaacuuccgccucccagguucaagcaguucuccugccucagccucccagguagcugggaguacaggugccugccaccacgcuuggcuaauuuuuguauuuuugguagagaugggguuucacuauguuggcccggcuggccucgaacuccugaccucaagugauccacccaccucggccucccaaagugcugggauuacaggugugagccaccgugcccugcagaacugauuuuuuuuuuuauaguccagucucuuccucauuagucugaacaaaggagcaaaaggacucgggauucugaagcgcuguaaaauaccaucauaacuuugaauaguccuugauaaugcaauguaugauacaauuguauugaugcauacaauauuuuaucuuuucaguaaaccuuuaugauucuuauugaguuaaugaaggauguagcaccugagcucugucucuucaucauacuugucuuugauaaugacaugaccaguaacucacuccggcccauaugcagauaguacugaggagugcuauggggaacuacagaauuuuucaggccuguuuaagugcuguucucugcuuugugacaaguucaacuuucuggaguuuucaaguuggaagggauguuuucuagccccaccccuuucuggacugguuugcuucuuucagccuccccuaaaauauggcccuuaagccucucuguaaagacauuuaaugaugguaaccucuccaccuaccaaggcaguccuuuucacgauuugaaugacccaaaguaguuagcucuuuauaauuugcaguacuuguuuggccacugacuuacucugacccucggaguggagacgcaagcaguuuggauucaacaagcauuuuauuacguuuuguggccauaacuucuggccacauuuguaauuaguacuacuuuaggucuagggugacaccgaauuaaaguauuuguguuaaagagucacauggagaaauaagcagaaucaaagagaaauaaauauagagucacauaaugagaaaguguaaaccauagugaagaugcaaaaagccauuuuugcuucagaaugaagggagcaguaaucccauucugguuuauauacauuugaccaaauggaaaugaccuggaugggauauuuuuaccauguggcuuguggacaaacaacuaagugcucauggaaaagcuguuuuccccauugccaaagagugagucacuugugagggagauucucuccacaaccagugcaaauguauguauugagccagaaugcuuagugaaacaagugcuuacugaauuuuuacagugucuguucaguacugugcuagguacucagagcagauggugacaaaaaacgcccccaaccugguuggggagauaagcccaagagaguuaugauuagcaucaugacauaagaaagcugagaauugugugucauccaccuucagaaaucaggcaagagagagaguccuugugggcuguccucauggaggacaggaauugggccuugauacauggguggaguagauuuggauagauuaaccuagggcauuuugggugacuuccaggagagaucucccccuaagccugcuacaaagucauuccuuugcccugggaaccaucaguuuauccaaauaguguccaucaucagaguuguuuuuucuuuuucuuuuucuuuauuuuagagacagggucuuugcucugucucccaggccggacugcaguggcuugagcauagcucacugcaagccuuaaacuccugggcuuaagccauccucccgcuucagcgucccaaguagcuaggacuacaggcgcauaccaccaugcuuaccugauuuuuauuuuuaucuuuuguagagauggagucuuguuauuuugucgaggcuggucauaaacuccuggccucaagugauucuuaggccacuucaaccucccaaagcacggggauuacaggugugagccacugcgccaagcccagaguuguuuuuucaaggaguaauuugguaugaugcaaaagauuuugaagaauaaaaacggauaucuggaguggguagagagguggaauuugucccauuuucaucugccuuuucuucuaugaagaauuuggaaaacuaucuaucagaagcacuuuaagaacaauuauaagacauuuuacuacuuccuuugccaguacaaaauguaacauaauugaggaauacuaaauuuauauucagugcaaaagcugugcauuggaauuugaugauuauauuuaaccauauuuuuugcaaauuuaaaaagauuagaauuucuacaugacuagauuagcugguauuugauauuuaaugaauaacaguaaguguuuggaaaaguaauucuggauaagaauuaccugugauccucaguuucaucaucuguaaaauuagaauaauaauagugccuacuuuauaggauucuuacgacaauuacaugagaugaauuaugcaaacuacuuagaauagugucugguauaauaaacuucaugugaguguuauuauuuugaaccauaguuaacaaucgucuuauugggaaaauaccauuugcauguacuaguuauaaaaacuauguguagggcuauaucauuggggaggugacagcauuuuauacuucuuuuuguaguggacaguugauuaggaauuaaguacagauguuuugccaauuauaaggaaauaaaauuuuuaaaggaguuuuuaacaguuuaugaaacuguuaugauguuuuaacaggaauugucuaagaaaugcuuucuauuggcauauuugcuaaauuaucuuuguucuacuaccuucuuucagacuucugcauuuucauaaagcuuauuugaaaaaaagguguaaucggggauaaagccacaaaugucuuaggaguuucuguaaucaucacccuuaauucacuuaauuguagcaauaagcuggcugugaauuacuuaaaacuuuaugaggccaggcgcaguggcucacaccuguaguuccagcacuuugggaggccaagguggcagaucgcuugagcccaggaguucaagaccagccugggcaacauagggaaaccccaucucuacaaaaaaauaaauuuaaaaaaaauuagcuggacauggugaagcgugccugcagucccagcuacucaggaggcugaggugggaggauugcuuaggcgggaggucaaggcugcagugagccauguucgugccacugcacucuggccugggagaaacagacccugucucaaaaaaaaacaaaaacaaacaacaaccacaaaaacaccuugauaaacaauucaugccauucaaguaguaaugaaugcagauuauuuuuagucucuaccuuuugguauaugucaugugguacgggaaggguguugaacagguuuaggaaguaaguugcacagguugguaagguuuuguuuguuugaaagaguguaguaaugauagaguucuaacagaguacaagccuggcaaaggcaauugcuugagaacaauaucauggcuagaauguaaguagaaauucaacuucagguuucucgugccuccaaauguaggacccuucacagcccucaccagccugaagguucugucacuucagaaaaccaggcugucuucugccuccuauugaaauggaaaugcauggauaacuaacaccuuuaacugguuuuggguuaagugauuuguaaagcucuguacuuuuugaguucuagugcaaaguuuuauucucauuuguugccauaaaggaguaagaagcaacuauuugucaauuagagagggcauugugggaaagagacccuaagaacuuuuuuuuuuuuuuuuugagacagggucucacucuguugcccaggcuggagugcaguggugcaaucauagcucauugcagccucaaacuccuggccucaaaugauccuuccaccccagacuuucaaaguacugggauuauagaugugagccacugugccuggcaacuaccugauuuuuaauuuuuauuuauuuauuuuuucagacagggucuugcucugucauccaggcuggagugcaauggcaugaucacggcucacugcagccucaagcuucugggcucaagcaauccucccagcucagccuccugaguagcugggacuacaggcacaugccaccacgccuggcuaauuuuuuaauuuuuuguagagauaggguuucaccauguugcccaggcuggucuugaacuccugaguucaggugguccgcucaucccagucccccaaagugcugcgauuacagaggugagccacuggccaggaacuuuuuugcgggggcaaggaggggauggugguccagaccagagaguaguuggagguuuauucauucagaagauaauugaccccagcagcagcugcgaagauauaagcuuuauuuuuguaaauuucuggauaaaccauuugaaaguugcagguauuggaacucuuuaccccuucauacuucugcauguaucccuuaaguauugggaugguuuuuacguaacaacaauacuauuaucacaccuaagaaaguugauaauacuucuuaauacuaucuuuuuuuuuuuuuugagacagagucuugcucuuguugcccaggcuggagugcagugacucgaucucagcucacugcaaccucugccuccuggguucaagccauucucuugccucagcuucccaaguagcugggauuacaggugccugccaccaggccuggcuaauuuuuuguauuuuuaguagagaugggguuucgccacguuggccaggcuggucucgaacuccugaccucaggugauccacccacuucagccucccaaagugcugggauuacaggcgugagccaccgcaccuggccccuuuuuuucuuuuucuuuuuuuuuuuuuaauugagauggaguuucacuuuugucgcccaggcuggagugcaguggcgcgaucucagcucacugcaaccuccgccuccuggcuucaaaugauucuccugccucagccucccaaguagcugggauuacaggcaugugccaccacgccuggcuaauuguuuuuauuuuuaguagauacgagguuuuaccauguuggccaggcuggucucgaacuccuaaccucagaugaucugccugccucagccucccaaagggcuaggauuauagacgugagccaccuuaauauuaucuaucauucacuuccuauucaaauuucuccaauuauaagaagauagauuuuguuuguuuuauauaauguuuuaaaaucucucuuaaucccuaagagacuaguccagggcuugaagucuucaugucagggggaauguuaagguguagucuauuccgggaagcgcaggcuucaacuuuccuuuaucuagagcuaccuuuagcuguacuuguaaucuuuacauagguuaucagucuguucuucugcauuaagauuuggaauaaaggcaaggacaaaauaacuuuuucuuuucuuuuuuuuugagauggagucucguucugucaccaggcuggagugcaguggugcaaucccgccucccggguucaagggauucucccgccucagccuccugaguagcugggacuauaggcacgugccaccaugcccggcuaauuuuuguauuuuuaguagagaugggguuuccccauguuggccaggaugaucuugaucucuugaccucguaauccacccaccucccaaaagugcuaggauuacaggcaugagccaccaugccuggcccuccaaaauaacuuuuucuuacucccuuuuuguuuuuauucuuuccucugccacuucugcuucgcacuucugugaaaugccuuccuccucuuugcacaaugcagugaugauagaaagauuucagcaacguuaacagggucuuuuuuuguuuuuuuggcguguguuuuuuuuuugagacagggucucacucugucacccagguuggaguggaggggugugaucauagcucacuacaaccuugaacuccugggcugaaacaguccuucugccucugccuccuaaauagcucagcguacaggaaugcaccacgaugcccagcuaaugauugauugauugauuauagagaugaagucuugcuuuguugcccaggcuaguuuugaacuggccuuucgucaagggauccucccacuuuagccucccaaagugcuaggauuacaggcaugagccacugcccucagccaaacagggucuuuuaaauaaucuuuuaacaauuuaaaaugauuauauacccauaccaguggagaaaaaauacagcuucauucaagacauguuuauagcagggcacgguggcucaugccuguaaucccagcacuuuagggcggcugaggcggguggaucacgaggucgggagaucgagaucauccuggcuaacacggugaaaccuggucucuacuaaaaauacaaaaaaaaaaaaaaauuagccaggcauggugguggcagguaccuguagucgcagcuacucaggaggcugaggcaggagaauggccugaaccugggaggcagaguuugcagugagccaagaucgcgccacugcacuccauccugggugacaaagcaagccuccaucucaaaaaaagaaaaaagacacguuuauaugcacggccuucucugagaguaacugucaacuccuguuauuuccuuuggguuaccaagaauugugcagguuuugggcaccuaucugacuagcuuagagccuucuggggaaaauacuucacuggaaacaugaucugccuucauucacaccaguuccaguaccuuucuacacauggaugguguagcuccuuuauagguagauugggauuguucugagauugcuuuauauucuuugucacagugaauuuaguaccuaaauuaaagccuucucuccuucuuuuuguuaacaaaauuacuuguaaccauaucguuaugguucuaaaauuuguucuaaaauuuuggagauaaguuuagauaugaccauauugauuaguauuaaaaguugacauuugguuguauguuucuccacugacucccauauaacccaguucguccuggaagauaguuuuuuuuuuuuuaauguuuuggcuacuuauuuacauuauuuauuuuuaacauauuaguacauuauuuuuuguuaucguuuguuuuguuuuguuuuguuuugaggcggagucucacucugucgcccaggcuggagugcaguggugagauuucagcucacugcaaccuccaucucccaggaucaagcgauucuccugccucagccucccaaguagcugggauuauaccaccacaccuggcuaauuuuuguauuuuuaguagagacaggguuuuaccauguuggccaggcuggucuugaacucuuggccacaggugaucugcccgcccucagccccccaaagugcugguauugcaggcuugagccaccaggccuugccacauuuugaauuuaagcagccauaaacuggucuuaacauacuauaggagguuucagugcccaguuauuuuauuucuuuuuuauuuauuuauuuuuucgagacagagucuccucucugucacccaggcuggagugcaguggcgcaaucucagcucacugcaagcuccgccucccagguucaaaccauucuccugccucagccucccgaguagcugggacuacaggugccugccaccacgcccgucuaauuuuuuguauuuguaguagagacaggguuucaccguguuagccaggauggucucaaucuccugaccucgugauccgcccgccucggccucccaaagugcugggauuacagcugggauuacaggugugagccaccacgcccagccucagugcccaguuauuuuagaugauauagauuagaaagauguuuaauggcucauuuguggauuuuuuugguuuaaaauaauuuuauuuuuuauuuuuauuuuuauuuuguuccccagccuggucuugaacuccuggccucaaaucauuguccugcuucugccucuggaagugcugggauuauaggcgccagccaucaugccuggcucucauuuguucauugaaggggucggauuagauaacauuucuaccaauuuuaaaauuauauaaauuggauaaagaaggacuccaaagcaauauagaaaaaguaugaauuacuaaaugaaaagcaagcuauuacaacuuuguaaaguacacgaguaacugauauuagaugauauaugaagagcugggcgcgguggcucaugccuguaaucccagcacuuugggaggccgaggugaguggaucacccgagguugggaguuuaagaccagccugaccaacauggagaaacccugucucuacuaaaaauacaaaauuagcugggugugguggcgcaugccuauaauuccagcuacuugggaggcugaggcuggagaaucacgggaacccagaaggcggagguuguggugagccaagauugugccauugcgcuccagccugggcaagaagagcgaaacucuaucucaaaaaaaaaaaaaaaaaaaagaucuaugaagaaaugaaaauggcaguguugggauugugaacaaauuuuguuuuuuucaaaaaaucuuuugggaaacuuaguaauucuuuuuuuuuuugaaacagagucuuguucugucaccagucuggagugcagugacgugaucuccgcucacugcaaccuucgccucccugguucaagugauucuccugccucagcuucccaaguagcugggacuagaggcagacgccaccacacccagcagauuuuuguauuuuuaguagagacgagguuucgccauguuggccaggauggucucgaucucuuuuccucagcauccgcccgccuuggccucccaaagugcugagauuacaggcgugagccacugcgcccagccugaaauuuaguaauucuuuaacugacuuauuuuuguuaaacuaaagggaacuuuaguacaagaauagccuuugaggccugaggccagaacugggauagacuggucaaguucuuaaagaaaacgguuguaacuggcaaagucaggagggaaauggagaguaauuagugcagcaguaauacuugugccuucaggcucaggauguaagcaugaugcugauaauagcuaaucuggagugcuugccaugugccuggcacuuugccaagcauuuuccuuucauugacuggugaguucgcucuacaaucccauucacuuaccucucucugguaagccauggugcuagcaauggaaucagaaucugucugccuaacccucacaaguguguacacuuuacagugagccauuuauaccuguccggcuggcaaaacaguccacaacugucuccuuaguggcuggaucccugcuggcucugccccgauggaaaugcuuuugccuucucugcucagugaucacuuuagagcacuaggacagaacagagcccagcuucgagggugaaaccugaugcugaagaauucacagccacacauaguguguccucuuaucccagcucugggccacucacuaccugcuugucccuguucacuuugucccauuguucccaacacuacaaguacauuuuuguuucaugagcugagggaggaggacaccuuaucugaaugacuuuggccaccccuuuaaaccucugaagguacagccucggacaaaguccacacuugucacacccuuuuuggcuguugucuuuucuccucuguuuguuuccccucucuuacuuccaaucuaucaggagacuaaacuauuucccagaaaggccuuuuugaguuuuuaguauuauuauguaccugccauuauugccucauuuuaauugucaacuuguaucuugaguuuauggacuaaauccaaaaugaggagcaaaauagcuuucugguagaugucaucugaugauagcaugaccauuuuacgaauuugccuaauuugcuuccuuggagccaguucccuuccugggaacucagugaagcucaugccaucacagaaaagagguugaucuuuauguuuuccaagggaaaagauaaagccuuuaaugcuugguguaggaguaaaccagaguuuuaaaauagaaucuguuugauguaccccaaucaaauauuguacacccaacaccuaccuagccguacacaucaccuaccuagccguacaccuaccuagcaguacagccugaaacagcaaacugaucauggauauuuuuucaaucaaaacaugcauuuuuuagcuggaacuguggcucaugccuguaaucccagcuacuugggagacugaggcacgagaaucgcuugaacccaggagguggagguuacagugagcugagauuguaccacugcacuccagccugggcgacaaaguugaggcucugucccccaaaaauaaaauaaaauaaaauuuaaaaaauaagcaaaauaggccgggcaugguggcucaugccuguaaucccagcacuuugggaggcugaggcagguggaucaccugaggucaggaguucaagaccauccuggucaacauggcaaaacccugucucuacuaaaaauacaaaauuagcugggcaugguggugggcgccuguaaucccagcuacuugggaggcugaggcaggagaaucgcuugaacacgagaggcagagguugcagugagccaagauugugccauugcacuccagccugggcaacgagagugaaaccccaucucagaaaaaaagaaaaaaguaaaaaaauaaauacaguaaaaacauacauuuucuuagccucuaagucagggcauugaaacuucaaaguuucacagcuuccuuuuaaacuaaauuugggcugggcaugguggcucacaccuauaaucccagcaguuugggaggcugaggcgaguggaucaccugaggucaggaguucaagaccagccuagccaacauggcgaaaccccgucucuacuaaaaauacaaaaaauuagcugggugugguggcggaagccuguaaucccagcuacucgggaggcugaggcaggagaguugcuugaacccgggaggcagagguggcagugagugagaucgugccacugcacuccagccugggugacaagagcaaaacuuugucucaguaaaauaggaugggauaggauaggacaggacaggacaggacaaaauuugccuuuguuuuguuaaaucuuaaccaucuaauauucaucacagucuuaauuaagccuagacuucauuccugggauugaauuuugauugcccuugauuuaguuuauucucuaacuccuuucauucuuuagcuuuuaaacuuucugcuuuaacauucuagagauaagaguuucgacaucccaguccuacugaauuuugaagcauuugacagcgagggguggguucagugugaaugagggcuacuucccccgagcugggacuaauuuugugcucuuuaguuucccacagucaaaucacucgccucuacagccgguucaccagccuggacaaaggagagaaugggacucucagguaggcaguguuuuucuuuauuuuccucacagaaaccagaaacccucuggcagugucugaauagcugccuuuaucccuaggguagacaugauagacauccagcaugcagauagcaaggaccauuucucuacuggucuuugagcaucauugauccacaagagaauuaaaucagcagaacaggcugggcgcgguggcucacgccuuaaucccagcacuuugggaggucaaggcgggcggaucaugaggccaggagguccagaccagccugaccaacauggugaaaccccgucucuacuaaaaauacaaaaauuagcucaguguggugguaggcgccuguaaucccagcuacucaggaggcugagguaggagaauugcuugaacccgggaggcagaggucgcagugagcaaagaucacgccacugcacuccagccucggcaacagagcaagacuccaucuaaaaaaaaaaaaaaaaacagcggaacuaugacaauuaaaugcauuaacagauguguguugcuuuauuccaacuccccuuaauuuagguggccauuguucugauucuaggaauguauuuuuaagauuucagcucucucugcuuacauuuucccauaauccuuucccaaacauuggcuuuuaggaaguugacccauagcgaucccagguggucuagguuguuuugucuucuuuuauuuaccaacccauaacccugagguacaucacuuuauguauauuaauguuggacaaaauguucaguauguuagucuagagcagugguucucaucugagggccauuuugccaccuggggcaaaaugucuggaaacauuuuuaauugccaugacuggagaaugcuacuagugccuaguggguuguggccagagaugcugcuaaacauccuacagugcacaggacagcccccaugacaaauaauuauucuggucuagaugucgguagugccaaaauugagaaacucuggucuagguaaguauaugauaucagagugauguaaugcuauauuguuuuauguuuguaauugucuuaccauaaucaaaugaaauauucuuuaccauuaucucccacacuaacucucaguagcaaccuuucuuaugcugugguucuucaucuuugauuggcauguaaugaagcuguugcccuuccuuuuggcuggcaugaagcagcuuaggacuucuuuagaaaguuucuagcacagguguuggauguagcauaaagggggaaggaauacaguugcuaagccuuuggacguaaucaucaccccaaauggaaaccccauacucauuaagcaugggguuaagcauaccuauuaagcauacguauuucccccuucucucauccccuggcaaccauaaaucuaccuucuuuuucucucuggacaauucauauaaauggaauuauauggcccucucauaacugacuucuucuggcuggacacgguggcucaugccuguaauucuagcacuuugggaggccaaggcgggcggaucaccugagaucaggaguucgagaccaggcuggccaacauggggaaaccccgucucuauuaaaaauacaaaaauuagcguggcgugguggugggcgccugugcgugguggugggcgccuguaauccaagcuacucaggaggcugaggcaggagaauugcuugaacuugggagguggagguugcagugagcccagauugugcugcuguauuccagccugggcgacagagagagacuuugucucaaacaaacaaacugacuucuucuacuuaacaugauguuuuuaagguucauccaugauguagcauauaccaguacuucauuccuuuuuauggcugaauaaauagucugucauauggauaugccacauuuguguauccauucagcaguuaguaaacauuugaguuuacaccuuuugaguauugcaaauaguguugcuuuaaacauuuuugggugcacauauguuuuaauuucucuuggacguauaccuaggaguggaauggugggucauaugaguugucuuuucacucucuuuguaguguucuuuaaagcacaaaaguuuuuaauuuugaugaaguccaguuucuuuaauauuucuuucagugcuugugcuuuugguaucauauauaagaaaccauugccaaauccagugucccaaaggcuuauccuauaucuucuuguaagggcuuuaugguuuuaguucuuauauuaaggucuuuugauuuauuuugaguugguuuuguauauggugucagagaagaguccaacaucauuuuuuuuugcauguggauauccaguuguaccagcaccauucguugaagacgcuauuaaaacuaugugaauuuacacuugaaaaauaacuagacuagaaaucccuauuuguaauuuuagcuccaauacuuaaaaauuccuuugaguuuauacuugccucauaaauucagacuuaaccacccaguaaagacuuaaaauuuauauucugaguucuuuucuucuuuguagaaagugggugguuucuaaauguguguguuuuuaucauguuugcugugugcuggaaaauaaucgaaaaguuuuuuuuuuaaugagcuguuucuuuuuuuuuuaagauggaguuucacucuuguuggccaggcuggagugcaauggugugaucucggcucacugcaaccucugccucccggguucaagugauucuccugccucagcuuccugaguagcuaggauuacaggcgcaugacaccacgcccugcuaauuucuguauuuuuaguagaaacgggguuucaccaucuuggccaggcuggucucaaacuccugaccucgugauccacccgccuuggccucccaaagugcugggauuaaaggugcgagccaccgugccuggccaaaaagcuuuuuuuuuuuuuuuuuuuuuuuuuugagagagagucucgcucuguagcccauggucucgauauccugaccucgugaugcaccugccuggcuaacgcagugaaaccccgucucuauuaaaaauacaaaaaauuagcugggcgugguggcaggcgccuguagucccagcuacucgagaggcugagguaggagaaucacuugaaccugggaggcgagaucacgcuacugcacuccagccugggagacacagcuagacuccaucucaaaaaauuaaaaaaaagcccgggugugguggcucacaccuguaaucccagcacuuugggaggcugagacgggcggaucacaaggucaggaggucgagaccaugggcuacagagcgagacucugucucaaaaaaaaaaaaaaaauguugaaaacuuuccaggcgucaguguagccugcuccuuaaaaucuaaguaagggccaagcgcaguggcuuacaccuggcuguaauccagcacuuugggaggccaaggcagguggaucacuugaggccaggaguuugagaucggccuggccgacauggugaaacaccaucuuuacgaaaaauacaaaaauuagcugggugugguggcgcaugccuggaauuccagguacuugggagguugaggcaggaaaauugcuugaacccgggaggcggagguuguagugaaccaagauugcagcacugcccugcacccugggcaacacagugagauccugccuuuaaaaaaaaaaaaaauucuggccgguugugguggcucacucuuguaaucccagcacuuugggaggccgagauggguggaucagcugaggucaggaguucgagaccaggcuggccaacaugguaaaaccccgucucuacuaaaaauacaaaaaaauuaaccaggugugguggcgcacgccuguaaucccagcuacuugggaggcugaggcaggagaaucacuugaacccgggagguggagguugcagugagccgagaucgugccacugcacuccagccugggcagcagagcaagacuccaucuuaaaauaaauaaauaaauagggccgggcgcggugguucacgccuguaaucccagcacuuugggaggccgaggcaggcagaucauggggucaagagaagaccaaccuggcuaacacagugaaaccccgucucuacuaaaaauacaaaaaauuagcugggaguggugguggguaccuguagucccagcuacucgggaggcugaggcaggagaauggugugaacccgggaggcggagcuuucagugagccgagaucacaccaccauacuccagccugggcgacagagcaagacuccgucucaaauaaaaaaauaaauaaauaaaauaaauaaauaaauaaauaaguaucuaaguaagauuugcucaaucuguaaguuaccauuucacagccuguggaaaaccagcagacuagcucacucauuugguagguauuuacugacuaucuaugaugugccagacacuguucuccaugcuggcaauauuuuuuuuuuuuuuguaagagacagggucgcacucugucuccuaggcuggaguguaauggcaccaucacagcucacugcaaccucaaccuccugggcucagacaguucucccaccucagcugcccaaguagcuaggacuacaggcaugcaucacuaugccuggcuaauuuuuuuuucuuuuuacuuuuagcaaaaaagcaaaaaagcgcacauuaugugguacaauggaauaguuucuucuagguauucaagguagcuuggugcuucuccuguuauuuuuauuuuauuuucauuuuuuguggagacacagucucaccuuguugcccaugcuggucucaaacuccugggcuccaucaguccucccgccauggccucccaaaguacugggauuauaggcauaagccacuguaccuggccugaaagcucuaggucuuaaaccuguucuuugaucucuaucaugguguggauugaaauauaagaaagguugggcgaggagacucaugccuguaaucccagcacuuugggaggcugaggugagaggauuccuugaggcccggagucucaagaccagccugagcaacauagugaaaccccgucucuacaaaaaauaaaaauaaaugagagaagcaccaagcuaccuugaauaccuagaagaaauuagccaauuguaccacauaaugugccacauaguaaacgaguaauauauuuuauguaaaucguuuugucagacccacccacuacugggauuucacucuggcugugccuccugacaauuaucuucuuagccuguggccauccgauuaaauugucuuccccuucucucagcccucuccucuucuacccccucuagccuuagaaaugaguuggccuaacugggaacucuucucuaguagaaugauccaguucucuccagccuuuguugccaaacucagcuuaaggccugucuugauguuuccaggacccaucagagugcucauccgaauacaaguggcuuccaaucuuuuguuaccuggaacagcuuccaccuucuuuuuuugguuuuuguuuuugagacagggucugacucuauugcccaggcuugauugcaguggcaccaucacggcucacuguagccucccaccucagccuccugaguagcugggacuacaggcacgugucacugccuggcuaacuuuuguauuuuuuguagagaggaggucucgccauguuccccaugacuggucucgaacuccugaacucaaaccaucugccugccucagucucccaaagugcugggacuacagaugugugccaccaugccuggccuucaccuucuuuuuuuuuuuuuuuuuuuuuuuuuuuugagauggagucucgcucugucguccaggcuggagugcaguggcacgaucucggcucacugcaaccuccgccucccggguucaugccauucucaugccucagccaaccgaguagcugggacuacaggugcccgccaccacacccagcuaauuuuuuguauuuuuaguagagacgggguuucacuguguuagccaggaugguuuugaucuccugaccuugugauccaccugccuuggccucccaaagugcuaagauuacaggcguaagccacugcgcccggccucgccuucaccuuaagaaggcaguuguaguuauuaggagaaagauuuucacuucaacaauuuuuuuuuuuuuuuuuuacuuuccucuuucaaggugcuccaugucugggccugaagccaaauucugcagagugagaggcuacaguguacagucuggggcauucugcauuccuuuguagugaucagcuccaguggaacauaaggcagaacuguggaaggcuuugguuagaauggagcuucuucagagugcuuucagagacucacuccgaagcaugcuuuauagaacagucauuccuuggucuaucaauagguguuauguuaaaaaaaaaaaaaaaaagcaaaaaguuauugacuaaaauuugugaaaaccuuggucaacaagguuaaauaggcuaccuaauuacuagauuucaccacaucuuuaauuuaccugggugaauugggaacauucaagggagaaguguuugccaaauugauuugcaauuucccugucugccuuuuuacauggaccaucucuucagauugauauuucacggaauauaaauauacacuguaaccuuauaaaccuuacuuucuucagaugccauuauuuuggguaagauauuucuaccauugccauagagauuguuuuuucuaaaaaggcagcuuaggccaggcgcaguggcucaugccuguaaucccagcacuuugggaggccgaggcaggggaaucgcuugaacccgggaggcggagguugcagugagccaagaucaugccauugcacuccagccugggcaguaagagugaaauuccaucucaaaaauaaauaaauaauaaauaaauaaauaauaaagaggaggagaagaaauaauuuuuaaaauaggaacaaaauccaggugagguuucuuaccaaaaaaaaaaaaaaggaacagaagcaaacuucccagcuaaagggcccauuuuuagucuaagaagguucaccuaaugcugaacaaugaauaauaaagaauacuucacaauaagauauauauagaugaaauuucagaauaucaagaggagauauuuaagacuuucuuucuuucuuucuuuuuuuuuuuuugagacagagucucgcucugucaccaggcuggagugcagaggcacaaucucggcucacugcagccaaguucaccgcuuccggguucaagugauucuccugccucagccuccagaguagcugcaauuauaggcgugcacuaccacgcccagugaauuuuuuuauuuuuaguagagacggguuucaccauguuggccaggauggucucgaucucuugaccuugugacccacccaccucagccucccaaagugcuaggauuacaggugugagccacugugccuggcccagaggauguuuuuaaagcaaacuuuauugaaguauaacauacagaaaagugcacaaaucaaaagcauuggacaugauaaauuuucaccaagggaagacuauccagccuccagaugaagaaacugauuauuaccaauacccagaagcuucccuuaugcuccuuuugucuuuaccugcuccccuccccaaaggguaaucauuauccugccuuguaacuccauagauuacaucagaacaaagaauauuuaaagaagagaaaccaucuuuguguucagauacugaccaggcucuuaccuuaaccugaccugcaaaagaccacuuuaggaccccugggguccccaaccucuggguugcagaccaguaccagucuguggccaguuaggaaccgggcuacacagcaggaggugaacagaaugcaagugagcauuaucaccugagcaccgccuccggucagaucaguggcggcacuagauucucauaggaacagaaacccuauugugaacugcccaugugagggaucuagacugagugcuccuuaugagaaucuaaugccugcugaucugagguugaacagugucauccugaaacuauccugucuacccccaggagaaaaauuauuuuccauaaaacuggucccuggucccaaaaaggcuggggaucgcugccagcugccuuuuuuuuuuuuuuuuuaauuagagacaggguuucccuauguugcccaggcuggucucggacuccuggguugggauuacaggcacaugccacuaugccuggcuuauuuuguauuuuuaauagagacaggguuucuccauauuggucaggcuggucucaaacuccugaccucaggcgaucugcccaccuuggccucccaaagugcugggauuauaggcgucaaccaccacgccuggccaucuuauccauuuaauuuaaaaauacugauuaagugcuuuagcuaauggaaauuuuugucauuucaguguuaauaaauauguuguaccauaugcuuaaccucucauacuacuuaaaauggaaagcuguauuuucuuuucuuuuuuuuuuuugagacagagucucgcucuguugcccaggcuggagugguacaaucuuggcugacugcaaccuccgccucccggguucaagcaguucucugccucagccucccaaguagcugggauuacaggcacccgccaccacgcccgucugauuuuuguauuuuuaguagagacgggguuuuaccaucuuggccaggcucgugucuaacuccugaccucaugauccacccaccucggccucccaaagugcuggaauuacaggagugagccaccacgcccggccuggaaagcuguguuuucuaauugaauguguguuccaguggguauguccuauuaacagauuuuaaucuccucauuauguacaagucaacuaaagcaacaaccugugggugcuugagauagaaguuaccugugaggcugaaucucucuguaagagaagggacuugcacagugaaggugagcaguauagagggauggcaugucugguuacuaacagucuaaaaacccugguuuuucuaagcaucccugugcccuugaauguuuggaaaaccacuccccauuggaaauuucuuggccacaaagaaugccaucguacauggcucuguucucagaauugacuacuaccagugauacugucuuuuucuaaaaaaaucuucaaggaagguuuuccuagguauaccaugaggcagaacauaauguugguaugcuuuucagugaauccacacaaaucuguauuucacaugguuuuuuuuuuuuuuuuuuuuuuuuuuuuuugagauggagucucacucugucaccaggcuggagugcaguggcgcaaucuuggcucacugcaaccuccaccucccagguucaagugauucuccuuucucagccuccagaguagcugggacuacaggcucgcgccaccaugcccagcuaauuuuuguguuuuuaguagagacgggguuucaccauguuggccaggauggucuugaucucuugaccucgugauccaccugccucagccucccaaagugcugggauuacaggcgugagccacugugcccggccuucggauggaucuuaugcuugugguguuuaggccacuuuggaguauuuauuuuuuucuauuagguuuauguugauggguaaauuugagaaucuaaguuuuagagaaacugcccagaucuacauucuacuauaaagcaaccaguaauaauaacuuguucguauauuauuuauuuaacaguugacaaaguauuuauuuauuuauuuauuuauuuauuuauuuauuuauuuauuuauuuugagacggagucuugcucugucaccaggcuggagugcaguggcgcaaucuuggcucacugcaaccuccaccucccagguucaugccauucuccugccucagucucccgaguagcugggacuacaggugcccgucaccacgccuagcuaauuuuuuguuuuuuuaguagagacgggguuucaccguguuagccagguuggucuucaucucuugaccucaugauccucccgccucggccucccaaagugcugggauuacaggugugagccacugcgcccggcugacaaauuauuuuuuauacucuuucuguuuguuuuguuuuuucuguuuugaaacagggucucacucugucacccaggcucgagggcagugauguuaccauggcuccuugcagccuugaccuucuaggcucaaacaauccucccgcuucagcuucccaaguagcugggacuacaggcacgugccaccaugccuggcuaauuuuuuuuuuuuuuuuaaacuuuuuagagauguggucuugcucuguugcccaggcuggucucgaacuccuagccugaagcaguucuuccaccuuggccuccaaaagugcugggauuauaggcugagcugccauacccagcccucuuucuuuuuaacuuuaauacuuuuagcaauacuguccuugaucugggugacuggaacuacauuauauauacaaucuaaauucuaagaguagaguuagaaaguaucaaaggacagguccaucggaaggccaaguguacaccuccuuauugagacugaaguucaggcuagguugugcaucaccacuugauacuagacuugguauuuaaacugccuuuucucagcuaaaguuucuuaagcuuguuagacauuaaacugaaguauguagccaugcaauucaaaucagccuuagucuuaauuuaaaagugaguaguuauuguuucuugaccucugucagacaggaggagcuacauuuugaugauaguguagacuuuguauuacagaacaaauuauguaauaaaagcuuaguacauguuuguugaauuaaauaaucaggaccucgguaauuuucucuuucaucaucuuaagcaauccaguuaucuuaugaaugacuucuucugguucaugcauugauauaaaauuauuacacuaaauggucaagaaggacuagaauccaggaugauuguuccagagcuuuguguucaguccacuaggucaguuucuaccugugucaccaaaugugguggagaagagcuugcugaguuaauuaagcaccacguaaacguuaaaccacaagaggaaaagagcgugaagucuccuggguacaguaggaguauuuuauuaucuuccgucuuugcuagcauauauuacaaagaggguggagguauacauuuuaucugucuguaaguaaacuucuugaaggcaggaguaaaaucuaguuuauaaucuuuuuuuuaacuuuuuaucuggaaauaauuuuaaacuugaaguuacaagaacaauacaagauaacuuuuauucugauacccagauucaccaauuguuaacauuuugucacauacuucacuguuuauuuccuauagaaaggacauucucagaucaaaaucaagaaaguugcauuuugaaacaguaccauuauguaauauuccauauuuuauaugguccaugcuucauuuucacauauuauccaauaauguccuuauagcaguuuuuuuccuaguccgggaucauguguuggguuuuguugugugucucuuuagcccccccuugaucuggaacaauccucugcuuuucuuuguccuccaugacauugauauuuuugaagacugcagcacagauaaguuguagacagcuuuguauucuuggcccaggaaccaacaaaagaaaguuuuuaaaaaauacuuauugaaaaauugggggacugggugcgguggcucacgccuguaaucccaggacuuugggaggcugagguggguggaucaccugaggucaggaguucaagaccagccuggccaaugugguaaaaccccaccucuacuaaaaauacaaaaauuggccgggcaugguagcacccgcuuguaaugcuagcuacuugggagacugaagcaguagaaucgcuugaacccgggaggaggagguugcagugaacccagagaucaagccacuacacuccagccugggagcgaaacuccaucucaaaaaaauaaaaauaaagaauuugggggagaguaacuuucauucaaaagguucaauauuagggcugggcaccguggcucacuccuguaaucccacccagcacuuugggaggccgaggccggcagaucaccugaggucaggaguucaagaccagccuggccaacauggugaaacuccgucucuacuaaauguacaaaaaacuagccaggcgugguggagagugccuguaaucccagcuacuugggaggcugaggcaggagaaucgcuugaaccugggaaguggagguggcagugagccaagaccaugccauugcauuccagccugggugacugagcaagacucugucucaaaaaaaaguucaauauaggaaagaaauaugguuuuuagaaaaagaacacauacuuugacuuacagacuuagauuuaaaucacaguucugcuacuuaggaguaguguggcuuugggcaaguuacuuuaucuuccugacucucaauuuccucagcucuaaaaggguauacauaaaacauuggcgugaagaaaugagaauaauguauguaaacagagcagcacaugauauauaugugaugaaugguaacugacaauauucgcuuugguauaaccucgccuaagucaugugaggaugacugcucuugucauguuugaggguuaaauacuucuguagcccuaguccacagaacauggaaauggagaaaaagccagagucagaacaaggaaaucaauugguugucacauuauuuccuugcauguaaauagcaccuaagaauuccuugcauuuuguaagugccuaaaaaucuuaacaaggauauggagaccccucuaaguguuuguccccauauucaaguucugcaguauuugauacuuuccauuugcuguucacuuuccaaacuuaauaacuagguacgcaaugcuaauguucaagaaaucauuuacuaagggacagcuuaguauuuguccaucaguuggcuuauugacguaaccugugugcuaaauucacuggaauguggcguaaucaaaucuggcuccuuccacuucugaguuggugcaagaaacacuuggcagcuauuaaagugcuauucuuugcaguuauuugguauaauuugccacagaaguaaauuccaggagguaauauucuugcuagguuacacccuguuaccuccugacuuaaggaguucaugcuaagggcaaugaucucuaucuaacucaaggugauucucuuggcagccgggaagauuuccagaggauuccagaacuugccaucaacccacugggggaccggaucaucaaugccuucuuuccagaggggugagucaguacaguuguuggacuuccuuccugaggcuaucacaaccuaaauuauuugcuaaucuggaauaaugauauugguugugccaucucagacugugauacccccugauuauauugagcaauucuaauuuugucauuucuagaauaucucuucuguucuacccuccuguguguuuuaaacuucaaauagauauaugagccuaucuucaaaauucuuauguuuaucauugauguaaaacuagacuuuuaaaaaauguuuauuuggaaauaauuucaaauuuacaaaaaaguugcaaaaguuaaaaguaauucggagaauacuuguauauuuauugcccugaugcaucuacuguuauauuguuaacauuuugccucauuugugugcucucuucuuaguaguagccaauaaaaauauaaugcaagccacauacguaauuuuacauuuucuaguaaccacauuuaaaaaguaaaaauaaguuaacuuugguaauauauauuuuauuuaauauauuuaaaauauuauuuccauauauaaucaauauuaaaaauaacugagauccuuuuuucguuuguuuguuuguuuuaagacagagucuugcucggucgcucaggcuggaguacaguggugccaucucggcucacugcaaccucugccucccggguucaagcgauucuccugccucagccuccgagauaguugggauuacagccacaugccaccauaccuggcuaauuuuuguauuuuuaguagagacaggguuucaccauguuggccaggcuggucuugagcuccugaccucaggugauccgccugccucagccucccaaaguacugggauuacuggcgugagccaccaugcccagccuacauuuuuucauaauaaguccuugaaauccaguguguaauuuacacuuaaacacauaucaagucagacugaccauguuuucagugcacauaaccagaugugacaagugacugcaguauugaacagcgcagcuuguacacccgugcuuacucuacauacccucucuugcagacacuuuuucccucucucuuuccccucucucuaccuacacauacucuacguguguguguauauacauacauacaugccuacauguacguacauacauacacauacauacauguauguauauacacauacuuauguaauuuuuuuguguauguguguucacauaauuguauuucugaacuauuucaggguaaguugcauaguaaugacccuuuaccucugaaugcaccaguguguguuugcuaagaauagggacauucuuuuacauauccauaguauaguuaucuacuucaguaaacuuaacauugauacaauccucuuaucuaaucuauuacucuguuuuauuaacauauuauccaguuuauucuaauuuauauucauauuccaauuuugucauccaauaaucuguuuuauagcacuuccccgccuccaguacaggaucuagucugggucaguugucaugucucuuuagccuccuuuaaucuggaacauuuccccagccuuuauuuuacuuucgugauauugaauaaacauaguucucaccacauaugcuuugucaaguagauuguucuuaauguggguuuuucuaacaugaaacuagucuuuugauaugcuuuacuaccuaauacacugccuucacaguagugaguaaauauuuacugauuugauuagguaccuuuucaacaauaaaacuuacauauaagcuuguuuuaaguaauuuccuaaacaaucuauuccugguuuauauggauagucuaugacccacaggacuucaaaauauuauaugggugccaguuuuuaauaaugagacugucaaugaggacacugucagauaaaaugccuggagaggaaauuuuagaacucuaaauugagagcaaaggaauuugcuaguugagaggguugggcauucaggaaaugugagugaaagucagaaggggaauuaggucgggcaguuaguucauguaaagaugggaaucaaaucacguugacuaugaggaaucuuaugcccucuuucauuuuuuccuuucucucuccuugaacugcccuguuuguuucaggugugguuuuuaugcugaauucuuccuuuuuucuaauuccucuuuuaccccugcaaagcauugaacccuauccagagauaacuuucacagcuaugcuuuguauccaaaccuuuugcaaugaaaaguaaacccaggagagucacuuugccaacuuuuuuucagaauuccuuagucaccauugauuacuugaagaagcagcuugugggaagcuguuuuguaagacuaaacuacauuugcugugacuacaauaucaccugucauucuguccaccaaucuacugcuaaggaaaugggacagagugcauaugaggaaguggagggcucuacugggcugcacugcuuagcucuuagcaagcugcgacucugcuucuugcucuaaucagauagauauauuuggcuucuggguuuuucuuucuucccuaggcauaugcacauuggggcuuuuuuuuuuuuuuuuuuaaagaaugagauuugaaaguggaccaugguuauucaauucccuuuuacccagaaacuuuaugcuagcaauaaucauuaauguguuuuuucuagcauauguuuuaaacuuuacuccacauuacuugauuccucagaucugacauuuuugaccagauacugguccauuagcaguauagauacaucgaagaacuaaaaggucauucuuuuguuuuguuuuuuguuuuuuugagacggagucucccucugucucccaggcuggcaugcaguggugugaucuuggcucaccgcaaccucugccuccuggguucgagugauucuccugccucagccuccccaaguagcugggacuacaggcucacgccaccacgccuggcuaagguuucaccacguuggccaggcugguuuugaacucuugaccucaggugauccgcccgccccggccucccagagugcugggauuaugggcgugagccacugcacccagccaaggucauucuuuugaguacagauggcucacaggcuagccuuugaacucugccuuuagaagggcuaugaacugcaugucuauagagcacagaagagaaccuacauaccucagcuauucgguggggcacagaaaggcugggguuuuuuuuuuuuuuagguaaccacaggaaccaggccaucugccuuagauaaauaaauuauauuauguuacauggggcauucuuuuuuaauauuaaagaacauucuucauucaaguuuugagaauuauuucuuacaggguuauugauuagccuguggcacaaugaaaagauuuucuccaagcuuaaguaccaaaaaggcuuuauacacaagaggucuuucaaaacuuuuuuuuuuuuuuuuuugagauggagucucccucugucacccaggcuggagugcaguggugcagucucgacucauugcacccuccaucuuugggguucaagugauucuccugccucaggcucucaaguagcugggauuacaggcaugcaccaccaggcccagcuaauuuuuguauuuuuaguagagacgggguuucaccauguuggccaggcuggucuugaacuccugaccucaggugauccacccaccuuggccucuugaagugcugggauuauagacgugagccacugugccuggccuaaaagauuauuuagagaaaaauuauccaauuaugagggaauaauaaaaucaugauguguccacagaauuaugcauauguuuuaaauguuucaaaguauuuauauugauuggagaaaugcuuaaaaguuaaaaaaaaaggcaggauacuaauacaguuaucugaaaagcauagaaaaguuacuagaagaaaaugcauucauauauauaugagggagucuugcaccgucaccugggcuggagugcaguggcgcagucucggcucacgcaacuucugccuccuguguguucaagugauucucccaccucagccucccaaauaacuggcaguauaagcgugagccaccaugccuggcugauugauugauugauuaauugauugauuccuuccuuccuuccuuuccucccucccuuccuuccuuuuccuuuccuuuuccuuccuuuuccuuuccuuucccuuuccuuuccuuuucuuuuuuuuugacauagucuugcugugucacccaggcuggagugcaguggugcaaucuaggcucacugcagccucugccucccaguuucaagcgauucuccugccucacccucccgaguagcugggauuacaggugcccacuaccacguccagcuaauuuuuuuguauuuuuaguagagacaggguuuuaccauguuggucaggcuggucucaacuccuggccucaagugaucugccugccucagccucccaaaguauuaggaugaugggcauggaccaccgugcccagccagaaaauauauuuauauuaacugugguuguaauugguagaacucggaucaguauuuuucuaucuacuuuucuuuuuuccacauuuucaaauuuauguuugcuuuuauaauuaaauaaacuuggcugggcaugguggcucaugccuguaaucccagcacuuugggaggccgaggugggcagaucaugaggucaggagauugagacgauccuagcuaacacggugaaacccugucuguacuaaaaauacaaaaaauuaggcugggugcagcagcucacaccuguaaucccaccacuugggaggcugaggcgggcagaucaccugaggucgggaguucgagacuagccugaccaacauggagaaaccccgucucuacuaaaaauauaaaauuagcugagcgugguggcgcaugccuguaaucccagcuacuccagaggcuggggcaggagaaucgcuugaaccagggaggcggagguugcagugagcugagaucgcgccauugcauuccagccugggcaacaagagcaaaacuccaucucaaaaaaaaaaaaaaaaaauacaaaaaauuagccgggcaugguggcgggcgucuguaguuccagcuagucaggaggcuaaggcaggagaauugcuugaacccgggaggcggagguugcagugagccgagguagugccacugcauuccagccuggaugcaagacucugucucaaaauaaauaaauaaagcaagacuuuauuuauuuauaagcagagcaagacucugucucaaaauaaauaaauaaauaagaaaaauuaaaaauuaaauaaacuuuauuuuaaaagcggccuuuccauaaugugccuuaauuuuaaaauaucccuugguauacauuacugcaggggagaugggggagaugugggagguggcugaggagucauugggcugccuguggcucgcugcagaguucaaagcaaugaguucaaguucuggcugucuuguauagugcuggcacuacucuacauucauuuuuuggaaaacagaugcaaguaaauucaauagauaacuuuaucccugguaaguccuguuaccuaaaucugguuaaaucauuuauaaagugggaguaauagcaccugccuuacaagguuggggugaggcuuaaaugauaugguacugugagucccaaaguaccaugcguauggaaagaaaccucauuaaaugaccuuucaggcuaccguagcuaaagcuguugccaguauauuuaauucauaagaaauaaucaccgugauugacaugguguuguguuuguuauauuucacaaucagagaggaccagguaaacuuccguggauucaugcgaacuuuggcucauuuccgccccauugaggauaaugaaaagagcaaagaugugaauggacccgaaccacucaacagccgaagcaacaaacugcacuguaaggagcuaaagucuucuggcuuaaaauacuugcuuuucauuucuuaaaagucauguauuuacucacucauuauuugaacaagcaucuacaagagcauacugguuaagaccucagacucuggagcuaaacuggccaagauuaaauacuagucuacccuuuuuuggucgugugacuuugggcaagguacuuaaccucuuugggcuucaguuuucucuucuguaaaauaggauacuaagggguuccacauuggauuguugugaggauuaaaugaguuaauaaaugucaagugcuucacauagugccuggcauauacuagguacuuaauaaguguuaccuaguaucauuauaauucauugagcaccuaccgugugccaggcacuguguuaagugcuagcauggcaauagugaacaagacccaggccccaccuuuaaggaauaauggcaauccucagcucaucuuagaauuugauagacacuggaugugacuuaaguaaugggggacagcuggauacagugcaagauuuaauuuuuauacccgugucucaugccucuuuuccuuuaauacuuguuugccuucccuucugcccuuauugguucauguacaauauugcccaaucccuuacaacacuucuccaggaaauugaaauuaaauuuaucuuuuuauucaguacaaguugaaauuacaguuguauuaaaacugacugaaggcugggcgcaguggcucaugccuguaaucccagcacuuugggaggccaagguagguagaucacuugagcccaggaguuugagaccagccugggcaacauggugaaacauugucucuaauaaaaauacaaaaauuagccaggugugguggcaggcaccugugcucccagguacuugggaggcugaggugggagaauugcuugagccugagagguugaggcugcaaugaaccuugauggcaccacugcacuucagcccaggugacagaaacucugucucaacaaagaaaagaaaacaaaacaaaaucuucgaaauagcacuaguggauuugggcguuacauggugucuuaggauaccuuuagcugacucagcuggcuuaaacaauagggaacuauauuagcucacuuuacaagucagauuaggccggcaggaggguugauucuguuucaagaacuagggauuuuucucuuuacucugccauccucauagucuguuuuauccuaaaguauuauggucacauggcagcucucaguuguuaacagggcuuuuuuuuuucuuguucacaucuggcaguagaggaagagagauauauauagagagagaucgagacugaaauugagcaacacuccucccaagcauggaauguaaguccuuccccucacuuugauaagucaguucaggucaggagagugcgagugccgaggagauuaggcuaaugagauuccccuccugaugcugugauugggguucugcuaaggaaaaagguuggaaugccacagaaauggcagacuucaggaugagauagaauaauaacaaagugcuaugcagguuaugcuugguuuuauuuuguuuuugcuuaauuuuuugagauagggucucacucugucacccaggcugagugcaguggcgugaucacagcucacuauggccuugacuuuccuggcucaagugaucuuuuugccucagccucucaaguugcugggaccacaggcgugugcacuacacccagcuaauuuuuuauuuucuaauuuuuuguagggacagggucucacuauguugcccagacuggucucgaaaucuuggacgcaagcagucaucccaccuuggccucccaaagugcugggauuacaggcaugagccuccauacccagccuguuuuuuucauuacauacuuuagucuuggcuguuggauuaacuuuuauaggaagcuaaaaauuaauuagaauucuguugcagucuauguauagggaucacauucauguaauuagaccaguaaaaccgaagcuauucuaaugccaaagaaaagacuagaagaguccgagaaguccucaauuucugucuaaauguguugcuucucuuugaaguucccacagggcuguauaagcuguagcauggugccucuuacuguagacugagagcaauugaaugucauauaccuagcaauacauuugccacugagacacauuuaccuuagagaaaggggaugugggccaggugcgguggcucacgccuguaaucccagcacuuugggaggcugaggcaggcggaucaccugaggucaggaguucgagacaagucuggccaacauagugaaaccccauuucuacaaaaauacaaaaaaaauuagccaggcauaaugguggaugccuguaaucccagcuacucaggaggcugaggcgggagaauugcuugaaccugggagguggaggcuacagugagccgagaucaugccauugcacuccagccugggugauagagcgagacucugucucaaaaaaaaaaaaaaaaaaaaaaaaaaaaaaaaggagauguguuacuuagaaaucuggguuuacaggccaggcaugauggcucacgccuguaaucccagcacuuugggaggccaaggcggguggaucacuugagaucagggguucaagaccagccuggccaacauggugaaacccugucuguacuaaaaauacaaaaaauuagcugggcgugguggcgggcgccuguaaucucagguacucgggaggcugagacaggagaauacuuugaaccuggggggcagagguugcaguuagccgagauugcaccauuacucuccagccugggcaacagagcaaaacuccaucucaaaaaaaaaaaaaagaaauguggguuuacagaggaguggaaccaaauuuuauuauggguuauacuuugcauagaauacugucuucaggaacucugagaacacacuuuguucuauuucuuuucuaagccacggugagagaauuuuaaucacgaucagcaaggcugaacuaugcccauguaggcacaggcccaagcacacauagugccacucugcucuucuguuugucuccuggaagugguaccuuauugcuuuccucuuuggauuggugagguuauaauaaugcuuucuguaggccaggcgcgguggcucaugccuguaaucccagcacuuugggaggccgagguggguggaucaccugaggucaggaguucgagaccagccugaccaacauggugaaaccaugucucuucuaaaaauacaaaauuagccaggcaugguggugcaugccuguaauuccagcuacucaggagacugaggcaggagaauugcuugaaccugggaggcugauauuacagugagccgagaucacgcuauugcacuccagacugggcaauaagagugaaacuccaucucaaagaauaauaauaauaauaguaauaauagugcuuuguguaaaagguacaacccuaucuacagguggauaguguuuaaaaaaaaaaaagugaaagguauaauucaucuuaggcccagggcaugguaaguaagagagaagucuagaggucuacagguuuuccuucccacauucuaauugucuucuuaaaugguuuaaguuuuuauaacacauaaugauguggaaaguaaagagucuacauuagaauauuuuucuuggguguugaggaguauaggcggaguagagcuugggagaguagccaggaagaaauagcagcauuauucaaagaauccaaaagguagaagcaauccuaguguccaucgacagaugaauggauaaauaaaauguuguguacacauacaaugaaauauuagucuguauuaaaaaagaaaauucugaggccgggagcgguggcucacaccuguaaucccagcauuuugggaggccaaggugggugaaucaugagaucagaaguucgagaccagccuggccaauguggugaaaucccaucucuacuaaaaauacaaaaauuagccuggcauggugguggauaccuguaaucccagcuagucgggaggcugaggcaggagaauugcuugaacccaggaggcggagguugcagugagcugagauugcgccacugcacucuagcuugggcgacagagcaagacuccaucucgaaaaaaaaaaggaaauucuggcaaaugguacaacauggaugaaucuugaagacauuaugcugagugaaauaaaguggauauaaaggacaaauauuguaugauuccucuuaugugagguuuccagaguggucaaauuuguagagacagaaaguagaacggugguugcccagggcugggggauggugguggugaugguaauggaguuauuguuaaaaggguacauuuuccgcuagugaagaugcagaaguuauggggagauggaugguggugaugcuugcacaacagugugaaaguacuuaaugccacggaacuguaccuguagaaaagguuuaaaugauacauuuuauguauauuuuaccacaauaaaaaaaaaagaagcagccgggcaugguggcuuauuccuguaaucccaacacuuugggaggccaaaguaggcagauugcuugaggucaggaguuugagaccagcuuggcuaacauggugaaacccugucucuacuaaaaauacaaaaauuagcugggugugguggcacauaccuguagucccagcuacucaggaggcugagacaggaaaauugcuugaacccgggaggcagagguuucagugaccugagaucgcgccacugcacuccagccugggugacagagcaagacuccgucucccaaaaagaaaaaaaaaaaagaagcaauagcauugauugaaguaaagguaaagguuuguagccugggcaacagagccugggcaacagaaccugggcaacaguaucuacaaaaaaaaaaaaaauugagcugggcaugguggcacaugccuguauuccuagcugcucaggaggcugaggcaggaggaucacuugagcccagaaguuugggucugcagugagccaugauugcaccacugcacuccagugacagagugaggcccuaucucuuaaaaaaaaaaaaaaaaaagcauaaaaaaggaagguaaagguuugacugagaucauuccuuugguuuuucauuaaacaaauguuugagcaccuacuacaugccagguacuauuuuaggcccaggauacagugaugaauaaaucagguaaggcccuugcuuucuuagaacuuaugaucuaauaagagagacagacuauagagaagacgggugaauaaacaagauuuauuguggugacaaggucugugaaggaagugaauacaugagaugagaaaggcauagggagaugucacuauagaaagaguggucagugaaaaccucucugaggaguugaaauuugagcugaaggcccaggcacaguggcuuacaccuauaaucccagcacuuugggaggcugaggcaggaggauugcuugagcccagguguucaagaccagcugucugggcgcaguggcucaugccuguaaucccagggcuuuggcaggcugaggcagguagaucacaaggucaagagaucgagaccauccuggccaacauggugaaaccccaucucuacuaaaaauacaaaaauuagcugggcgugguggcacaugccuauaaucccagcuacucgggagucugaggcagaauugcuugaacccgggaggcggagguuacagugaaccgagaucaugccacugcacuccagccugggcgacagagcaagacuccaucucaaaaaaaaaaaaaauucaggccaggcgcgauggcucacgccuguaaucccagcacuuugggaggccgaggugguuagaucaugcgguuagaucaugagguuaggagaucgagaccauccuggcuaacacggugaaacccugucuguacuaaaaacacacacacaaaaaauuagccaggcgugguggugggcgccuguagucccagcuacucgggaggcugaggcaggagaauggcgugaacccaggaggcggagcuugccgugagcugagaucccaccacugcacuccagccugggcaacagagcaagacucugucucaacaacaacaacaaaaaacaauuuaucuagacaaagaccuugcaccuuucaccagccugggcaacacagugagacccuagcucuacaaaaauuuuuaaaaauuagccagguguggugucuguggucccaacuacucuggaggcugaggugagaggauccuuugagccugggagguugaggcuguagugagucaugauugugcuacugcacuccagccugggagacagagcaggacccugucugaaaaaaauaaauaaauaaaauaaaauaaaccaaccaaauuaaacagagcagaaaaaaaaauacauauauaugaagucucuccuagcuacuuccuuucucuggaauucugauauauaccuuacaaggaguaaauuagauuuuaaaauuacuuuuaugucaucuuaguggacucaccauuuuauuuuggaggggagugauauuuaaaccuguagauauuaauccauguucuuaugccuuugugccuaauaaucgcucugccuggaaugaccaccccuugucucauuucuguuugucuuucaaggccuuguucaaauguuaccucuccuugauauuuccccagcugcaccagaaagccacgucugccauacacuuuguucccccagcauuuuggauauguuguagugcuuaggauguacucgagagucgugugucuugcccuccucuacuagauagugaguuccuaaggacagagucuaaauccauggaucuuaauagcucuagagcaguggauucgggccuuuuaguauuugcagcacucuauuuaagacccuuaaucuuaguggcauucuugaagugauucaaaaccuaaaaaccaagcuaaauucaguugugggacaagacauucacauccucaggcuggcgauuugucacggcaccuauaaaaucacccaguguuaucacccuauucucuugguagcccuucagcaacauggcagaaaucuaaugauuuugcuuucugauuccuaucucauggacccaagcaaaguucuccuaucuccuaguuucuagaaggcuuaaagagaaagaaacaugauaaagccaggagaccaucugagccaucauauuuauuugaaacucaauuucuuuaccuccaggacucccaagugguagagaauuacuugaaauuugagacaauuuugcccaggaggcucuauucccaaagcuguggucagcucucauggugccuguguggugccuauuguugguuuucccugagugguaccugguagauuugauguuugugugaggugaccuaauuuacagaaccacguaaggaguguuuugggggggggcguuuaacauucuagguuaagaaaaaggacauuuggcuuucuuuguaugaaguuuucugauuuguuggaagagggaccauacuucaucuaaucuaagaacucaucaauucucaauucuucaguguuacaacuuuuuaaaagcccuacaaguaauggcaauuguucuuggaaaaucgauuaauuggcugucaguuuucugucuagugucuuauauauuuaguuccuugagaaggggcaacacacuacagaauuuugacuaacuuuguguuuuucccuuacaguugcuuuucgacuauaugauuuggauaaagaugaaaagaucucccgugaugagcuguuacagguauguggagagcuccucgagaacuugugcuuggacucugccugcuuauuagugugggcaggaacuauucuuuccuuuaguaagcauuuauuuaauaccugcuaugugcagaguccuguccugguuauaagacaaaggagaugaccugggaaaacuugaaauggcucauuguguuuucauagacagaugucuccacuauuuaaaagcuaacuaggcugggcaugguggcucacgccuguaaucccagcauuuugggaugccaaggcaggcagaucaccugaggucaggaguucaagggcagccuggccaacaugguaaaaacccauuucuaguaaaaauacaaaaauuagccaucggccgggcgcuuuggcucacaccuguaaucccagcacuuuggaaggccgaggcagguggaucacgaggucaggagaucgagaccauccuggcuaacauggugaaacccugucucuacuaaaaauacaaaaaauuagccgggugugguggcgggcaccuguagucccagcuacuccggagacugaggcaggagaauggcaugaaccugggaggcggagcuugcagugagcagagcucacuccacugcacuccagccugggcgacagagcaagauuccgucucaaaaaaaaaaaaaaaaaaaaaaaauuagccgucugugguggugggugccuguaaucccagcugcucgggaggcugaagcaguagaaucgcuugaacccaggagguggagguugcagugagccaagaucgugccacugcacuccagccugagcgacaagagugaaacuccaucccaaaaaagaaaaaaauaaguaaauaaauaaaagcuaacuaaauggcuuuuagguacugucugagauuuacaucagauaauucaguuauugccaaaucagauuauuggcagccagguaauucugaugacacuuaguuaaaugcuguuauuuagucuguccuuaggguugacuaagagucaaggagcugcugcugugcugguguacccugagcuaacugccacuguucuuuguugcuccuagggauaauucccuguuuuccuacuagcagugacuggcauuucauccuaggaugaaauuacucagggcagauucaggagcaacccaacguauucuuacauuucuaucagcaaaaaccaaaacagucuucaggucaguguuagcgucccuugcuuuugaguugggaauuucuucagcgagaagcguuuauuuucuugaaaguugccacauaugggcuucuguguucugaagaaaaaaagacaguagcagucacucuauaguugcauguguuuaugcucuggcccagaucugaccucagguuauccacccgccucggccucucaaaguguugggauuacaggcgugagccaccacgcccggcccauguuuucuuaauaugauucuugugaaaguccugguugaacuuuuggaggucauuaucuugauugugaggauggugccauggguggguacauauguuaaaccuuauccaauuguacauuuuauuuauuuauuuauuuauuuuguauuuuuaguagagacgggguuucagcauauuggccaggcuggucucgaacuccuaaccucaagugauccacccaccucggccucccaaagugcugggaguacaagcacgagccaucaugccuggccccaacuguccauuuuaaauauguacagcuuauuguauauuauuuauacuucaauaaagauaguuacucuucuccccaacucauuuuaugaggcuagcguaacuuuugccugagaauuuuuuuguuuuguuuuguuuuguuuuuugagagagucucacuuugucgccugggcuggagugaauaucaccaucucagcucacugcacccuccgccacccagguucaagcgauucucgugccucagccuccugaguaacugggauugcagacaugcaccaccauacccagcuaauuuuuguguuuuuaguagagaugggguuucgccauguugaccaggcuggucucgaacucuugggcucaagcaguucgcccacuucagccucccaaagugcugggauuacaggcgugagccaccguacccagccacaccugucaaucuuauagaagacagcguaagaaaagaaaauuaggggccaggcgcaguggcucaugccuguaaucccagcacuuuuggaggccgaggcagguggaucccgaggucaggagaucgagaccauccuggcuaacauggugaaaccccgucuccccugucucuacuaaaaauacaaaaaauuagccgggcauggugguggacaccuguagucccaguuacucgggaggcugaggcaggagaauggugugaaccuaggaggcggagcuugcagugagccgagaucacgcuacugcacuccagccugggcaacagggcgagacuccgucucaaaaaaaaaagaaaagaaaagaaaauuauagcccaaucucuuuuacucacauaguuguaaaaauccuaaacaaaauauuaacacacugaauccagcaauauaaaauauaauauauauauauuuaaagccaaagauguauuaaagccaaggauguauuauagccaaggugcaauuauacuagaaauucaaaguugguuuaacauuagaaaaucaaccaauauauuucacccacaccaacacuuuaaagaagaaaaacugaguggucuuuuccauagaaaaauguaauugauaaaauucaccauccauucauuuuauuuuauuuacuuauuuaucuuuuuuucuggagacgguguuucacucugucgcccaggcuggagagcaguggcgugaucucagcucacuguaacauccgccucccaaguucaagcgauucuccugacucagccuccaguguagcugggauuauaggcaugcgccaccacacacagcuaauuuuguauuuuuaguagagacgggguuucaccauguuggucaggguggugucgaucuccugacuucaggugauccaccugccucggccucccaaagugugugagccagcuugccuggccucaccauccauucaugauuuaaaaaaaaaaaaaagaagucuuagaaaaucagaaguagagggaaccuuucuuaaaucgauaaagaauauauauauaaacccucaccaaacauuaaaaauaauaguaggcugggugugguguuucacuccuguaauuccagcuacucgggaggcugaaguaggagaaucgcuugaaaccaggaggaggagguugcagugagcugagaucaugccacugcucuccagccugggcgacagagcaaaacucugucuuaauaauucacuaauaaacuucuuuuuuuuuauuuuuuugagacggagucucgcucugucgcucgggcuggagugcaauggcgcgaucucaacucacugcaaccuccgccucccggguucaagugauucucccgccucagccuccugaguagcugggacuauaggcaccugccaccacgccuggcuaauuuuuguauuuuuaguagagacgggguuucaccguauuggccaggcuggucuugaacuccugaccuugugaucagcccaccuuggccucccaaagugcugggauuacaggcaugagccaccgcaccuggccuaauaacuuuugacuggaacaauaaguggcaacauggacagguagagggagcacugagcugggaauggaggccugggcagauagcucaugccacugguuccugggaccugagucaagccaccucugggcuguuucauguccuuauuaacagaucggaugagauaaccuuuuuuuucuuuuuugagacagucucacuacauuucccaggcuggcuugaaugcuuaggcucaagugauccucuggccuuagccuuccaaguagguggguccaguagcugggacuacaugcaugugucacugcaccuggugaaaugauguuaaagacaccacuacuuuuaucccgacccuccgacucacacuauagauacccauacauaauccaguuuucuaauucuacaaauaaaacaccucagaaaaauuuggucugggaucugaagaagcugcugucugagguuggauucaucugcuuggcaacacacagggaauguggcaaauggguugucuauugauuaucuuugcuagcauugucuuuguuuuuuuuuuuuuuuuuugagauggagucucgcucuguugcccaggcuagagugcaguggcaugaucucagcucacugcgaccuccaccucccggguucaagugacuguccucccauagccuccugaguagcugggauuauaggcgcgcacuaccaugcccggcuaauuuuuguauucuuagucgagacggguuucaccauguuggucaggcuggucuccaacuccugaccucgucauccaccugccucagccucccaaaguccugggauuacaggcgugagccaccacauccggugcauugucucuuuuuauuaauucuucuauugggguacauuuguaccuaaaauguacaacuuccaauuuucuuuucuuuuuuuucguuugagagggagugucuuucuugucgcccaggcuggaaugcaauggaguaaucucggcucacugcaaccuccaccuucuggguucaagcgauucugccucagccucccaaguagcugggauuacaggugcccgccaccaugccuagcuaauuuuuguauuuguaguagagaugggguuucaccauguuggcuaggcuggugucaaacuccugaucucagaugaucugccuaccucggccucccaaagcuuugggauuacaggugugagccaccacccccggccaaaacuucugauuuucaagaauugguuuauuuaaaaaauaaucaguuuggauacaaaucaguauuucagcuuuuuuucuuuuuagaaaaucauguaauuuacuauugauggauugguugauugacugauagggucucccucugcugccuacucuggagugcagcaacuauucacaggcaugaucauagcacacugcagccuugaacuccugggcucagaccauccuccugccucagccgccugaguagcugguacuauaggcaugcacuaccacaccuggcuuguaauuucgcucuuguugcccagccuggagugcaauggugcaauuuuggcucaccacaaccucugccucccggguugaagcgauucucaugccucagccucccgaguagcugggauuacagguaugcaccaccacgcccagcuaauuuuguauuuuuaguagagaugggguuucuccaccaugcccggcccaugaaaucgauuuuuaaaaaguaaauuacaggccgggcgcaguggcucacgccuguaaucccagcacuuugggaggccgaggcaggcggaucaccugaggucgggaguucgagaccagccugaccaacauggcaaaaucccgucucuacuaaaaauacaaaaauuagccaggcaugcuguugggcaccuguaaucccagcuacucgagaggcugaggcaggagaaucgccugaaccugggagguagagguugcaguaagccaagaucgugccauugcauuccagccugggcaacagagugagacuccaucucaaaaaaaaaaaaaagaaucuauuucaugagauuguagaagggaguaaaggaguggaggaaaggaagucuaugagccacugggcuagaggcccuuuccuuucuguggaaaagcucaguucuugccaucugaagacagagguggcugacugcaauaauaauauaaggagucagaaagguacccugucucccauuucauauugccuaagaaccagccuuuccauauugccugacagucaaauuguuaaaguugcuuauuuuguuuaaggaagcaauuuucaaaguauguucacacccuaaagguguuaauagaauucccaggggcccaaggauugguuaaguuuaagacagauuuggugaaacaguguuaaauucucuuacucaauucucgcagccuuuuaauugugcuuguuauuuuucucagaaggggauuuagcauuuaacucuucaaggauuuuuauguuuucuugggccauacuuuaggaauaguuggcuuaaugcagcacuucgaagaggacgacauuuugggugggauuucagaaagccccaccaaacugauuuaaaucaauaaggaacuaguuaggcucacgcaacaagaauguuuggcauagauuguccaggcugguacaguaccuaacugauguccaggaaccaggcuuauucuguguuccugcccuggcauccauagcucauauuacucaccucauggcuccaggguggcugcagugccaccagacagaaugagguaagaagaaugaggaagggcaaaaugcaaaggacucucccuuagucuuugucuucuuauccagucaccuagauaaguucugcuuacaucauugccuagaugagaagauaaagguuucagccuuuuagcuguuacuuagucacaugaugguaaagauggggauacauucugagauaugcaauguuaggcaauuuuguaguuguaggaacaucauagaauguaccuacaugaaccuagaugguauagccuacuacacaccuaggcuaugugguguggccuauuguuccuagacuacaaacccgugcagcaaguuacuguucugacuacuauaugcaguuguaacauaaugguaaguauuuguguaucuaaacauaucuguggcugggcaugguggcucacgccuauaaucucggcacuuugggagguggcagagggagaauugcuugagcccaggaguugaaggccugccugggcaacacagugagaccucauuccuacaaaaaaauuuugaaaaauuagccaaguggcugggcgcaguggcucacacuuguaaucucagcacuuugggaggcggaggcgggcagaucaugaggucaggaguucgagaccagccuggccaacauggcgaaaccccaucucuacuaaaaauacaaaaauuagcuggguguggugucacaucccuguaaucccagcuacucgggaggccgaggcaggggaaucgcuugaacuggggaggcagagguugcagugagccgagaucgugccauugcacuccagccugggcaacaagagugaaacuccgccucaggaaaaaaaaaaaaaaaaggcaugguugcacacaccuguaguguaguaccaguuccuugggggaggcugaggugagaggaucacuugagcuucggaggugaggcugcagugagccacauucgcaacccagcacuccagcuugggcaacagagcgagacccugucucaaaaaaaaaacccaaaaacaaauacuuacaucuaaacauggaaaagguacaguaaaaauaugguauuguaaucuuuuuuaacaaauuuuuuggccgggcgcaguggcucaugccuguaaucccagcacuuugggaggccgaggugagcggaucacgaggucaggagaucgagaccauccugucuaacaugcugaaaccccaucucuacuaaaaauacaaaaaauuagccuagccgggcacgguggcaggcgccuguaauccuagcuacgcaggaggcugaggcaggagaacggcgugaacccgggaggcagagcuugcagugagcugagaucgugccacugcccuccagccugggcaacagagugagacuccgucucaaaaaaaaaaaaaaaaaaggaaaaaaaauuuaacuuuuagguucagggcuacauaugcagguuaguuauguagguaaacucuugucauggggguuugauguacagauuauuucgccacccauguacuaagccuaguacccaguaguuauuuuuucuguuucucucucaccuccuacuccacccucugguaggccccagugucugugguuccccuuuuugugucuauguguucucaucaaaauacaguauuauaaucuuauagcaccaccauuauauaugcagucggucauuaaccaaaacauuauuaugcagugcaugacuguauuugagggcaucaaaggaaaaggaggauggugauagcuuuauuuuuaaucuuaguaaagagucccucugauucccaaggcccuuguaauuccuggcucuuggucuuccaggugcuacgcaugauggucggaguaaauaucucagaugagcagcugggcagcaucgcagacaggaccauucaggaggcugaucaggauggggacagugccauaucuuucacagaauuuguuaagguuggucacuuacuucuuguuugaaaaaguuacguuuuaguggcugggcgcgguggcuuacgccuguaaucccagcacuuuaggaggccaaggugggcggaucacgaggucaggaguucaagaccagccuggcuaacauggugaaaccucaucuguacuaaaaauacaaaaauuagccaggcgugguggcgcgugccuguaaucccagcuacuugggaggcugaggcaggagaaucgcuugaacccaggaggccaagguugcagugagccgagaccacaccacugcacuccagccuggcaacagagugagacucugccuccaaaaaaaaaaaaaaaaguuacguuuuacugcacaggaggaaggggggaaaacauuacucagauaagagcuugggaguguuguaaucuucauaaccuuuguaacuguuacugguuuucucccccagguuuuggagaagguggauguagaacagaaaaugagcauccgauuucuucacuaaaggagaccaaacuguuccuugcggucuaguauuuaagaacuggaacuugaaaguccuccuucuaccaacuccaccuccacccccucauuccccuucucccaaaguacuacugcuguugcaugacaaccccaaauauguucugucaacacaaaccugccuuugguguauaaacagggcauuacagaaugguacacccuauauauuucuguucaguauccauucacuaguucuucauuuauaaauaucaucuuccccauucugcugcugaaugccacacauccauccagucugagaaagugagagaggcaaucaugccaagaacaagccagcaaagcucuuucaccagauguagacuguagcccugcugccuucccuccagcgagucugccagcaugcuucuucauccuuuuuauauguucuuugcuuccuacuucccugucuuccaacauacuguucacuuacucuggcagucuuucugcuuuucauuaagccucaaaaucuccucuguucuacuuggcaccacaagcuauguccuauauauguauuucugacuuggcaggauaguucaggggucuggcaguuuuuauuuaccuucauuauuaaaugggccucugggauguugccucuucaggagcuuuuugguaaucaauacuucucucagaaguaugagaccauccucugcacucugcucugucaucaaaggcugcuggguggagauacccuuuuugaaagguggccuuggugagagguauggagccaagucuucuagguugcuugcccacaucacucuaucucuggccucugauucucaacuuuguaccuguguggcuccucuuguuagugcaauguugacuguugaaaaagcagcaguaugcuuacagguuugcuuaguuuggggacaccguuaccaccagaauggcugcucugacaauaugccuagggacuuucucauggcuuuuauuuaauaaggaggcugggcacccuauaaagccucaugcauucacaccuuugcagcaugguuuaugccucaguguuaugugcacuggaauguuuuccacuucacauuuccaaguagaaauauuaguguuacggaagugccuaauaucccaguccaaauuuuuuuuuuuuuuuuuuuuuuuuuuugagacagagucuugcucugucacccaggcuggagugcaguggugcgaucgcucacugcaaccucagccuccuggauuuaagugauucuccugccucagccucccaaguagcugggauuacaggugugcaccaccaugcccggcuaauuuuuuguauuuuuaguggagacaggguuucaccauguuggccaggcuggucucgaacuccugaccucgugauccgccugccucagccucccaaagugcugggauuacaggugugagccaccacgccuggccccaguccaaaauauuuaaagauuguuuccuuagugucuugaaguuuugcacaaaauucuuuuuuuugagauggagucucacucugucacccaggcuggagugcaguggcgugaucuuggcucacugcaaccucugccuccuggguucaagcaauucucccaccucagccucccaaguagcugggauuacagacgugugccaccauaccuggguaauuuuugcauuuuuaguggagagggaguuucaccauguuggccagguuggucuugaacuccugaccucaggugauccuccugccucggccucccaaagugcugggauuacaggcaugagccaccgugcucagccgcaaaauucuuuaugaauuuuacacuuggcaaauguuaaugacggaagccauagucugcuccuaauacauguccaaagcauugacuguugugucauuagcugccugguuacauuagcucccuggcuucuuguuuagaccacugcuaaucccuuaaaaacaagaggucuggcacuaguagcacaaccuaagguggcauuacagaucuuugagcgagccacagcaacuuuucugccaagucagcuuaguuuagacuucagugaaucaggcuauugcuauccuaauguaugucucuaugaguguauuuagccacacaucugcccuugguugacuuucugacucauugcuugcuugcuuguuuccuugcuuuggaaaacuauugaagauugcuaaaaaauaccacugcaaagugauggaaaaggguggagaacaggggaguagccaggcuggauggcucaaauauaaaugaaugaggaauucuuuaugaaguaucagucagauuuuaugauuaagugauguaauauaggaauuauguaaaagggaagaaugucugauacugaucuauuagagagguacuuuagaggcuucuugauuggcauaaaguuccuaagguuauagauuuuccccccuuuuggcuguauagcaaaguguuuuaauccacgguugugccuuauuguuccauuaaaauuguaucuucgauccaucaauaaauacuugugguugaaacaa

SEQ ID NO: 191222 - RNA, 50647 nt, Homo sapiens
uuguuucaaccacaaguauuuauugauggaucgaagauacaauuuuaauggaacaauaaggcacaaccguggauuaaaacacuuugcuauacagccaaaaggggggaaaaucuauaaccuuaggaacuuuaugccaaucaagaagccucuaaaguaccucucuaauagaucaguaucagacauucuucccuuuuacauaauuccuauauuacaucacuuaaucauaaaaucugacugauacuucauaaagaauuccucauucauuuauauuugagccauccagccuggcuacuccccuguucuccacccuuuuccaucacuuugcagugguauuuuuuagcaaucuucaauaguuuuccaaagcaaggaaacaagcaagcaagcaaugagucagaaagucaaccaagggcagauguguggcuaaauacacucauagagacauacauuaggauagcaauagccugauucacugaagucuaaacuaagcugacuuggcagaaaaguugcuguggcucgcucaaagaucuguaaugccaccuuagguugugcuacuagugccagaccucuuguuuuuaagggauuagcaguggucuaaacaagaagccagggagcuaauguaaccaggcagcuaaugacacaacagucaaugcuuuggacauguauuaggagcagacuauggcuuccgucauuaacauuugccaaguguaaaauucauaaagaauuuugcggcugagcacgguggcucaugccuguaaucccagcacuuugggaggccgaggcaggaggaucaccugaggucaggaguucaagaccaaccuggccaacauggugaaacucccucuccacuaaaaaugcaaaaauuacccagguaugguggcacacgucuguaaucccagcuacuugggaggcugaggugggagaauugcuugaacccaggaggcagagguugcagugagccaagaucacgccacugcacuccagccugggugacagagugagacuccaucucaaaaaaaagaauuuugugcaaaacuucaagacacuaaggaaacaaucuuuaaauauuuuggacuggggccaggcgugguggcucacaccuguaaucccagcacuuugggaggcugaggcaggcggaucacgaggucaggaguucgagaccagccuggccaacauggugaaacccugucuccacuaaaaauacaaaaaauuagccgggcaugguggugcacaccuguaaucccagcuacuugggaggcugaggcaggagaaucacuuaaauccaggaggcugagguugcagugagcgaucgcaccacugcacuccagccugggugacagagcaagacucugucucaaaaaaaaaaaaaaaaaaaaaaaaaaauuuggacugggauauuaggcacuuccguaacacuaauauuucuacuuggaaaugugaaguggaaaacauuccagugcacauaacacugaggcauaaaccaugcugcaaaggugugaaugcaugaggcuuuauagggugcccagccuccuuauuaaauaaaagccaugagaaagucccuaggcauauugucagagcagccauucuggugguaacgguguccccaaacuaagcaaaccuguaagcauacugcugcuuuuucaacagucaacauugcacuaacaagaggagccacacagguacaaaguugagaaucagaggccagagauagagugaugugggcaagcaaccuagaagacuuggcuccauaccucucaccaaggccaccuuucaaaaaggguaucuccacccagcagccuuugaugacagagcagagugcagaggauggucucauacuucugagagaaguauugauuaccaaaaagcuccugaagaggcaacaucccagaggcccauuuaauaaugaagguaaauaaaaacugccagaccccugaacuauccugccaagucagaaauacauauauaggacauagcuuguggugccaaguagaacagaggagauuuugaggcuuaaugaaaagcagaaagacugccagaguaagugaacaguauguuggaagacagggaaguaggaagcaaagaacauauaaaaaggaugaagaagcaugcuggcagacucgcuggagggaaggcagcagggcuacagucuacaucuggugaaagagcuuugcuggcuuguucuuggcaugauugccucucucacuuucucagacuggauggauguguggcauucagcagcagaauggggaagaugauauuuauaaaugaagaacuagugaauggauacugaacagaaauauauaggguguaccauucuguaaugcccuguuuauacaccaaaggcagguuuguguugacagaacauauuugggguugucaugcaacagcaguaguacuuugggagaaggggaaugaggggguggagguggaguugguagaaggaggacuuucaaguuccaguucuuaaauacuagaccgcaaggaacaguuuggucuccuuuagugaagaaaucggaugcucauuuucuguucuacauccaccuucuccaaaaccugggggagaaaaccaguaacaguuacaaagguuaugaagauuacaacacucccaagcucuuaucugaguaauguuuuccccccuuccuccugugcaguaaaacguaacuuuuuuuuuuuuuuuuggaggcagagucucacucuguugccaggcuggagugcagugguguggucucggcucacugcaaccuuggccuccuggguucaagcgauucuccugccucagccucccaaguagcugggauuacaggcacgcgccaccacgccuggcuaauuuuuguauuuuuaguacagaugagguuucaccauguuagccaggcuggucuugaacuccugaccucgugauccgcccaccuuggccuccuaaagugcugggauuacaggcguaagccaccgcgcccagccacuaaaacguaacuuuuucaaacaagaaguaagugaccaaccuuaacaaauucugugaaagauauggcacuguccccauccugaucagccuccugaaugguccugucugcgaugcugcccagcugcucaucugagauauuuacuccgaccaucaugcguagcaccuggaagaccaagagccaggaauuacaagggccuugggaaucagagggacucuuuacuaagauuaaaaauaaagcuaucaccauccuccuuuuccuuugaugcccucaaauacagucaugcacugcauaauaauguuuugguuaaugaccgacugcauauauaaugguggugcuauaagauuauaauacuguauuuugaugagaacacauagacacaaaaaggggaaccacagacacuggggccuaccagaggguggaguaggaggugagagagaaacagaaaaaauaacuacuggguacuaggcuuaguacauggguggcgaaauaaucuguacaucaaacccccaugacaagaguuuaccuacauaacuaaccugcauauguagcccugaaccuaaaaguuaaauuuuuuuuccuuuuuuuuuuuuuuuuuugagacggagucucacucuguugcccaggcuggagggcaguggcacgaucucagcucacugcaagcucugccucccggguucacgccguucuccugccucagccuccugcguagcuaggauuacaggcgccugccaccgugcccggcuaggcuaauuuuuuguauuuuuaguagagaugggguuucagcauguuagacaggauggucucgaucuccugaccucgugauccgcucaccucggccucccaaagugcugggauuacaggcaugagccacugcgcccggccaaaaaauuuguuaaaaaagauuacaauaccauauuuuuacuguaccuuuuccauguuuagauguaaguauuuguuuuuggguuuuuuuuuugagacagggucucgcucuguugcccaagcuggagugcuggguugcgaauguggcucacugcagccucaccuccgaagcucaagugauccucucaccucagccucccccaaggaacugguacuacacuacaggugugugcaaccaugccuuuuuuuuuuuuuuuuccugaggcggaguuucacucuuguugcccaggcuggagugcaauggcacgaucucggcucacugcaaccucugccuccccaguucaagcgauuccccugccucggccucccgaguagcugggauuacagggaugugacaccacacccagcuaauuuuuguauuuuuaguagagaugggguuucgccauguuggccaggcuggucucgaacuccugaccucaugaucugcccgccuccgccucccaaagugcugagauuacaagugugagccacugcgcccagccacuuggcuaauuuuucaaaauuuuuuuguaggaaugaggucucacuguguugcccaggcaggccuucaacuccugggcucaagcaauucucccucugccaccucccaaagugccgagauuauaggcgugagccaccaugcccagccacagauauguuuagauacacaaauacuuaccauuauguuacaacugcauauaguagucagaacaguaacuugcugcacggguuuguagucuaggaacaauaggccacaccacauagccuagguguguaguaggcuauaccaucuagguucauguagguacauucuaugauguuccuacaacuacaaaauugccuaacauugcauaucucagaauguauccccaucuuuaccaucaugugacuaaguaacagcuaaaaggcugaaaccuuuaucuucucaucuaggcaaugauguaagcagaacuuaucuaggugacuggauaagaagacaaagacuaagggagaguccuuugcauuuugcccuuccucauucuucuuaccucauucugucugguggcacugcagccacccuggagccaugaggugaguaauaugagcuauggaugccagggcaggaacacagaauaagccugguuccuggacaucaguuagguacuguaccagccuggacaaucuaugccaaacauucuuguugcgugagccuaacuaguuccuuauugauuuaaaucaguuugguggggcuuucugaaaucccacccaaaaugucguccucuucgaagugcugcauuaagccaacuauuccuaaaguauggcccaagaaaacauaaaaauccuugaagaguuaaaugcuaaauccccuucugagaaaaauaacaagcacaauuaaaaggcugcgagaauugaguaagagaauuuaacacuguuucaccaaaucugucuuaaacuuaaccaauccuugggccccugggaauucuauuaacaccuuuagggugugaacauacuuugaaaauugcuuccuuaaacaaaauaagcaacuuuaacaauuugacugucaggcaauauggaaaggcugguucuuaggcaauaugaaaugggagacaggguaccuuucugacuccuuauauuauuauugcagucagccaccucugucuucagauggcaagaacugagcuuuuccacagaaaggaaagggccucuagcccaguggcucauagacuuccuuuccuccacuccuuuacucccuucuacaaucucaugaaauagauucuuuuuuuuuuuuuugagauggagucucacucuguugcccaggcuggaaugcaauggcacgaucuuggcuuacugcaaccucuaccucccagguucaggcgauucuccugccucagccucucgaguagcugggauuacaggugcccaacagcaugccuggcuaauuuuuguauuuuuaguagagacgggauuuugccauguuggucaggcuggucucgaacucccgaccucaggugauccgccugccucggccucccaaagugcugggauuacaggcgugagccacugcgcccggccuguaauuuacuuuuuaaaaaucgauuucaugggccgggcaugguggagaaaccccaucucuacuaaaaauacaaaauuagcugggcgugguggugcauaccuguaaucccagcuacucgggaggcugaggcaugagaaucgcuucaacccgggaggcagagguuguggugagccaaaauugcaccauugcacuccaggcugggcaacaagagcgaaauuacaagccaggugugguagugcaugccuauaguaccagcuacucaggcggcugaggcaggaggauggucugagcccaggaguucaaggcugcagugugcuaugaucaugccugugaauaguugcugcacuccagaguaggcagcagagggagacccuaucagucaaucaaccaauccaucaauaguaaauuacaugauuuucuaaaaagaaaaaaagcugaaauacugauuuguauccaaacugauuauuuuuuaaauaaaccaauucuugaaaaucagaaguuuuggccgggggugguggcucacaccuguaaucccaaagcuuugggaggccgagguaggcagaucaucugagaucaggaguuugacaccagccuagccaacauggugaaaccccaucucuacuacaaauacaaaaauuagcuaggcaugguggcgggcaccuguaaucccagcuacuugggaggcugaggcagaaucgcuugaacccagaagguggagguugcagugagccgagauuacuccauugcauuccagccugggcgacaagaaagacacucccucucaaacgaaaaaaaagaaaagaaaauuggaaguuguacauuuuagguacaaauguaccccaauagaagaauuaauaaaaagagacaaugcaccggaugugguggcucacgccuguaaucccaggacuuugggaggcugaggcagguggaugacgaggucaggaguuggagaccagccugaccaacauggugaaacccgucucgacuaagaauacaaaaauuagccgggcaugguagugcgcgccuauaaucccagcuacucaggaggcuaugggaggacagucacuugaacccgggagguggaggucgcagugagcugagaucaugccacugcacucuagccugggcaacagagcgagacuccaucucaaaaaaaaaaaaaaaaaacaaagacaaugcuagcaaagauaaucaauagacaacccauuugccacauucccuguguguugccaagcagaugaauccaaccucagacagcagcuucuucagaucccagaccaaauuuuucugagguguuuuauuuguagaauuagaaaacuggauuauguauggguaucuauagugugagucggagggucgggauaaaaguaguggugucuuuaacaucauuucaccaggugcagugacacaugcauguagucccagcuacuggacccaccuacuuggaaggcuaaggccagaggaucacuugagccuaagcauucaagccagccugggaaauguagugagacugucucaaaaaagaaaaaaaagguuaucucauccgaucuguuaauaaggacaugaaacagcccagagguggcuugacucaggucccaggaaccaguggcaugagcuaucugcccaggccuccauucccagcucagugcucccucuaccuguccauguugccacuuauuguuccagucaaaaguuauuaggccaggugcgguggcucaugccuguaaucccagcacuuugggaggccaaggugggcugaucacaaggucaggaguucaagaccagccuggccaauacggugaaaccccgucucuacuaaaaauacaaaaauuagccaggcgugguggcaggugccuauagucccagcuacucaggaggcugaggcgggagaaucacuugaacccgggaggcggagguugcagugaguugagaucgcgccauugcacuccagcccgagcgacagagcgagacuccgucucaaaaaaauaaaaaaaaagaaguuuauuagugaauuauuaagacagaguuuugcucugucgcccaggcuggagagcaguggcaugaucucagcucacugcaaccuccuccuccugguuucaagcgauucuccuacuucagccucccgaguagcuggaauuacaggagugaaacaccacacccagccuacuauuauuuuuaauguuuggugaggguuuauauauauauucuuuaucgauuuaagaaagguucccucuacuucugauuuucuaagacuucuuuuuuuuuuuuuuaaaucaugaauggauggugaggccaggcaagcuggcucacacacuuugggaggccgaggcagguggaucaccugaagucaggagaucgacaccacccugaccaacauggugaaaccccgucucuacuaaaaauacaaaauuagcugugugugguggcgcaugccuauaaucccagcuacacuggaggcugagucaggagaaucgcuugaacuugggaggcggauguuacagugagcugagaucacgccacugcucuccagccugggcgacagagugaaacaccgucuccagaaaaaaagauaaauaaguaaauaaaauaaaaugaauggauggugaauuuuaucaauuacauuuuucuauggaaaagaccacucaguuuuucuucuuuaaaguguuggugugggugaaauauauugguugauuuucuaauguuaaaccaacuuugaauuucuaguauaauugcaccuuggcuauaauacauccuuggcuuuaauacaucuuuggcuuuaaauauauauauauuauauuuuauauugcuggauucaguguguuaauauuuuguuuaggauuuuuacaacuaugugaguaaaagagauugggcuauaauuuucuuuucuuuucuuuuuuuuuugagacggagucucgcccuguugcccaggcuggagugcaguagcgugaucucggcucacugcaagcuccgccuccuagguucacaccauucuccugccucagccucccgaguaacugggacuacagguguccaccaccaugcccggcuaauuuuuuguauuuuuaguagagacaggggagacgggguuucaccauguuagccaggauggucucgaucuccugaccucgggauccaccugccucggccuccaaaagugcugggauuacaggcaugagccacugcgccuggccccuaauuuucuuuucuuacgcugucuucuauaagauugacagguguggcuggguacgguggcucacgccuguaaucccagcacuuugggaggcugaagugggcgaacugcuugagcccaagaguucgagaccagccuggucaacauggcgaaaccccaucucuacuaaaaacacaaaaauuagcuggguaugguggugcaugucugcaaucccaguuacucaggaggcugaggcacgagaaucgcuugaaccuggguggcggagggugcagugagcugagauggugauauucacuccagcccaggcgacaaagugagacucucucaaaaaacaaaacaaaacaaaacaaaaaaauucucaggcaaaaguuacgcuagccucauaaaaugaguuggggagaagaguaacuaucuuuauugaaguauaaauaauauacaauaagcuguacauauuuaaaauggacaguuggggccaggcaugauggcucgugcuuguacucccagcacuuugggaggccgagguggguggaucacuugagguuaggaguucgagaccagccuggccaauaugcugaaaccccgucucuacuaaaaauacaaaauaaauaaauaaauaaauaaaauguacaauuggauaagguuuaacauauguacccacccauggcaccauccucacaaucaagauaaugaccuccaaaaguucaaccaggacuuucacaagaaucauauuaagaaaacaugggccgggcgugguggcucacgccuguaaucccaacacuuugagaggccgaggcggguggauaaccugaggucagaucugggccagagcauaaacacaugcaacuauagagugacugcuacugucuuuuuuucuucagaacacagaagcccauauguggcaacuuucaagaaaauaaacgcuucucgcugaagaaauucccaacucaaaagcaagggacgcuaacacugaccugaagacuguuuugguuuuugcugauagaaauguaagaauacguuggguugcuccugaaucugcccugaguaauuucauccuaggaugaaaugccagucacugcuaguaggaaaacagggaauuaucccuaggagcaacaaagaacaguggcaguuagcucaggguacaccagcacagcagcagcuccuugacucuuagucaacccuaaggacagacuaaauaacagcauuuaacuaagugucaucagaauuaccuggcugccaauaaucugauuuggcaauaacugaauuaucugauguaaaucucagacaguaccuaaaagccauuuaguuagcuuuuauuuauuuacuuauuuuuuucuuuuuugggauggaguuucacucuugucgcucaggcuggagugcaguggcacgaucuuggcucacugcaaccuccaccuccuggguucaagcgauucuacugcuucagccucccgagcagcugggauuacaggcacccaccaccacagacggcuaauuuuuuuuuuuuuuuuuuuuuuuugagacggaaucuugcucugucgcccaggcuggagugcaguggagugagcucugcucacugcaagcuccgccucccagguucaugccauucuccugccucagucuccggaguagcugggacuacaggugcccgccaccacacccggcuaauuuuuuguauuuuuaguagagacaggguuucaccauguuagccaggauggucucgaucuccugaccucgugauccaccugccucggccuuccaaagugcugggauuacaggugugagccaaagcgcccggccgauggcuaauuuuuguauuuuuacuagaaauggguuuuuaccauguuggccaggcugcccuugaacuccugaccucaggugaucugccugccuuggcaucccaaaaugcugggauuacaggcgugagccaccaugcccagccuaguuagcuuuuaaauaguggagacaucugucuaugaaaacacaaugagccauuucaaguuuucccaggucaucuccuuugucuuauaaccaggacaggacucugcacauagcagguauuaaauaaaugcuuacuaaaggaaagaauaguuccugcccacacuaauaagcaggcagaguccaagcacaaguucucgaggagcucuccacauaccuguaacagcucaucacgggagaucuuuucaucuuuauccaaaucauauagucgaaaagcaacuguaagggaaaaacacaaaguuagucaaaauucuguaguguguugccccuucucaaggaacuaaauauauaagacacuagacagaaaacugacagccaauuaaucgauuuuccaagaacaauugccauuacuuguagggcuuuuaaaaaguuguaacacugaagaauugagaauugaugaguucuuagauuagaugaaguauggucccucuuccaacaaaucagaaaacuucauacaaagaaagccaaauguccuuuuucuuaaccuagaauguuaaacgcccccccccaaaacacuccuuacgugguucuguaaauuaggucaccucacacaaacaucaaaucuaccagguaccacucagggaaaaccaacaauaggcaccacacaggcaccaugagagcugaccacagcuuugggaauagagccuccugggcaaaauugucucaaauuucaaguaauucucuaccacuugggaguccuggagguaaagaaauugaguuucaaauaaauaugauggcucagauggucuccuggcuuuaucauguuucuuucucuuuaagccuucuagaaacuaggagauaggagaacuuugcuuggguccaugagauaggaaucagaaagcaaaaucauuagauuucugccauguugcugaagggcuaccaagagaauagggugauaacacugggugauuuuauaggugccgugacaaaucgccagccugaggaugugaaugucuugucccacaacugaauuuagcuugguuuuuagguuuugaaucacuucaagaaugccacuaagauuaagggucuuaaauagagugcugcaaauacuaaaaggcccgaauccacugcucuagagcuauuaagauccauggauuuagacucuguccuuaggaacucacuaucuaguagaggagggcaagacacacgacucucgaguacauccuaagcacuacaacauauccaaaaugcugggggaacaaaguguauggcagacguggcuuucuggugcagcuggggaaauaucaaggagagguaacauuugaacaaggccuugaaagacaaacagaaaugagacaagggguggucauuccaggcagagcgauuauuaggcacaaaggcauaagaacauggauuaauaucuacagguuuaaauaucacuccccuccaaaauaaaauggugaguccacuaagaugacauaaaaguaauuuuaaaaucuaauuuacuccuuguaagguauauaucagaauuccagagaaaggaaguagcuaggagagacuucauauauauguauuuuuuuuucugcucuguuuaauuugguugguuuauuuuauuuuauuuauuuauuuuuuucagacaggguccugcucugucucccaggcuggagugcaguagcacaaucaugacucacuacagccucaaccucccaggcucaaaggauccucucaccucagccuccagaguaguugggaccacagacaccacaccuggcuaauuuuuaaaaauuuuuguagagcuagggucucacuguguugcccaggcuggugaaaggugcaaggucuuugucuagauaaauuguuuuuuguuguuguuguugagacagagucuugcucuguugcccaggcuggagugcaguggugggaucucagcucacggcaagcuccgccuccuggguucacgccauucuccugccucagccucccgaguagcugggacuacaggcgcccaccaccacgccuggcuaauuuuuuguguguguguuuuuaguacagacaggguuucaccguguuagccaggauggucucgaucuccuaaccucaugaucuaaccgcaugaucuaaccaccucggccucccaaagugcugggauuacaggcgugagccaucgcgccuggccugaauuuuuuuuuuuuuugagauggagucuugcucugucgcccaggcuggagugcaguggcaugaucucgguucacuguaaccuccgccucccggguucaagcaauucugccucagacucccgaguagcugggauuauaggcaugugccaccacgcccagcuaauuuuuguauuuuuaguagagaugggguuucaccauguuggccaggauggucucgaucucuugaccuugugaucuaccugccucagccugccaaagcccugggauuacaggcaugagccacugcgcccagacagcuggucuugaacaccugggcucaagcaauccuccugccucagccucccaaagugcugggauuauagguguaagccacugugccugggccuucagcucaaauuucaacuccucagagagguuuucacugaccacucuuucuauagugacaucucccuaugccuuucucaucucauguauucacuuccuucacagaccuugucaccacaauaaaucuuguuuauucacccgucuucucuauagucugucucucuuauuagaucauaaguucuaagaaagcaagggccuuaccugauuuauucaucacuguauccugggccuaaaauaguaccuggcauguaguaggugcucaaacauuuguuuaaugaaaaaccaaaggaaugaucucagucaaaccuuuaccuuccuuuuuuaugcuuuuuuuuuuuuuuuuuuaagagauagggccucacucugucacuggagugcaguggugcaaucauggcucacugcagacccaaacuucugggcucaagugauccuccugccucagccuccugagcagcuaggaauacaggcaugugccaccaugcccagcucaauuuuuuuuuuuuuuguagauacuguugcccagguucuguugcccaggcucuguugcccaggcuacaaaccuuuaccuuuacuucaaucaaugcuauugcuucuuuuuuuuuuuucuuuuugggagacggagucuugcucugucacccaggcuggagugcaguggcgcgaucucaggucacugaaaccucugccucccggguucaagcaauuuuccugucucagccuccugaguagcugggacuacagguaugugccaccacacccagcuaauuuuuguauuuuuaguagagacaggguuucaccauguuagccaagcuggucucaaacuccugaccucaagcaaucugccuacuuuggccucccaaaguguugggauuacaggaauaagccaccaugcccggcugcuucuuuuuuuuuuauugugguaaaauauacauaaaauguaucauuuaaaccuuuucuacagguacaguuccguggcauuaaguacuuucacacuguugugcaagcaucaccaccauccaucuccccauaacuucugcaucuucacuagcggaaaauguacccuuuuaacaauaacuccauuaccaucaccaccaccaucccccagcccugggcaaccaccguucuacuuucugucucuacaaauuugaccacucuggaaaccucacauaagaggaaucauacaauauuuguccuuuauauccacuuuauuucacucagcauaaugucuucaagauucauccauguuguaccauuugccagaauuuccuuuuuuuuuucgagauggagucuugcucugucgcccaagcuagagugcaguggcgcaaucucagcucacugcaaccuccgccuccuggguucaagcaauucuccugccucagccucccgacuagcugggauuacagguauccaccaccaugccaggcuaauuuuuguauuuuuaguagagaugggauuucaccacauuggccaggcuggucucgaacuucugaucucaugauucacccaccuuggccucccaaaaugcugggauuacaggugugagccaccgcucccggccucagaauuuucuuuuuuaauacagacuaauauuucauuguauguguacacaacauuuuauuuauccauucaucugucgauggacacuaggauugcuucuaccuuuuggauucuuugaauaaugcugcuauuucuuccuggcuacucucccaagcucuacuccgccuauacuccucaacacccaagaaaaauauucuaauguagacucuuuacuuuccacaucauuauguguuauaaaaacuuaaaccauuuaagaagacaauuagaaugugggaaggaaaaccuguagaccucuagacuucucucuuacuuaccaugcccugggccuaagaugaauuauaccuuucacuuuuuuuuuuuuaaacacuauccaccuguagauaggguuguaccuuuuacacaaagcacuauuauuacuauuauuauuauuauucuuugagauggaguuucacucuuauugcccagucuggagugcaauagcgugaucucggcucacuguaauaucagccucccagguucaagcaauucuccugccucagucuccugaguagcuggaauuacaggcaugcaccaccaugccuggcuaauuuuguauuuuuagaagagacaugguuucaccauguuggucaggcuggucucgaacuccugaccucaggugauccacccaccucggccucccaaagugcugggauuacaggcaugagccaccgcgccuggccuacagaaagcauuauuauaaccucaccaauccaaagaggaaagcaauaagguaccacuuccaggagacaaacagaagagcagaguggcacuaugugugcuugggccugugccuacaugggcauaguucagccuugcugaucgugauuaaaauucucucaccguggcuuagaaaagaaauagaacaaaguguguucucagaguuccugaagacaguauucuaugcaaaguauaacccauaauaaaauuugguuccacuccucuguaaacccacauuucuuuuuuuuuuuuuugagauggaguuuugcucuguugcccaggcuggagaguaauggugcaaucucggcuaacugcaaccucugccccccagguucaaaguauucuccugucucagccucccgaguaccugagauuacaggcgcccgccaccacgcccagcuaauuuuuuguauuuuuaguacagacaggguuucaccauguuggccaggcuggucuugaaccccugaucucaagugauccacccgccuuggccucccaaagugcugggauuacaggcgugagccaucaugccuggccuguaaacccagauuucuaaguaacacaucuccuuuuuuuuuuuuuuuuuuuuuuuuuuuuuuuugagacagagucucgcucuaucacccaggcuggagugcaauggcaugaucucggcucacuguagccuccaccucccagguucaagcaauucucccgccucagccuccugaguagcugggauuacaggcauccaccauuaugccuggcuaauuuuuuuuguauuuuuguagaaaugggguuucacuauguuggccagacuugucucgaacuccugaccucaggugauccgccugccucagccucccaaagugcugggauuacaggcgugagccaccgcaccuggcccacauccccuuucucuaagguaaaugugucucaguggcaaauguauugcuagguauaugacauucaauugcucucagucuacaguaagaggcaccaugcuacagcuuauacagcccugugggaacuucaaagagaagcaacacauuuagacagaaauugaggacuucucggacucuucuagucuuuucuuuggcauuagaauagcuucgguuuuacuggucuaauuacaugaaugugaucccuauacauagacugcaacagaauucuaauuaauuuuuagcuuccuauaaaaguuaauccaacagccaagacuaaaguauguaaugaaaaaaacaggcuggguauggaggcucaugccuguaaucccagcacuuugggaggccaaggugggaugacugcuugcguccaagauuucgagaccagucugggcaacauagugagacccugucccuacaaaaaauuagaaaauaaaaaauuagcuggguguagugcacacgccuguggucccagcaacuugagaggcugaggcaaaaagaucacuugagccaggaaagucaaggccauagugagcugugaucacgccacugcacucagccugggugacagagugagacccuaucucaaaaaauuaagcaaaaacaaaauaaaaccaagcauaaccugcauagcacuuuguuauuauucuaucucauccugaagucugccauuucuguggcauuccaaccuuuuuccuuagcagaaccccaaucacagcaucaggaggggaaucucauuagccuaaucuccucggcacucgcacucuccugaccugaacugacuuaucaaagugaggggaaggacuuacauuccaugcuugggaggaguguugcucaauuucagucucgaucucucucuauauauaucucucuuccucuacugccagaugugaacaagaaaaaaaaaagcccuguuaacaacugagagcugccaugugaccauaauacuuuaggauaaaacagacuaugaggauggcagaguaaagagaaaaaucccuaguucuugaaacagaaucaacccuccugccggccuaaucugacuuguaaagugagcuaauauaguucccuauuguuuaagccagcugagucagcuaaagguauccuaagacaccauguaacgcccaaauccacuagugcuauuucgaagauuuuguuuuguuuucuuuucuuuguugagacagaguuucugucaccugggcugaagugcaguggugccaucaagguucauugcagccucaaccucucaggcucaagcaauucucccaccucagccucccaaguaccugggagcacaggugccugccaccacaccuggcuaauuuuuguauuuuuauuagagacaauguuucaccauguugcccaggcuggucucaaacuccugggcucaagugaucuaccuaccuuggccucccaaagugcugggauuacaggcaugagccacugcgcccagccuucagucaguuuuaauacaacuguaauuucaacuuguacugaauaaaaagauaaauuuaauuucaauuuccuggagaaguguuguaagggauugggcaauauuguacaugaaccaauaagggcagaagggaaggcaaacaaguauuaaaggaaaagaggcaugagacacggguauaaaaauuaaaucuugcacuguauccagcugucccccauuacuuaagucacauccagugucuaucaaauucuaagaugagcugaggauugccauuauuccuuaaagguggggccugggucuuguucacuauugccaugcuagcacuuaacacagugccuggcacacgguaggugcucaaugaauuauaaugauacuagguaacacuuauuaaguaccuaguauaugccaggcacuaugugaagcacuugacauuuauuaacucauuuaauccucacaacaauccaauguggaaccccuuaguauccuauuuuacagaagagaaaacugaagcccaaagagguuaaguaccuugcccaaagucacacgaccaaaaaaggguagacuaguauuuaaucuuggccaguuuagcuccagagucugaggucuuaaccaguaugcucuuguagaugcuuguucaaauaaugagugaguaaauacaugacuuuuaagaaaugaaaagcaaguauuuuaagccagaagacuuuagcuccuuacagugcaguuuguugcuucggcuguugagugguucggguccauucacaucuuugcucuuuucauuauccucaauggggcggaaaugagccaaaguucgcaugaauccacggaaguuuaccugguccucucugauugugaaauauaacaaacacaacaccaugucaaucacggugauuauuucuuaugaauuaaauauacuggcaacagcuuuagcuacgguagccugaaaggucauuuaaugagguuucuuuccauacgcaugguacuuugggacucacaguaccauaucauuuaagccucaccccaaccuuguaaggcaggugcuauuacucccacuuuauaaaugauuuaaccagauuuagguaacaggacuuaccagggauaaaguuaucuauugaauuuacuugcaucuguuuuccaaaaaaugaauguagaguagugccagcacuauacaagacagccagaacuugaacucauugcuuugaacucugcagcgagccacaggcagcccaaugacuccucagccaccucccacaucucccccaucuccccugcaguaauguauaccaagggauauuuuaaaauuaaggcacauuauggaaaggccgcuuuuaaaauaaaguuuauuuaauuuuuaauuuuucuuauuuauuuauuuauuuugagacagagucuugcucugcuuauaaauaaauaaagucuugcuuuauuuauuuauuuugagacagagucuugcauccaggcuggaaugcaguggcacuaccucggcucacugcaaccuccgccucccggguucaagcaauucuccugccuuagccuccugacuagcuggaacuacagacgcccgccaccaugcccggcuaauuuuuuguauuuuuuuuuuuuuuuuuugagauggaguuuugcucuuguugcccaggcuggaaugcaauggcgcgaucucagcucacugcaaccuccgccucccugguucaagcgauucuccugccccagccucuggaguagcugggauuacaggcaugcgccaccacgcucagcuaauuuuauauuuuuaguagagacgggguuucuccauguuggucaggcuagucucgaacucccgaccucaggugaucugcccgccucagccucccaaguggugggauuacaggugugagcugcugcacccagccuaauuuuuuguauuuuuaguacagacaggguuucaccguguuagcuaggaucgucucaaucuccugaccucaugaucugcccaccucggccucccaaagugcugggauuacaggcaugagccaccaugcccagccaaguuuauuuaauuauaaaagcaaacauaaauuugaaaauguggaaaaaagaaaaguagauagaaaaauacugauccgaguucuaccaauuacaaccacaguuaauauaaauauauuuucuggcugggcacggugguccaugcccaucauccuaauacuuugggaggcugaggcaggcagaucacuugaggccaggaguugagaccagccugaccaacaugguaaaacccugucucuacuaaaaauacaaaaaaauuagcuggacgugguagugggcaccuguaaucccagcuacucgggagggugaggcaggagaaucgcuugaaacugggaggcagaggcugcagugagccuagauugcaccacugcacuccagccugggugacacagcaagacuaugucaaaaaaaaagaaaaggaaaggaaagggaaaggaaaggaaaaggaaggaaaaggaaaggaaaaggaaggaagggagggaggaaaggaaggaaggaaggaaucaaucaauuaaucaaucaaucaaucagccaggcaugguggcucacgcuuauacugccaguuauuugggaggcugaggugggagaaucacuugaacacacaggaggcagaaguugcgugagccgagacugcgccacugcacuccagcccaggugacggugcaagacucccucauauauauaugaaugcauuuucuucuaguaacuuuucuaugcuuuucagauaacuguauuaguauccugccuuuuuuuuuaacuuuuaagcauuucuccaaucaauauaaauacuuugaaacauuuaaaacauaugcauaauucuguggacacaucaugauuuuauuauucccucauaauuggauaauuuuucucuaaauaaucuuuuaggccaggcacaguggcucacgucuauaaucccagcacuucaagaggccaagguggguggaucaccugaggucaggaguucaagaccagccuggccaacauggugaaaccccgucucuacuaaaaauacaaaaauuagcugggccugguggugcaugccuguaaucccagcuacuugagagccugaggcaggagaaucacuugaaccccaaagauggagggugcaaugagucgagacugcaccacugcacuccagccugggugacagagggagacuccaucucaaaaaaaaaaaaaaaaaaguuuugaaagaccucuuguguauaaagccuuuuugguacuuaagcuuggagaaaaucuuuucauugugccacaggcuaaucaauaacccuguaagaaauaauucucaaaacuugaaugaagaauguucuuuaauauuaaaaaagaaugccccauguaacauaauauaauuuauuuaucuaaggcagauggccugguuccugugguuaccuaaaaaaaaaaaaaaccccagccuuucugugccccaccgaauagcugagguauguagguucucuucugugcucuauagacaugcaguucauagcccuucuaaaggcagaguucaaaggcuagccugugagccaucuguacucaaaagaaugaccuuggcugggugcaguggcucacgcccauaaucccagcacucugggaggccggggcgggcggaucaccugaggucaagaguucaaaaccagccuggccaacguggugaaaccuuagccaggcgugguggcgugagccuguagucccagcuacuuggggaggcugaggcaggagaaucacucgaacccaggaggcagagguugcggugagccaagaucacaccacugcaugccagccugggagacagagggagacuccgucucaaaaaaacaaaaaacaaaacaaaagaaugaccuuuuaguucuucgauguaucuauacugcuaauggaccaguaucuggucaaaaaugucagaucugaggaaucaaguaauguggaguaaaguuuaaaacauaugcuagaaaaaacacauuaaugauuauugcuagcauaaaguuucuggguaaaagggaauugaauaaccaugguccacuuucaaaucucauucuuuaaaaaaaaaaaaaaaaaagccccaaugugcauaugccuagggaagaaagaaaaacccagaagccaaauauaucuaucugauuagagcaagaagcagagucgcagcuugcuaagagcuaagcagugcagcccaguagagcccuccacuuccucauaugcacucugucccauuuccuuagcaguagauugguggacagaaugacaggugauauuguagucacagcaaauguaguuuagucuuacaaaacagcuucccacaagcugcuucuucaaguaaucaauggugacuaaggaauucugaaaaaaaguuggcaaagugacucuccuggguuuacuuuucauugcaaaagguuuggauacaaagcauagcugugaaaguuaucucuggauaggguucaaugcuuugcagggguaaaagaggaauuagaaaaaaggaagaauucagcauaaaaaccacaccugaaacaaacagggcaguucaaggagagagaaaggaaaaaaugaaagagggcauaagauuccucauagucaacgugauuugauucccaucuuuacaugaacuaacugcccgaccuaauuccccuucugacuuucacucacauuuccugaaugcccaacccucucaacuagcaaauuccuuugcucucaauuuagaguucuaaaauuuccucuccaggcauuuuaucugacaguguccucauugacagucucauuauuaaaaacuggcacccauauaauauuuugaaguccugugggucauagacuauccauauaaaccaggaauagauuguuuaggaaauuacuuaaaacaagcuuauauguaaguuuuauuguugaaaagguaccuaaucaaaucaguaaauauuuacucacuacugugaaggcaguguauuagguaguaaagcauaucaaaagacuaguuucauguuagaaaaacccacauuaagaacaaucuacuugacaaagcauauguggugagaacuauguuuauucaauaucacgaaaguaaaauaaaggcuggggaaauguuccagauuaaaggaggcuaaagagacaugacaacugacccagacuagauccuguacuggaggcggggaagugcuauaaaacagauuauuggaugacaaaauuggaauaugaauauaaauuagaauaaacuggauaauauguuaauaaaacagaguaauagauuagauaagaggauuguaucaauguuaaguuuacugaaguagauaacuauacuauggauauguaaaagaaugucccuauucuuagcaaacacacacuggugcauucagagguaaagggucauuacuaugcaacuuacccugaaauaguucagaaauacaauuaugugaacacacauacacaaaaaaauuacauaaguauguguauauacauacauguauguauguguauguauguacguacauguaggcauguauguauguauauacacacacacguagaguauguguagguagagagaggggaaagagagagggaaaaagugucugcaagagaggguauguagaguaagcacggguguacaagcugcgcuguucaauacugcagucacuugucacaucugguuaugugcacugaaaacauggucagucugacuugauauguguuuaaguguaaauuacacacuggauuucaaggacuuauuaugaaaaaauguaggcugggcaugguggcucacgccaguaaucccaguacuuugggaggcugaggcaggcggaucaccugaggucaggagcucaagaccagccuggccaacauggugaaacccugucucuacuaaaaauacaaaaauuagccagguaugguggcauguggcuguaaucccaacuaucucggaggcugaggcaggagaaucgcuugaacccgggaggcagagguugcagugagccgagauggcaccacuguacuccagccugagcgaccgagcaagacucugucuuaaaacaaacaaacaaacgaaaaaaggaucucaguuauuuuuaauauugauuauauauggaaauaauauuuuaaauauauuaaauaaaauauauauuaccaaaguuaacuuauuuuuacuuuuuaaaugugguuacuagaaaauguaaaauuacguauguggcuugcauuauauuuuuauuggcuacuacuaagaagagagcacacaaaugaggcaaaauguuaacaauauaacaguagaugcaucagggcaauaaauauacaaguauucuccgaauuacuuuuaacuuuugcaacuuuuuuguaaauuugaaauuauuuccaaauaaacauuuuuuaaaagucuaguuuuacaucaaugauaaacauaagaauuuugaagauaggcucauauaucuauuugaaguuuaaaacacacaggaggguagaacagaagagauauucuagaaaugacaaaauuagaauugcucaauauaaucaggggguaucacagucugagauggcacaaccaauaucauuauuccagauuagcaaauaauuuagguugugauagccucaggaaggaaguccaacaacuguacugacucaccccucuggaaagaaggcauugaugauccggucccccaguggguugauggcaaguucuggaauccucuggaaaucuucccggcugccaagagaaucaccuugaguuagauagagaucauugcccuuagcaugaacuccuuaagucaggagguaacaggguguaaccuagcaagaauauuaccuccuggaauuuacuucuguggcaaauuauaccaaauaacugcaaagaauagcacuuuaauagcugccaaguguuucuugcaccaacucagaaguggaaggagccagauuugauuacgccacauuccagugaauuuagcacacagguuacgucaauaagccaacugauggacaaauacuaagcugucccuuaguaaaugauuucuugaacauuagcauugcguaccuaguuauuaaguuuggaaagugaacagcaaauggaaaguaucaaauacugcagaacuugaauauggggacaaacacuuagaggggucuccauauccuuguuaagauuuuuaggcacuuacaaaaugcaaggaauucuuaggugcuauuuacaugcaaggaaauaaugugacaaccaauugauuuccuuguucugacucuggcuuuuucuccauuuccauguucuguggacuagggcuacagaaguauuuaacccucaaacaugacaagagcagucauccucacaugacuuaggcgagguuauaccaaagcgaauauugucaguuaccauucaucacauauauaucaugugcugcucuguuuacauacauuauucucauuucuucacgccaauguuuuauguauacccuuuuagagcugaggaaauugagagucaggaagauaaaguaacuugcccaaagccacacuacuccuaaguagcagaacugugauuuaaaucuaagucuguaagucaaaguauguguucuuuuucuaaaaaccauauuucuuuccuauauugaacuuuuuuuugagacagagucuugcucagucacccaggcuggaaugcaauggcauggucuuggcucacugccaccuccacuucccagguucaagcgauucuccugccucagccucccaaguagcugggauuacaggcacucuccaccacgccuggcuaguuuuuuguacauuuaguagagacggaguuucaccauguuggccaggcuggucuugaacuccugaccucaggugaucugccggccucggccucccaaagugcugggugggauuacaggagugagccacggugcccagcccuaauauugaaccuuuugaaugaaaguuacucucccccaaauucuuuauuuuuauuuuuuugagauggaguuucgcucccaggcuggaguguaguggcuugaucucuggguucacugcaaccuccuccucccggguucaagcgauucuacugcuucagucucccaaguagcuagcauuacaagcgggugcuaccaugcccggccaauuuuuguauuuuuaguagaggugggguuuuaccacauuggccaggcuggucuugaacuccugaccucaggugauccacccaccucagccucccaaaguccugggauuacaggcgugagccaccgcacccagucccccaauuuuucaauaaguauuuuuuaaaaacuuucuuuuguugguuccugggccaagaauacaaagcugucuacaacuuaucugugcugcagucuucaaaaauaucaaugucauggaggacaaagaaaagcagaggauuguuccagaucaagggggggcuaaagagacacacaacaaaacccaacacaugaucccggacuaggaaaaaaacugcuauaaggacauuauuggauaauaugugaaaaugaagcauggaccauauaaaauauggaauauuacauaaugguacuguuucaaaaugcaacuuucuugauuuugaucugagaauguccuuucuauaggaaauaaacagugaaguaugugacaaaauguuaacaauuggugaaucuggguaucagaauaaaaguuaucuuguauuguucuuguaacuucaaguuuaaaauuauuuccagauaaaaaguuaaaaaaaagauuauaaacuagauuuuacuccugccuucaagaaguuuacuuacagacagauaaaauguauaccuccacccucuuuguaauauaugcuagcaaagacggaagauaauaaaauacuccuacuguacccaggagacuucacgcucuuuuccucuugugguuuaacguuuacguggugcuuaauuaacucagcaagcucuucuccaccacauuuggugacacagguagaaacugaccuaguggacugaacacaaagcucuggaacaaucauccuggauucuaguccuucuugaccauuuaguguaauaauuuuauaucaaugcaugaaccagaagaagucauucauaagauaacuggauugcuuaagaugaugaaagagaaaauuaccgagguccugauuauuuaauucaacaaacauguacuaagcuuuuauuacauaauuuguucuguaauacaaagucuacacuaucaucaaaauguagcuccuccugucugacagaggucaagaaacaauaacuacucacuuuuaaauuaagacuaaggcugauuugaauugcauggcuacauacuucaguuuaaugucuaacaagcuuaagaaacuuuagcugagaaaaggcaguuuaaauaccaagucuaguaucaaguggugaugcacaaccuagccugaacuucagucucaauaaggagguguacacuuggccuuccgauggaccuguccuuugauacuuucuaacucuacucuuagaauuuagauuguauauauaauguaguuccagucacccagaucaaggacaguauugcuaaaaguauuaaaguuaaaaagaaagagggcuggguauggcagcucagccuauaaucccagcacuuuuggaggccaagguggaagaacugcuucaggcuaggaguucgagaccagccugggcaacagagcaagaccacaucucuaaaaaguuuaaaaaaaaaaaaaaaauuagccaggcaugguggcacgugccuguagucccagcuacuugggaagcugaagcgggaggauuguuugagccuagaaggucaaggcugcaaggagccaugguaacaucacugcccucgagccugggugacagagugagacccuguuucaaaacagaaaaaacaaaacaaacagaaagaguauaaaaaauaauuugucagccgggcgcaguggcucacaccuguaaucccagcacuuugggaggccgaggcgggaggaucaugaggucaagagaugaagaccaaccuggcuaacacggugaaaccccgucucuacuaaaaaaacaaaaaauuagcuaggcguggugacgggcaccuguagucccagcuacucgggagacugaggcaggagaauggcaugaaccugggagguggagguugcagugagccaagauugcgccacugcacuccagccuggugacagagcaagacuccgucucaaaauaaauaaauaaauaaauaaauaaauaaauaaauaaauaaauaaauacuuugucaacuguuaaauaaauaauauacgaacaaguuauuauuacugguugcuuuauaguagaauguagaucugggcaguuucucuaaaacuuagauucucaaauuuacccaucaacauaaaccuaauagaaaaaaauaaauacuccaaaguggccuaaacaccacaagcauaagauccauccgaaggccgggcacaguggcucacgccuguaaucccagcacuuugggaggcugaggcagguggaucacgaggucaagagaucaagaccauccuggccaacauggugaaaccccgucucuacuaaaaacacaaaaauuagcugggcaugguggcgcgagccuguagucccagcuacucuggaggcugagaaaggagaaucacuugaaccugggagguggagguugcagugagccaagauugcgccacugcacuccagccuggugacagagugagacuccaucucaaaaaaaaaaaaaaaaaaaaaaaaaaaaaaccaugugaaauacagauuuguguggauucacugaaaagcauaccaacauuauguucugccucaugguauaccuaggaaaaccuuccuugaagauuuuuuuagaaaaagacaguaucacugguaguagucaauucugagaacagagccauguacgauggcauucuuuguggccaagaaauuuccaauggggagugguuuuccaaacauucaagggcacagggaugcuuagaaaaaccaggguuuuuagacuguuaguaaccagacaugccaucccucuauacugcucaccuucacugugcaagucccuucucuuacagagagauucagccucacagguaacuucuaucucaagcacccacagguuguugcuuuaguugacuuguacauaaugaggagauuaaaaucuguuaauaggacauacccacuggaacacacauucaauuagaaaacacagcuuuccaggccgggcgugguggcucacuccuguaauuccagcacuuugggaggccgagguggguggaucaugaggucaggaguuagacacgagccuggccaagaugguaaaaccccgucucuacuaaaaauacaaaaaucagacgggcgugguggcgggugccuguaaucccagcuacuugggaggcugaggcagagaacugcuugaacccgggaggcggagguugcagucagccaagauuguaccacuccagccugggcaacagagcgagacucugucucaaaaaaaaaaaagaaaagaaaauacagcuuuccauuuuaaguaguaugagagguuaagcauaugguacaacauauuuauuaacacugaaaugacaaaaauuuccauuagcuaaagcacuuaaucaguauuuuuaaauuaaauggauaagauggccaggcguggugguugacgccuauaaucccagcacuuugggaggccaaggugggcagaucgccugaggucaggaguuugagaccagccugaccaauauggagaaacccugucucuauuaaaaauacaaaauaagccaggcauaguggcaugugccuguaaucccaacccaggaguccgagaccagccugggcaacauagggaaacccugucucuaauuaaaaaaaaaaaaaaaaaggcagcuggcagcgauccccagccuuuuugggaccagggaccaguuuuauggaaaauaauuuuucuccuggggguagacaggauaguuucaggaugacacuguucaaccucagaucagcaggcauuagauucucauaaggagcacucagucuagaucccucacaugggcaguucacaauaggguuucuguuccuaugagaaucuagugccgccacugaucugaccggaggcggugcucaggugauaaugcucacuugcauucuguucaccuccugcuguguagcccgguuccuaacuggccacagacugguacuggucugcaacccagagguuggggaccccagggguccuaaaguggucuuuugcaggucagguuaagguaagagccuggucaguaucugaacacaaagaugguuucucuucuuuaaauauucuuuguucugauguaaucuauggaguuacaaggcaggauaaugauuacccuuuggggaggggagcagguaaagacaaaaggagcauaagggaagcuucuggguauugguaauaaucaguuucuucaucuggaggcuggauagucuucccuuggugaaaauuuaucauguccaaugcuuuugauuugugcacuuuucuguauguuauacuucaauaaaguuugcuuuaaaaacauccucugggccaggcacaguggcucacaccuguaauccuagcacuuugggaggcugaggugggugggucacaaggucaagagaucgagaccauccuggccaacauggugaaacccgucucuacuaaaaauaaaaaaauucacugggcgugguagugcacgccuauaauugcagcuacucuggaggcugaggcaggagaaucacuugaacccggaagcggugaacuuggcugcagugagccgagauugugccucugcacuccagccuggugacagagcgagacucugucucaaaaaaaaaaaaagaaagaaagaaagaaagucuuaaauaucuccucuugauauucugaaauuucaucuauauauaucuuauugugaaguauucuuuauuauucauuguucagcauuaggugaaccuucuuagacuaaaaaugggcccuuuagcugggaaguuugcuucuguuccuuuuuuuuuuuuuugguaagaaaccucaccuggauuuuguuccuauuuuaaaaauuauuucuucuccuccucuuuauuauuuauuuauuuauuauuuauuuauuuuugagauggaauuucacucuuacugcccaggcuggagugcaauggcaugaucuuggcucacugcaaccuccgccucccggguucaagcgauuccccugccucggccucccaaagugcugggauuacaggcaugagccacugcgccuggccuaagcugccuuuuuagaaaaaacaaucucuauggcaaugguagaaauaucuuacccaaaauaauggcaucugaagaaaguaagguuuauaagguuacaguguauauuuauauuccgugaaauaucaaucugaagagaugguccauguaaaaaggcagacagggaaauugcaaaucaauuuggcaaacacuucucccuugaauguucccaauucacccagguaaauuaaagauguggugaaaucuaguaauuagguagccuauuuaaccuuguugaccaagguuuucacaaauuuuagucaauaacuuuuugcuuuuuuuuuuuuuuuuuaacauaacaccuauugauagaccaaggaaugacuguucuauaaagcaugcuucggagugagucucugaaagcacucugaagaagcuccauucuaaccaaagccuuccacaguucugccuuauguuccacuggagcugaucacuacaaaggaaugcagaaugccccagacuguacacuguagccucucacucugcagaauuuggcuucaggcccagacauggagcaccuugaaagaggaaaguaaaaaaaaaaaaaaaaaauuguugaagugaaaaucuuucuccuaauaacuacaacugccuucuuaaggugaaggcgaggccgggcgcaguggcuuacgccuguaaucuuagcacuuugggaggccaaggcagguggaucacaaggucaggagaucaaaaccauccuggcuaacacagugaaaccccgucucuacuaaaaauacaaaaaauuagcugggugugguggcgggcaccuguagucccagcuacucgguuggcugaggcaugagaauggcaugaacccgggaggcggagguugcagugagccgagaucgugccacugcacuccagccuggacgacagagcgagacuccaucucaaaaaaaaaaaaaaaaaaaaaaaaaaaagaaggugaaggccaggcaugguggcacacaucuguagucccagcacuuugggagacugaggcaggcagaugguuugaguucaggaguucgagaccagucauggggaacauggcgagaccuccucucuacaaaaaauacaaaaguuagccaggcagugacacgugccuguagucccagcuacucaggaggcugaggugggaggcuacagugagccgugauggugccacugcaaucaagccugggcaauagagucagacccugucucaaaaacaaaaaccaaaaaaagaagguggaagcuguuccagguaacaaaagauuggaagccacuuguauucggaugagcacucugauggguccuggaaacaucaagacaggccuuaagcugaguuuggcaacaaaggcuggagagaacuggaucauucuacuagagaagaguucccaguuaggccaacucauuucuaaggcuagaggggguagaagaggagagggcugagagaaggggaagacaauuuaaucggauggccacaggcuaagaagauaauugucaggaggcacagccagagugaaaucccaguagugggugggucugacaaaacgauuuacauaaaauauauuacucguuuacuauguggcacauuaugugguacaauuggcuaauuucuucuagguauucaagguagcuuggugcuucucucauuuauuuuuauuuuuuguagagacgggguuucacuauguugcucaggcuggucuugagacuccgggccucaaggaauccucucaccucagccucccaaagugcugggauuacaggcaugagucuccucgcccaaccuuucuuauauuucaauccacaccaugauagagaucaaagaacagguuuaagaccuagagcuuucaggccagguacaguggcuuaugccuauaaucccaguacuuugggaggccauggcgggaggacugauggagcccaggaguuugagaccagcaugggcaacaaggugagacugugucuccacaaaaaaugaaaauaaaauaaaaauaacaggagaagcaccaagcuaccuugaauaccuagaagaaacuauuccauuguaccacauaaugugcgcuuuuuugcuuuuuugcuaaaaguaaaaagaaaaaaaaauuagccaggcauagugaugcaugccuguaguccuagcuacuugggcagcugaggugggagaacugucugagcccaggagguugagguugcagugagcugugauggugccauuacacuccagccuaggagacagagugcgacccugucucuuacaaaaaaaaaaaaaauauugccagcauggagaacagugucuggcacaucauagauagucaguaaauaccuaccaaaugagugagcuagucugcugguuuuccacaggcugugaaaugguaacuuacagauugagcaaaucuuacuuagauacuuauuuauuuauuuauuuauuuuauuuauuuauuuuuuuauuugagacggagucuugcucugucgcccaggcuggaguaugguggugugaucucggcucacugaaagcuccgccucccggguucacaccauucuccugccucagccucccgaguagcugggacuacagguacccaccaccacucccagcuaauuuuuuguauuuuuaguagagacgggguuucacuguguuagccagguuggucuucucuugaccccaugaucugccugccucggccucccaaagugcugggauuacaggcgugaaccaccgcgcccggcccuauuuauuuauuuauuuuaagauggagucuugcucugcugcccaggcuggagugcaguggcacgaucucggcucacugcaaccuccaccucccggguucaagugauucuccugccucagccucccaaguagcugggauuacaggcgugcgccaccacaccugguuaauuuuuuuguauuuuuaguagagacgggguuuuaccauguuggccagccuggucucgaacuccugaccucagcugauccacccaucucggccucccaaagugcugggauuacaagagugagccaccacaaccggccagaauuuuuuuuuuuuuuaaaggcaggaucucacuguguugcccagggugcagggcagugcugcaaucuugguucacuacaaccuccgccucccggguucaagcaauuuuccugccucaaccucccaaguaccuggaauuccaggcaugcgccaccacacccagcuaauuuuuguauuuuucguaaagaugguguuucaccaugucggccaggccgaucucaaacuccuggccucaagugauccaccugccuuggccucccaaagugcuggauuacagccagguguaagccacugcgcuuggcccuuacuuagauuuuaaggagcaggcuacacugacgccuggaaaguuuucaacauuuuuuuuuuuuuuuugagacagagucucgcucuguagcccauggucucgaccuccugaccuugugauccgcccgucucagccucccaaagugcugggauuacaggugugagccaccacacccgggcuuuuuuuuaauuuuuugagauggagucuagcugugucucccaggcuggagugcaguagcgugaucucgccucccagguucaagugauucuccuaccucagccucucgaguagcugggacuacaggcgccugccaccacgcccagcuaauuuuuuguauuuuuaauagagacgggguuucacugcguuagccaggcaggugcaucacgaggucaggauaucgagaccaugggcuacagagcgagacucucucucaaaaaaaaaaaaaaaaaaaaaaaaaagcuuuuuggccaggcacgguggcucgcaccuuuaaucccagcacuuugggaggccaaggcggguggaucacgaggucaggaguuugagaccagccuggccaagauggugaaaccccguuucuacuaaaaauacagaaauuagcagggcguggugucaugcgccuguaauccuagcuacucaggaagcugaggcaggagaaucacuugaacccgggaggcagagguugcagugagccgagaucacaccauugcacuccagccuggccaacaagagugaaacuccaucuuaaaaaaaaaagaaacagcucauuaaaaaaaaaacuuuucgauuauuuuccagcacacagcaaacaugauaaaaacacacacauuuagaaaccacccacuuucuacaaagaagaaaagaacucagaauauaaauuuuaagucuuuacugggugguuaagucugaauuuaugaggcaaguauaaacucaaaggaauuuuuaaguauuggagcuaaaauuacaaauagggauuucuagucuaguuauuuuucaaguguaaauucacauaguuuuaauagcgucuucaacgaauggugcugguacaacuggauauccacaugcaaaaaaaaaugauguuggacucuucucugacaccauauacaaaaccaacucaaaauaaaucaaaagaccuuaauauaagaacuaaaaccauaaagcccuuacaagaagauauaggauaagccuuugggacacuggauuuggcaaugguuucuuauauaugauaccaaaagcacaagcacugaaagaaauauuaaagaaacuggacuucaucaaaauuaaaaacuuuugugcuuuaaagaacacuacaaagagagugaaaagacaacucauaugacccaccauuccacuccuagguauacguccaagagaaauuaaaacauaugugcacccaaaaauguuuaaagcaacacuauuugcaauacucaaaagguguaaacucaaauguuuacuaacugcugaauggauacacaaauguggcauauccauaugacagacuauuuauucagccauaaaaaggaaugaaguacugguauaugcuacaucauggaugaaccuuaaaaacaucauguuaaguagaagaagucaguuuguuuguuugagacaaagucucucucugucgcccaggcuggaauacagcagcacaaucugggcucacugcaaccuccaccucccaaguucaagcaauucuccugccucagccuccugaguagcuuggauuacaggcgcccaccaccacgcacaggcgcccaccaccacgccacgcuaauuuuuguauuuuuaauagagacgggguuuccccauguuggccagccuggucucgaacuccugaucucaggugauccgcccgccuuggccucccaaagugcuagaauuacaggcaugagccaccguguccagccagaagaagucaguuaugagagggccauauaauuccauuuauaugaauuguccagagagaaaaagaagguagauuuaugguugccaggggaugagagaagggggaaauacguaugcuuaauagguaugcuuaaccccaugcuuaaugaguaugggguuuccauuuggggugaugauuacguccaaaggcuuagcaacuguauuccuucccccuuuaugcuacauccaacaccugugcuagaaacuuucuaaagaaguccuaagcugcuucaugccagccaaaaggaagggcaacagcuucauuacaugccaaucaaagaugaagaaccacagcauaagaaagguugcuacugagaguuagugugggagauaaugguaaagaauauuucauuugauuaugguaagacaauuacaaacauaaaacaauauagcauuacaucacucugauaucauauacuuaccuagaccagaguuucucaauuuuggcacuaccgacaucuagaccagaauaauuauuugucaugggggcuguccugugcacuguaggauguuuagcagcaucucuggccacaacccacuaggcacuaguagcauucuccagucauggcaauuaaaaauguuuccagacauuuugccccagguggcaaaauggcccucagaugagaaccacugcucuagacuaacauacugaacauuuuguccaacauuaauauacauaaagugauguaccucaggguuauggguugguaaauaaaagaagacaaaacaaccuagaccaccugggaucgcuaugggucaacuuccuaaaagccaauguuugggaaaggauuaugggaaaauguaagcagagagagcugaaaucuuaaaaauacauuccuagaaucagaacaauggccaccuaaauuaaggggaguuggaauaaagcaacacacaucuguuaaugcauuuaauugucauaguuccgcuguuuuuuuuuuuuuuuuuagauggagucuugcucuguugccgaggcuggagugcaguggcgugaucuuugcucacugcgaccucugccucccggguucaagcaauucuccuaccucagccuccugaguagcugggauuacaggcgccuaccaccacacugagcuaauuuuuguauuuuuaguagagacgggguuucaccauguuggucaggcuggucuggaccuccuggccucaugauccgcccgccuugaccucccaaagugcugggauuaaggcgugagccaccgcgcccagccuguucugcugauuuaauucucuuguggaucaaugaugcucaaagaccaguagagaaaugguccuugcuaucugcaugcuggaugucuaucaugucuacccuagggauaaaggcagcuauucagacacugccagaggguuucugguuucugugaggaaaauaaagaaaaacacugccuaccugagagucccauucucuccuuuguccaggcuggugaaccggcuguagaggcgagugauuugacugugggaaacuaaagagcacaaaauuagucccagcucgggggaaguagcccucauucacacugaacccaccccucgcugucaaaugcuucaaaauucaguaggacugggaugucgaaacucuuaucucuagaauguuaaagcagaaaguuuaaaagcuaaagaaugaaaggaguuagagaauaaacuaaaucaagggcaaucaaaauucaaucccaggaaugaagucuaggcuuaauuaagacugugaugaauauuagaugguuaagauuuaacaaaacaaaggcaaauuuuguccuguccuguccuguccuauccuaucccauccuauuuuacugagacaaaguuuugcucuugucacccaggcuggagugcaguggcacgaucucacucacugccaccucugccucccggguucaagcaacucuccugccucagccucccgaguagcugggauuacaggcuuccgccaccacacccagcuaauuuuuuguauuuuuaguagagacgggguuucgccauguuggcuaggcuggucuugaacuccugaccucaggugauccacucgccucagccucccaaacugcugggauuauaggugugagccaccaugcccagcccaaauuuaguuuaaaaggaagcugugaaacuuugaaguuucaaugcccugacuuagaggcuaagaaaauguauguuuuuacuguauuuauuuuuuuacuuuuuucuuuuuuucugagaugggguuucacucucguugcccaggcuggagugcaauggcacaaucuuggcucacugcaaccucugccucucguguucaagcgauucuccugccucagccucccaaguagcugggauuacaggcgcccaccaccaugcccagcuaauuuuguauuuuuaguagagacaggguuuugccauguugaccaggauggucuugaacuccugaccucaggugauccaccugccucagccucccaaagugcugggauuacaggcaugagccaccaugcccggccuauuuugcuuauuuuuuaaauuuuauuuuauuuuauuuuugggggacagagccucaacuuugucgcccaggcuggagugcagugguacaaucucagcucacuguaaccuccaccuccuggguucaagcgauucucgugccucagucucccaaguagcugggauuacaggcaugagccacaguuccagcuaaaaaaugcauguuuugauugaaaaaauauccaugaucaguuugcuguuucaggcuguacugcuagguagguguacggcuagguaggugauguguacggcuagguagguguuggguguacaauauuugauugggguacaucaaacagauucuauuuuaaaacucugguuuacuccuacaccaagcauuaaaggcuuuaucuuuucccuuggaaaacauaaagaucaaccucuuuucugugauggcaugagcuucacugaguucccaggaagggaacuggcuccaaggaagcaaauuaggcaaauucguaaaauggucaugcuaucaucagaugacaucuaccagaaagcuauuuugcuccucauuuuggauuuaguccauaaacucaagauacaaguugacaauuaaaaugaggcaauaauggcagguacauaauaauacuaaaaacucaaaaaggccuuucugggaaauaguuuagucuccugauagauuggaaguaagagaggggaaacaaacagaggagaaaagacaacagccaaaaagggugugacaaguguggacuuuguccgaggcuguaccuucagagguuuaaagggguggccaaagucauucagauaagguguccuccucccucagcucaugaaacaaaaauguacuuguaguguugggaacaaugggacaaagugaacagggacaagcagguagugaguggcccagagcugggauaagaggacacacuauguguggcugugaauucuucagcaucagguuucacccucgaagcugggcucuguucuguccuagugcucuaaagugaucacugagcagagaaggcaaaagcauuuccaucggggcagagccagcagggauccagccacuaaggagacaguuguggacuguuuugccagccggacagguauaaauggcucacuguaaaguguacacacuugugaggguuaggcagacagauucugauuccauugcuagcaccauggcuuaccagagagagguaagugaaugggauuguagagcgaacucaccagucaaugaaaggaaaaugcuuggcaaagugccaggcacauggcaagcacuccagauuagcuauuaucagcaucaugcuuacauccugagccugaaggcacaaguauuacugcugcacuaauuacucuccauuucccuccugacuuugccaguuacaaccguuuucuuuaagaacuugaccagucuaucccaguucuggccucaggccucaaaggcuauucuuguacuaaaguucccuuuaguuuaacaaaaauaagucaguuaaagaauuacuaaauuucaggcugggcgcaguggcucacgccuguaaucucagcacuuugggaggccaaggcgggcggaugcugaggaaaagagaucgagaccauccuggccaacauggcgaaaccucgucucuacuaaaaauacaaaaaucugcugggugugguggcgucugccucuagucccagcuacuugggaagcugaggcaggagaaucacuugaaccagggaggcgaagguugcagugagcggagaucacgucacugcacuccagacuggugacagaacaagacucuguuucaaaaaaaaaaagaauuacuaaguuucccaaaagauuuuuugaaaaaaacaaaauuuguucacaaucccaacacugccauuuucauuucuucauagaucuuuuuuuuuuuuuuuuuuuugagauagaguuucgcucuucuugcccaggcuggagcgcaauggcacaaucuuggcucaccacaaccuccgccuucuggguucccgugauucuccagccucagccucccaaguagcuggaauuauaggcaugcgccaccacacccagcuaauuuuguauuuuuaguagagacaggguuucuccauguuggucaggcuggucuuaaacucccaaccucgggugauccacucaccucggccucccaaagugcugggauuacaggcaugagccaccgcgcccagcucuucauauaucaucuaauaucaguuacucguguacuuuacaaaguuguaauagcuugcuuuucauuuaguaauucauacuuuuucuauauugcuuuggaguccuucuuuauccaauuuauauaauuuuaaaauugguagaaauguuaucuaauccgaccccuucaaugaacaaaugagagccaggcaugauggcuggcgccuauaaucccagcacuuccagaggcagaagcaggacaaugauuugaggccaggaguucaagaccaggcuggggaacaaaauaaaaauaaaaauaaaaaauaaaauuauuuuaaaccaaaaaaauccacaaaugagccauuaaacaucuuucuaaucuauaucaucuaaaauaacugggcacugaggcugggcgugguggcucacaccuguaaucccagcuguaaucccagcacuuugggaggccgaggcgggcggaucacgaggucaggagauugagaccauccuggcuaacacggugaaacccugucucuacuacaaauacaaaaaauuagacgggcgugguggcaggcaccuguagucccagcuacucgggaggcugaggcaggagaaugguuugaaccugggaggcggagcuugcagugagcugagauugcgccacugcacuccagccugggugacagagaggagacucugucucgaaaaaauaaauaaauaaaaaagaaauaaaauaacugggcacugaaaccuccuauaguauguuaagaccaguuuauggcugcuuaaauucaaaauguggcaaggccugguggcucaagccugcaauaccagcacuuuggggggcugagggcgggcagaucaccuguggccaagaguucaagaccagccuggccaacaugguaaaacccugucucuacuaaaaauacaaaaauuagccagguguggugguauaaucccagcuacuugggaggcugaggcaggagaaucgcuugauccugggagauggagguugcagugagcugaaaucucaccacugcacuccagccugggcgacagagugagacuccgccucaaaacaaaacaaaacaaaacaaacgauaacaaaaaauaauguacuaauauguuaaaaauaaauaauguaaauaaguagccaaaacauuaaaaaaaaaaaaacuaucuuccaggacgaacuggguuauaugggagucaguggagaaacauacaaccaaaugucaacuuuuaauacuaaucaauauggucauaucuaaacuuaucuccaaaauuuuagaacaaauuuuagaaccauaacgauaugguuacaaguaauuuuguuaacaaaaagaaggagagaaggcuuuaauuuagguacuaaauucacugugacaaagaauauaaagcaaucucagaacaaucccaaucuaccuauaaaggagcuacaccauccauguguagaaagguacuggaacuggugugaaugaaggcagaucauguuuccagugaaguauuuuccccagaaggcucuaagcuagucagauaggugcccaaaaccugcacaauucuugguaacccaaaggaaauaacaggaguugacaguuacucucagagaaggccgugcauauaaacgugucuuuuuucuuuuuuugagauggaggcuugcuuugucacccaggauggagugcaguggcgcgaucuuggcucacugcaaacucugccucccagguucaggccauucuccugccucagccuccugaguagcugcgacuacagguaccugccaccaccaugccuggcuaauuuuuuuuuuuuuuuguauuuuuaguagagaccagguuucaccguguuagccaggaugaucucgaucucccgaccucgugauccacccgccucagccgcccuaaagugcugggauuacaggcaugagccaccgugcccugcuauaaacaugucuugaaugaagcuguauuuuuucuccacugguauggguauauaaucauuuuaaauuguuaaaagauuauuuaaaagacccuguuuggcugagggcaguggcucaugccuguaauccuagcacuuugggaggcuaaagugggaggaucccuugacgaaaggccaguucaaaacuagccugggcaacaaagcaagacuucaucucuauaaucaaucaaucaaucauuagcugggcaucguggugcauuccuguacgcugagcuauuuaggaggcagaggcagaaggacuguuucagcccaggaguucaagguuguagugagcuaugaucacaccccuccacuccaaccugggugacagagugagacccugucucaaaaaaaaaacacacgccaaaaaaacaaaaaaagacccuguuaacguugcugaaaucuuucuaucaucacugcauugugcaaagaggaggaaggcauuucacagaagugcgaagcagaaguggcagaggaaagaauaaaaacaaaaagggaguaagaaaaaguuauuuuggagggccaggcaugguggcucaugccuguaauccuagcacuuuugggagguggguggauuacgaggucaagagaucaagaucauccuggccaacauggggaaaccccaucucuacuaaaaauacaaaaauuagccgggcaugguggcacgugccuauagucccagcuacucaggaggcugaggcgggagaaucccuugaacccgggaggcgggauugcaccacugcacuccagccuggugacagaacgagacuccaucucaaaaaaaaagaaaagaaaaaguuauuuuguccuugccuuuauuccaaaucuuaaugcagaagaacagacugauaaccuauguaaagauuacaaguacagcuaaagguagcucuagauaaaggaaaguugaagccugcgcuucccggaauagacuacaccuuaacauucccccugacaugaagacuucaagcccuggacuagucucuuagggauuaagagagauuuuaaaacauuauauaaaacaaacaaaaucuaucuucuuauaauuggagaaauuugaauaggaagugaaugauagauaauauuaagguggcucacgucuauaauccuagcccuuugggaggcugaggcaggcagaucaucugagguuaggaguucgagaccagccuggccaacaugguaaaaccucguaucuacuaaaaauaaaaacaauuagccaggcgugguggcacaugccuguaaucccagcuacuugggaggcugaggcaggagaaucauuugaagccaggaggcggagguugcagugagcugagaucgcgccacugcacuccagccugggcgacaaaagugaaacuccaucucaauuaaaaaaaaaaaaagaaaaagaaaaaaaggggccaggugcgguggcucacgccuguaaucccagcacuuugggaggcugaaguggguggaucaccugaggucaggaguucgagaccagccuggccaacguggcgaaaccccaucucuacuaaaaauacaaaaaauuagccaggccugguggcaggcaccuguaaucccagcuacuugggaagcugaggcaagagaauggcuugaacccaggaggcagagguugcagugagcugagaucgagucacugcacuccagccugggcaacaagagcaagacucugucucaaaaaaaaaaaaaagauaguauuaagaaguauuaucaacuuucuuaggugugauaauaguauuguuguuacguaaaaaccaucccaauacuuaagggauacaugcagaaguaugaagggguaaagaguuccaauaccugcaacuuucaaaugguuuauccagaaauuuacaaaaauaaagcuuauaucuucgcagcugcugcuggggucaauuaucuucugaaugaauaaaccuccaacuacucucuggucuggaccaccauccccuccuugcccccgcaaaaaaguuccuggccaguggcucaccucuguaaucgcagcacuuugggggacugggaugagcggaccaccugaacucaggaguucaagaccagccugggcaacauggugaaacccuaucucuacaaaaaauuaaaaaauuagccaggcgugguggcaugugccuguagucccagcuacucaggaggcugagcugggaggauugcuugagcccagaagcuugaggcugcagugagccgugaucaugccauugcacuccagccuggaugacagagcaagacccugucugaaaaaauaaauaaauaaaaauuaaaaaucagguaguugccaggcacaguggcucacaucuauaaucccaguacuuugaaagucugggguggaaggaucauuugaggccaggaguuugaggcugcaaugagcuaugauugcaccacugcacuccagccugggcaacagagugagacccugucucaaaaaaaaaaaaaaaaaguucuuagggucucuuucccacaaugcccucucuaauugacaaauaguugcuucuuacuccuuuauggcaacaaaugagaauaaaacuuugcacuagaacucaaaaaguacagagcuuuacaaaucacuuaacccaaaaccaguuaaagguguuaguuauccaugcauuuccauuucaauaggaggcagaagacagccugguuuucugaagugacagaaccuucaggcuggugagggcugugaaggguccuacauuuggaggcacgagaaaccugaaguugaauuucuacuuacauucuagccaugauauuguucucaagcaauugccuuugccaggcuuguacucuguuagaacucuaucauuacuacacucuuucaaacaaacaaaaccuuaccaaccugugcaacuuacuuccuaaaccuguucaacacccuucccguaccacaugacauauaccaaaagguagagacuaaaaauaaucugcauucauuacuacuugaauggcaugaauuguuuaucaagguguuuuugugguuguuguuuguuuuuguuuuuuuuugagacagggucuguuucucccaggccagagugcaguggcacgaacauggcucacugcagccuugaccucccgccuaagcaauccucccaccucagccuccugaguagcugggacugcaggcacgcuucaccauguccagcuaauuuuuuuuaaauuuauuuuuuuguagagaugggguuucccuauguugcccaggcuggucuugaacuccugggcucaagcgaucugccaccuuggccucccaaagugcuggaacuacaggugugagccacugcgccuggccucauaaaguuuuaaguaauucacagccagcuuauugcuacaauuaagugaauuaagggugaugauuacagaaacuccuaagacauuuguggcuuuauccccgauuacaccuuuuuuucaaauaagcuuuaugaaaaugcagaagucugaaagaagguaguagaacaaagauaauuuagcaaauaugccaauagaaagcauuucuuagacaauuccuguuaaaacaucauaacaguuucauaaacuguuaaaaacuccuuuaaaaauuuuauuuccuuauaauuggcaaaacaucuguacuuaauuccuaaucaacuguccacuacaaaaagaaguauaaaaugcugucaccuccccaaugauauagcccuacacauaguuuuuauaacuaguacaugcaaaugguauuuucccaauaagacgauuguuaacuaugguucaaaauaauaacacucacaugaaguuuauuauaccagacacuauucuaaguaguuugcauaauucaucucauguaauugucguaagaauccuauaaaguaggcacuauuauuauucuaauuuuacagaugaugaaacugaggaucacagguaauucuuauccagaauuacuuuuccaaacacuuacuguuauucauuaaauaucaaauaccagcuaaucuagucauguagaaauucuaaucuuuuuaaauuugcaaaaaauaugguuaaauauaaucaucaaauuccaaugcacagcuuuugcacugaauauaaauuuaguauuccucaauuauguuacauuuuguacuggcaaaggaaguaguaaaaugucuuauaauuguucuuaaagugcuucugauagauaguuuuccaaauucuucauagaagaaaaggcagaugaaaaugggacaaauuccaccucucuacccacuccagauauccguuuuuauucuucaaaaucuuuugcaucauaccaaauuacuccuugaaaaaacaacucugggcuuggcgcaguggcucacaccuguaauccccgugcuuugggagguugaaguggccuaagaaucacuugaggccaggaguuuaugaccagccucgacaaaauaacaagacuccaucucuacaaaagauaaaaauaaaaaucagguaagcauggugguaugcgccuguaguccuagcuacuugggacgcugaagcgggaggauggcuuaagcccaggaguuuaaggcuugcagugagcuaugcucaagccacugcaguccggccugggagacagagcaaagacccugucucuaaaauaaagaaaaagaaaaagaaaaaacaacucugaugauggacacuauuuggauaaacugaugguucccagggcaaaggaaugacuuuguagcaggcuuagggggagaucucuccuggaagucacccaaaaugcccuagguuaaucuauccaaaucuacuccacccauguaucaaggcccaauuccuguccuccaugaggacagcccacaaggacucucucucuugccugauuucugaagguggaugacacacaauucucagcuuucuuaugucaugaugcuaaucauaacucucuugggcuuaucuccccaaccagguugggggcguuuuuugucaccaucugcucugaguaccuagcacaguacugaacagacacuguaaaaauucaguaagcacuuguuucacuaagcauucuggcucaauacauacauuugcacugguuguggagagaaucucccucacaagugacucacucuuuggcaauggggaaaacagcuuuuccaugagcacuuaguuguuuguccacaagccacaugguaaaaauaucccauccaggucauuuccauuuggucaaauguauauaaaccagaaugggauuacugcucccuucauucugaagcaaaaauggcuuuuugcaucuucacuaugguuuacacuuucucauuaugugacucuauauuuauuucucuuugauucugcuuauuucuccaugugacucuuuaacacaaauacuuuaauucggugucacccuagaccuaaaguaguacuaauuacaaauguggccagaaguuauggccacaaaacguaauaaaaugcuuguugaauccaaacugcuugcgucuccacuccgagggucagaguaagucaguggccaaacaaguacugcaaauuauaaagagcuaacuacuuugggucauucaaaucgugaaaaggacugccuugguagguggagagguuaccaucauuaaaugucuuuacagagaggcuuaagggccauauuuuaggggaggcugaaagaagcaaaccaguccagaaagggguggggcuagaaaacaucccuuccaacuugaaaacuccagaaaguugaacuugucacaaagcagagaacagcacuuaaacaggccugaaaaauucuguaguuccccauagcacuccucaguacuaucugcauaugggccggagugaguuacuggucaugucauuaucaaagacaaguaugaugaagagacagagcucaggugcuacauccuucauuaacucaauaagaaucauaaagguuuacugaaaagauaaaauauuguaugcaucaauacaauuguaucauacauugcauuaucaaggacuauucaaaguuaugaugguauuuuacagcgcuucagaaucccgaguccuuuugcuccuuuguucagacuaaugaggaagagacuggacuauaaaaaaaaaaaucaguucugcagggcacgguggcucacaccuguaaucccagcacuuugggaggccgagguggguggaucacuugaggucaggaguucgaggccagccgggccaacauagugaaaccccaucucuaccaaaaauacaaaaauuagccaagcgugguggcaggcaccuguacucccagcuaccugggaggcugaggcaggagaacugcuugaaccugggaggcggaaguugcagugugccgagaucacgccacugcacuccagccugguugacagagggagacuccguuucaaaaaaaaaaaaaaaaaaaaucaguuccuaguacaaauucacacggagauuuuuggagcacauccaauuucaauagcgaauaaaaaaguacaccagcauaguagaaaucaauacauauaugagauuaggacagcaaguaucgucguguaaguaaaaaacugguggucacaguauccguguuuuuucucuagaaguucagauugaaagaagucucacaaucccagaccccugauuguuuaaaggucuccaggcaucgggucaugucucccaaagccuuacuacacggucuugcuuucugggugguuuucccaauuugugacaagaacuuguuuguaauuucccauaguugucagagguuuuagguccuuacccagaaacggauuuucuacagaauccaucucgaguuccugaauuugcuucucgggcuuuaccuacuguucaggaugccucuucauagggaaggguggugcgaggcaacagaaaggaaaggaguucggggacuuugaugggcagggugcagaaaaggggggcgucgacgcucuacgagugaucaagagucccgauuuugaagggaaggacagccccacaguagcuagagccccgcuccaggaagcugcagcuggaagaacaggucuuccagcucucgguccccaaaccuggaggcugcccaggaccccccaaccucacaggcacccgagcuccagaccuuagcgacagccgcccuugguugugaggccagccugaggcgcccggcguucccacccccaacccgaacucacagccggucuccuucuugaucuccucgagcucuucgucccgcaguaacguggaggcccgagaacccaucgccgugccgggagcuccuccgggagcagcggcgccagaagagacggcgacaggagggaaggagggagggaaggaagggcuaggggucaagaagggagagggcaguguuuccacugcggacccgggagggaacccagggguggu

SEQ ID NO: 191223 - RNA, 15620 nt, Homo sapiens
gacgacugucugagagaggggccgcuacgccgcacagcaaacaagcuccgcgacguuuccaggacccggauaaucccgcccuuagagcagagccggaagaaggcgggacgaaccggaagagggugaaaugcuuucgguaggcacuccacggcugugaagauggcggcggcugcguggcuucagguguugccugucauucuucugcuucugggagcucacccgucaccacugucguuuuucagugcgggaccggcaaccguagcugcugccgaccgguccaaauggcacauuccgauaccgucggugaguauucacuucacuaacgucugaaccuagaggagcaagggguggggcuacggcggcccaagggguccaugaagguuccgcaaaagucucuucaaaaggggugggguugcugggauggucuguguggcuagccaacugggacccaccucccuggaguggaaagccgcgcacuucugugauuaggcuagcgggaauguaagggccacuucagcaacagaaaggagugguggagcggcuucucaucagaaaaacagaacuuucagugccugacuugagauguaaacuugauguacaaacggagaguuguuuaucuuucagauguuucacagaauccaguguccccggguuggauaagaaagauauguaaauaggagucuucauuucuuucuuucuuuuucuuccucugcacuucuuggucccuggguaauucugcuuacgagaugguucgacuucgcuucaacuuuggaauggcuauucuaagcuuuacugugugacuagaaagcauagagauuuaagaaauguguuuuaacaugggaaugguuaaaauugaagaaauaguacuuaaaauuuaaugugguaaggcuagucuuucauuuggauaauuaacuacauggguugacccuuucugccccuuacccauuuuaaaccuuauuucaguaacagguauaguccugugagcagacaaaaaccagaugcagggaggaaaugcugaaaagcauuagccccauuaaaccuacguuggccuuuuuguuucauucugcucugcucacugacuguaauguccaaaucuuauuugggcuuuuauuaugguaaacguuauaccuuuuguucaguggugaagauuuucagguguucaguuagguuuuuacuuguuacuaaaaugguuaauaguuaagucuuuuuagauuugaaaauaaaacucugguuauuugcacacagaauaguucauuagaaaaaaugauugguuauucugagcagugauuggugaguaaagggaaugaacugauuaagggguacgucccauaaagauuuaaguuaaguuggaauuucuagcagucuuagauaguuauaugaugcuuugguaauugaagccaucugaggcuaauuaucuuuccuuuauguuugcaggggaaaaauuauuuuaguuuuggaaagauccucuucagaaauaccacuaucuuccugaagugugaguuuuugaauuucaugaaguuuuaauuugaauuuuaaaaauuuauagguaauguuuuaaauuaccuauuuuauaaguucugaaaucuaauagucuggcauuaucuagguauaaauauuuuuaguauuacuaagguccuuuuacugaaucaucuucaaaguacucgugugaacuuuauuuucuucucuuguuuuucugguguuuacauugcauauauacacuauguagacauuauauauuaguauauauaauguauauauuaauauauaugcuguauauacuacauugaauauucagucacaucucagucgaauuacauuuacaguugauacuuucugagaaaagcauccuuaggugauuuugucauuaugcaaacaucauagaguauacuuaaaacuggauggcacuacacgccuaguuuguaugguacagccuauugcuccuaggcuauaaaccuguauaacauguuacuguacugaaugcuauaggugguuguaacacaaugguaaguuuuuguauaucuaaacauaggaaaguagaguacaaauacgauauuacaauuuuaugggacccccguuguauauguagucuuucauuuacugaaauguuauguagugaaugacugugauuauguugggguugauucccugcauggugguuuuaaucuguucuguguagauuaaagagguuuuacucuugugugcuuguuaaauguuuacugcaaacaugaccuagguuugucaggccguuggcugugaaggaauauauuuaguagauccuuuauuuacaaaaggaguauuuuacugcuuuggaagaggaagcucagauauuaucaagaaauagggauuauguagaacaaaacuaguuugucuaguggaaaaaugacuguaucugaaucuaaaguaucccauuguguguucaguaaaagcuuccuuuuaguucugaaaccggcuuuaauuuagagaacgauugaucgugggcagcuuuauuucuagaugagggauaaaaauccugaugauagaugugugauucuaugcauacugucuucacggaagugcaaaauuuuaagucauaguuggauaauuuuauucuuuucaauuguuuagugaguaauuauuacuuauugcauagacuguggggaaguaauagaaaaauguucuucccucaucgagcuuacauucuagugggagugaaaacagcagguagaauuucucugaagaauauauacuguauccaugaauauguaaucagucuccugaccagugacuuauauuugauuuagaucaaaucuacucugacacuggccuugugagauugguuuacuggguaaccuaguaacccuugucuuuuggaauagcuugacagccuguuugcuguuuuauucuuuuauuagguccagucuuuuuuucucguguaguuugaucuagugguguuuugccaaguuaaaccaacugcauuuuuuuuaagauggugucucacucugucacccagacuggagugcagugguacgaucuuggcuuacugcaaccuccaccucccagguucaagcgauucuccugccucagccucccgaguagcugggauuacaggcaugagucucuaugcccagcccuaacugcguauuuugaaguguuuauauuucauuguuuuuggaggauuugaggcacuuuauuuuuuguuguuguuuuuugagacggaguuuugcugugacgcccaggcuggaaugcaguggcacgaucucggcucacuguaaccucugcuuccuggguucaagcgauucuucugccucagccucccgaguagcugggacuauaggcgcgugccaccacgccggcuaauuuuuguauuuuuagcagagguggggguuucaccauauuggccaggcuggucucgaacucccgaccucaaguuaucugccugccuuggccucccacaguucugggauuacaggugugagccaccgugcccggccugagacacuuuaacauuaucuuuuucuuuguuauuucugugcuuucucauauuuaccaguugucuuugauuuuguacuuuuugggggaugguauauagcuuuccauggaauagcugggaccauuuuuuuuuuuuuuuuuuuuuuugagacggagucucgcucugucgcccaggccggacugcggauugcaguggcgcaaucucggcucacugcaagcuccgcuucccagguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccgaccuuauugucucuuaaagccuuucauuuaaaguucuaaauauugucuuguaacauaaacagcaguauuuuugcugccaaauuuccuuacaagucuccuguuugggggauguguucuuacuggcuuuuuauuaguuaauccugucccuguauggauuauuuugaauaguucauagcccaauugcuuuuuaucauuuccauaaauucuauccaacaggucaaauuuuugaacauucuaauagaguccuuugaaaauguguuggucaucuaaaaauuaguuugagaaaacaguuuaaaagaaaaaaaaaggaagcuuauaauuagguugcuucuuuuguuaugaaugaaaaguagauuccuaaaugcagucauguuuauuuuugucauguuuauuauuacauuuauauaaaguagggagucuuuaguauauuuuuccuuucauagcuagaaucaaagauaaaagcgaauacugacuuccuccagcuaaucagucauauagucagauuuacccucccaagucuucagaauaaugucuugauccauuagaauacuguguuccaaacuguguuuaaugagcuuuaugaagcuuccaugauaacaugagcuuccuugaggccucuuuuaagguaggcuuugaaaaaaaaaaucugauacucuuaucuuugcuuuugcuauuucuaccuuccacagccauguuugcuuuucguucauugcucuuucuguucuaucuugauaucuuucaaggucugagauagcaauuuugcucucaguggaacuauuauguauaucaucauuuaacaccauuuaacaguuguuaauauugccuugugacaugcauuccuaauuuuauuauugcuugucucuucaacuagccuuuugaagggucuuaauaauuuguuuccacucguuucccucuuuagccuaacagugugccauuauaccuuuguaauacuugugcuauuuauuuauuuauuuauuuauuuauguuuuuugagacagggucucgcucugucgcccaggcuggagugcagugguaccaucauggcucacugcagacuugaccuccugggcucaagugauccuccugccucccuugccugaguagcugggacuacaagcauguaccaccacgccuagcuuuuuaaucauuuuuuguagagaugaguucucacuauguugccuaggguggucuugagcuccugggcucaagcgaucccccugccuuggccucccaaacuucugggguuauaggugugagcuaccgcaccuagccugcucaauaaauacuuaaauaauagaagacuggcuugaauuuagagugcuuuaucacucccagguuuuucucaauagagauccagaaguuaggacuuuauggcauaaaaauagauccacaguuuccagagguuaaaaacugcuuaccugcuauuuuucuaugaacaacaauacuuuuaucuuaauauccagcucuuuuugcauguauuauuucaauaccuuauguuuggagaaaggauggucuuugaguaucucaguuuaggguacgaaaugaauaggauauagguuaacagcuuaggaaaaaugcuuuguuggggaauuaucuuuuguuaacaaagauuucuucuuuuguaguugauggagaaccuugugaccugucuuugaauauaaccugguaucugaaaagcgcugauuguuacaaugaaaucuauaacuucaagguaaggaacauaaaauuacagaguuuuuuuggaccuuagugauuaucugguuccagucucuuaauuucauagaggaaagaguaucauguagcuauggaggaggagagcugaaacuagaaugcaugcuucccaauuugcagaccaccaauucucaaacuuuuugguuucagaacucuuauauuuguaaaaauuauuguggacuccagaaagccuuugagcauguggguuaugcuauuagaaauuacaacugagaaaauauaaaaauauuuauuaguuuauuuuaaaguagcaauaauaaacuuauugcauguuaauauaaauaacuguuuuucccagaaaaccacacagaagaguaggauuguuuuguauuuuuguaaauuuguuuacuaucuggcauaacagaagaucacuguauucuuauauucccuccuucacucagucuguugcaauaauuuggcuuaaguacauguagaaaauaaugaccucauacagauauauaguugggaaaaggaaugguauuuuaauggccuuuucagauaacugaggauauucuuuuuugauucuauaccaaaacucaacaaguggaaguuuuuaaagguuaguugcaauguggaaucugaaauauuaaugaacuuuuuuuguacucugauaagaaauccacugauaugaauguaucuuuuaccugugugugaucuuguagcaucauuuauuggucauuuagaaaauagcaguugacugaauuauauacauuuuuauaaauauuaacucauuucacacuuagcuaaaaauuacauuguuuauaacuauacccugcccucuucaucucaucaguagguucuuaaguuuuggaagccguuaaauucaguguagcagauacaaguucuucaaaauuccaguuuuugcuugaaaucucaaauuuuauuuuggcagugaauacugucaguugucuuccuugaggggacagccucuguugcccauuuccagagaaauaacucucaaauaaccaagucugaguaaugguaguuuuucagucauucuuucaaguaaauaugguguuucguggaaaaaaugauuaguuuaacucacaagucaaagcaauugcagagugcuuuaucucaagacaauaauuuauuguauuuugcaugcuuuccauuuugucaccuagauuauuuaaaaagucagguacucaaaagguccagauuuaauaacauuaauaauuuuuacugcuuuaucuaggauauucuuacauaaaaguggcauuuuuaaaaacugccaguuugugacuaugaagaauaugacugcuaguagaauuaaaugccacugccuuaguuccugauaaggggcaacaguuuuacccacuauugcuuuuguaauaucguuacaagucaaauagcauacuauuauuauuaugaaaauaguuuuuuuuuuuuugagauggagucucacucugucacccaggcuggagugcaguggcgcgaucucagcucaccacaaccucugccuccuggguucaagugauuguccagccucagccucccaaguagcugggauuacaggugucugccaccacacccggcuaauuuuuguauuuuuaguaaagaugggguuuugccauguuggccaggcuggucucaaacuccugaccucaggugauccaccugccucagucucccaaagugcugggauuacaggcgugagccauugugcccagccaugaaaauaguuuugucuaugguucaacggccacacuuuugagaauugccauaaucuagaauacuugagcguugaaaauauauugcucaaagaauaaagcuggaagcaucacauuaccugacuucaaacuguacuacagggcuacaguaaccaaaacagacacaaagaccaaugaaacagagaagacagcccagaaauaaggccgcacaccuacaaccaucugauauuuaacaaagcugacaaaaaacaagcaauggggaaaggacucccuauuuaguagauaguguugcgguagcgugcuggccauaugcagauugaaacuggaccccuuccucacaccauauucaaaaaucaacucaagauagauuaaagacuuaaauguaaaacccaaaacuauaaaaacccuggaagacaaccuaggcaauaccauucuggacaugggaaguggcaaagauuucaugaugaagaugccaaaagcaauugcgccaaaagcaauugcaacaaaagcaaaaauugacaaaugggaucuaauuaaguuuaagagcuucugcacagcaaaagaaacuaucaauagaguagacagccuacagaaugggagaaaauauuugcaaacuaugcauccaacaaaggucuaauauccagccucuauaaggaacuuaaacaaauuuauaugcaaaaaacaaccccauagaaaaguggguaaaggacaugaacagacacuuuucaaaagaagauauacagccaacaagcauaugaaaaaaaaaaagcucaguaucguugauuauuagagaaaugcaaaucaaaaccacaaugagauaccaucucacaucagaauggcuauuaugagaaagucaaaggauaauagaugcuggcaagguuguggagaaaagggaaugcuuauacauuguuagugggaguguaaauuaguucaaccacuguggaaagcacuguggcaauuccucaaagagcuaaaaacagaauuaccauuugacccagcaaucccauuacuggguauauauccaaaguaauauaaaucauucuaccguaaagacauaugcacauauauguucacugcagcacuguuuacaauagcaaagacauggaaucaaccuaaaugcccaucaaugguaaacuggauaaaugugguacauaugcggccauaaaaaagaaugugauacauaugcaaccauaaaaaagaaugagaucauuuccuuugcaagaacacagaaggagcuggaggccauuaaccuuagcaaacuaacacaggaacagaaagcgaaauaccacguuuucacuuauaagugggagcugaaugaugagaacacaugaucacaaagaggggaacggcagacacugggccuacuugaggguggagggugggaggagggagaggaucagaaaaaauaacucuugaguacuaggcaguaccugggugaugaaauaaucuguaaaacaguucccugugaguucaguuuaccuauauaacaaaguugcguauguauaccggaaccuaaaauaaaaguuaaaaaaaaaauauauauauauauauacacacacauauauauaguucugaguugaauuuuucagaccuuuuccauucuguuucuaucucucaauuugcauuuuuaagaagauuauccuaguucugugcuugcaacaauuuucugcucuaucuuagcuuaugagcaugaauauuuuuuuguugauguuguuaauuuggucaaguaaaucuuuuaaguauauuuuaaugugacaaaacccucuacacucuggcaguuucccagucuacucagaauuguuaguagaacuaugccuugugagccaaagacuagagucuaauaguccuugagucugauaguguuugauucuuagauauuuuuauauagagccuuuaucugaugcuguucauuuuuaaaauagcaaacucaaaauuguaucuguacugcaggugaacuguuuguugugcugugcucuuaguaucuuauuuuuuggaaggugaguuaacuacucuguauuaucucuuuuuccaggcagaagaaguagaguuguauuuggaaaaacuuaaggaaaaaagaggcuugucugggaaauaucaaacaucaucaaaauuguuccagaacugcagugaacucuuuaaaacacagguaaucuuugaaagugauuggagauaaauagaauaggcaaaaauuggaauguauauauuuuuggcuguauccacuuccgacuucucaaguauuucuuuuggcagaaguaaguggaagcauguucugauagguacauagucagccacuuauacauacucaucaaagagagguuguacuuugcuuuguguguaaaaagcaaacccccauuuuuuuauugugguaaaauauacacuacauaaaauuuaccauuuuaaccauuucuaaguguauaauacaguggcauuaaauauauucacauugcugugcagccaucgacccaucuccaguacuuuuuuuuuccccaaggcagauucuugcucuguccgccaggcuggagugcaguggcacaaucucggcucacugcagucuccaucacccggaucuaagcaauucuuucaccucagccucccaaguggcuagggcuacagauucacaccauuacgccuggcuaauuuuuuuuguauuuucuguagagacaggauuucaccauguuagccaggcuggucuugaacucuugaccugaagugauccacccaccuuggccucccaaaaugcugggauuacaggugugagccaccgggcugagccccaucucuaguacuuuuaucaucccaaacugaaacaucauaccuauuaaacaaaaauuccccaccuuccaaccccaagaccaugguaaccacucuucuacuuuccaugaauuugacuauucuagauaccucauauaaauagaaucauacaacuuuuguucuuuuuugucugacuucuuccacuuagcauaauguuuuuaagguucauccauguuauagcguuaucagaauuucauuccuuuuuaaggcuaagugauguucuauuguauguauguaccacauuuuguuuuuccauucaucuguugauggacauuuaaaacgucacauuuuuaauucuuuggucuccucaucuaauuaauauguucccagaaaaaucaggguuuuuaaaauuuacuucuauagaucugaaaucagaaggguaucaucauugucuuagaguucaauuucacaccuuaauuuuguagaaagagggagaugugaauaaucauacauuuuucgugcuuacacauaugcaaucauguaaguggagauucugauaucaaauuuuguugucuuagaaauaguaaucucaguuuuuugauagaaaaauuuuauauguguugaaaauaguuauaguaauuaucaucuauacuuguccuuacuauauuuaaaaauuauuuuggaauauuuagcaacuugccuugaacugucaaauuacuagaaguaaaguuuauuauuaagaagacaaauuuagucauugguaauugaggccagaugcgguggcucaggccuguaaucccagcacuuugggaggccgaggugggcggaucaccugaggucaggaguucaagaccagccuggccaacauggugaaacccugucucuacaaaaaaauuagccgggcaugguggcggguaccuguaaucccagcuacucgggaggcugaagugggagaaucacuugaacccaggaggcugagauagugucagugcacuccagccugggcgacaagagugaaacuuggucucaaaaaaaaaaaaaaaaaagggauaauugaugagcagaugaauuaauugguaauugaaggaagaguuccgcuuuuauuauaacuuagauuuuauggucuuggagggaaaagaaaauagcuuuaagauggugaaagaaugguagagaaagcuagaagcaaugugauguuguguaguuuguauguuuucuguugguuuuccaaauuuaucccuuagacuaggaggauugguuggucuuuucuuggauuugauuauggaaagcuaccugaugcaucugguugcuggaggcugacuacuuuuagaugugcuguaaucuuuccagggucuuggcuuauugguaagguuuccucuccuccuccagucuaauguaacaggguugaauuacacagucucauuacucaggaaggacaaugccucaucuacugauaacugguaagaaagauaauuaguguaguuuuuuacaggcauaaaaaauguaguaugguggaagggacagcagaccuaagcaucaagaauauuagguuuaggccgggcgcgguggcucacgccuguagucccagcacuucgggaggccgaugugggcggaucaugaggucaggagauugagaccauccuggcuaacacggugaaacccugucucuacuaaaaauacaaaaaaauuagccaggcaugguggcgggcaccuguagucccagcuauucgggaggcugaggcaggagaauggcaugaaccugggaggcggagcuugcagugagccgagauaacaccacugcacuccagucugugcaacagagcaagacuccgucucaaaaaaaaaaaaaagaauauuagguuuaaauccuauuucuuugucuaaagcuuuguaguuuugagccacauuuuacucaucuguagaaugaggggaaaugaucuaagcuucuucuauccuaagcauacauccuauaucuaaagcuuugucauucuuaaauguuuauuauucugauagaaaaauugaauggccauuuugguuugauacuauuuucuaguucccagcaggguuuuauucacuuguuugugguuaauuggaaauguuuugucuacugaugcuguguuauuauauuuacuaguuagggugugguguuuuguucuaaccauuucuuuguauuuugagcuacacuuuucuucuaguauuuacacaccuuuaauguuuuguuuuguguuucuuuuauagaccuuuucuggagauuuuaugcaucgacugccucuuuuaggagaaaaacaggagguaauuguuuucauuauauauuucugagagugcaguaaaaacuuugguggugcaggagauacccgugcucacugcaucucuaaggagggagugcugcaccuggggagcaggcuuccccaguggcuacaggaacuugggcagcuaaaaacaagaaguucugaauuaauuauuauuauuuuuuuaauguuuaaaggcuaaggagaauggaacaaaccuuaccuuuauuggagacaaaaccguaaguauauuuggggauuuggggcauugaacacauauuuuaguuuucuuaaauuuguguauuucugaauuguucucccauacuaugcuaauauuugaaaagaaaguuaaaucuggaagcuauagaccaaaauguuaaaaaugguuggaucucuggaugauaguaugagugauuuuuaguuucuuuguguuuucugaauuuucuacuguacacauguauugcuuuuauaauuauccccccauaaauaucuguaaacaggaagaaacuuauuaaaaauaagaacucuuaaacuucaucuaaaauuaucugugauaaaauauaauugaaagagaguuuggaaaaauugaaauaaggucuaaagcuauaaauaugccuuaaguuuucauaaauaugcauuguauggauacuauuuucaaauucauaauuaauuccucaaaacaucaccaguuaaaaauuuagaggaaggaugacagcuaucaauguuggguuaugguuuuuacaaagcugauuaaaguuuuuaauuuuauaacaacuuuaugaagguauaauauacauauuacagaaguuauguuuuguuucguuuuuugagacaaggucucacucuugcccaugcuggagaacagugguaugaagauggcucccugcagccuugacgucuugggcucaagugauccuccugccucagacuccaaguaacuggggccacaggcacauaccaccaugccugguuaauuuuaaaaaauuuuuuguggggguugggucucaccauguugcccaggcugguauagaacuccuaggcucaaguaauagucucacuucagccucccaaagugcuaggauuauaggcgugagccacugcaccuagccuaaaaguuguuauuaaaguuauuaaagcauauaauugagugguuuuuaguauucucaaguugugcaagcaccaaucgcuaauuccagaauuguucauccccaaaaguagccccauacucaucagucacuccgcauuucuccugcccccagccucugacaaucaguaaucuauuuucuuucucuguacuugccuuuucuggacauuuuguguaacuggaaucauauaauacauggacuugugucuggcuucuuucacaguuuacacucugucucaacuuuuacuuccugcuugcacagaaccuuaagaucagccagugaaugauuagggccuccucaggucucuccuggaccugugcacagcccugggcaugugugcacagcccugcacauauggccuucuagauuuccaggaauauuuuggagcuuuccaaaauuccuauggacaucucauucuccaauuuuuccuuuuaaguuuccaaucagccucuuaauagccucaguugguaaggucaccucaggcagcugugaucuugaaggauugcuguucaauguuuuugacaaaugcuuugaguacaggguuguugacacugggugaucucugagucaggucagauaaagacaagcccugagaauggagcuuuucagcaauuugccagacagcucaggugaucagucuuuuagggaccuccaaauguauuuuuuccuuugggaggccuaggugggcagaucacuugagagccaggaguuugacaccagccuggccaacguggugaaaccccgucucuaccaaaaauacaaaaauuaggcaggugugguggugcacgccuguaaucccagcuacuugggaggcugaagcaggagaaucacuugaacccagaagguggaggcugcaaugagccgagaucacaccacugcacuccagccuaggcaacagagugaaacucuguguuugcuuccccuacccccuuugccuaguggcugcuaagcuguuguuuuuaucagcuguuaacaguuucagggacuuugguuuuaaggagcuugggagagaggaaugggaauagggugaacacagacaucucaagcuugcuuuucuuuccuagauucagaugccuuucuugaagaaacauuucuuggauuguugaaagacuuuaauaauuuccaaaguuccaaaaguugauuuugauaguuuuugccaguguuuucguugcuuuuauggaugaguagauuuucagaguuucuuauucugccauucugaaaguguucucacuaccuaaaccccaguuuuauuuguacagaauuuuaacugaauguaaguuaggcaugacagucuuuguuaauuuuuuuaaacaaaagauagccauuaggacuggguacaguggcucacgccuguaaugccaacacuuugggaggccaaggugggcagaugacuugagguugggaguucgagaccagcuuggccaauguggugaaacuuugucuuuacuaaaaauacaaaaauuaguugcucaugguggcaggcaccuguaauccaagcuacucaggaggcugaggcaggagaaucgcgugaacuugggagguggaggcugcagugagcugagaucacgcuacugcacuccagccugggcagccagugagauuccaucucaaaaaaaaaagaaaaaagauauucauuggauuuucucuuacuaauagguauauauucacugugaaaauggagacgauauacauaaaugaaaagaagaaaauaguaaucuauaauaccaugcagugauauauuuaucuuccuauucuuuuguauaugggcauguuuauauuauuuuaaaaagggaaucuuagaguauguauuauaugacuuuuuuuuguagcuuagcaauauaacauggacaugucgucaguuugguaaauauuguauugcaucguuacuuaaaugcuuguauagugucuuauuguaugaguacauugcaauuuguucaauucucuguucuugaacuuuuaugaguuucauuaucuuggaauuuuaugcaguguugugauuaauauuuuaacuacauuugcuuuuaagucuuuauuuucugaucucagaagaauuguauauugggauaaguuuuuaauucuauaacuuaaaaguaaaaauccuuuguaauuuuauguuc

SEQ ID NO: 191224 - RNA, 52818 nt, Homo sapiens
gaccagccauacacaugccuuuauuuagaucagcuuuuuucaaaaugcagccaaacuuaugaguuggacagcccaaaguaaccagcccuauuccacugaguuaguuuaccccacagcaguagaacccagugcugguuugguuccuggcccauggugggacagcgugaaggugauggagggcucuagcacaaggaggugcugagugccaccggcaggugcuucugcagacagccuagagcaagguaagcaggagcacucgcuucagaaccgaggcggcucggaccagaggcaggcacuuuccuccacauggcaaagggacaaggguuuguucuuccuaccucauugcuuuacuaaagggucaggcuaggcaugaccgaucaaggauggguaggggguaaaauggaggaggagcaugacugaugaggugccuggaagccuguagggguguagcugcuggguccuuugagguaaauggcuuuggaaauagagggugaaacugaaauccugagugauccugcauggcuuuggaugaggccagccugguucaggcauacauggugagcugcagccacugaaagaagucccaagaucagaauguagaucagaaaagagugaccccccccccccccgcccuaggaaucuuacggggcaagaggaaagggaacagucccagcaggucagacccccagaagauuuuccaagaagcaguggcuuacuguuuccuuucuccuagaucuucccuaagaaggugcauguuuucccgcaucaagugacugggggagcagagguccuuuugggccucaagugcauguguccugggagccugcugagccucccuccauguucuguuccuaucccuucccuccaccacuguguggaaaugaggagcacacccuggguccaguccgccccguugaccccuccaccuugaguuuuaauguguagggggaaugugcugugccuaugcuuuaccuccagaacguugagcuugaugauaccaucuccauccuugucaaaugcaugaaaagcuccugugaaagaaugcacaggccagaggccaguuacaggcgcacuccgccucuacuacuguaacuuccccucagaggaccaugugcccagugcugucccucaucagcacaaagaugugcaggcagagaaucaccaguaacccucccuuugccaucccauucugggccuaaagaggucauuggcccuuguucagccuggauggagcagacuggagauuaucaggugagaugccuguugccacaacugccccugcaagagagcagagggcagccccccucucccacuuacugaacaugcccuccagccuaacgaagcagcagaugaaacugucaaagucgauguucauguguuugucugcguaccgcaugguaaugaugucauagagcugguuguugagguggaauccuguggaggggaccauguuagagguggacguggagcuggaggccuugggccugccuucuauuuucccugccucucggccacucugugaccugggaagggaaagugagaagcccuuucccucuccuuucucuaguggggcccuaguagccuaguccccucccauuccugcucccaccgucucggguccacaucccugccaccccuuccuucucagcaccugcgucguugacugcauuucgcaucucguagcuguugauggugccggacuggucugugucauaguguuugaaaauuuucuggcaauagaaaauuugaggauggaggucacacacugaaucuccaaaucaaccccauucuugacucccacgcuucauuuucucuucccaccugccaggccuuaaucuuguuccagaggugguggaacuccugcagguugagcuuuccagagccaucugucuggaggagggaggucagggcuacacagcacacagcaaaaucccccuggauuuggagggagggucuaggagacuccgggcuguccuacccacugcccuguuguacuauuuaacccuccccuccacuccaccaccagucagagauugcgccuacucuguaacccaggagccgcucuccuaaggaccacuuuugcuugggcaggaucccaggccugagagaagcacagggguuagggcaguuacaacccaacauccuccccuuccgccucuaacaaccccuuucagacgaguauccaagauguucugaaucagggucuccuuaaguuucccugggcacaaauuagggcccuuugccugacugggcacccuguauguugccuuggcccccgugggcugaugacagagggucgggaaggggcggcaggaaggauacauccaugagcgcaaucaugcuacggcaggacuccagugugaacccgugugucuucagguccuugucuggggggauggagaagagugaggagcugcuuugagacaacgggacuccccacccaccccacccccauuugguuugagcaacucacguuuguucacgacuguguuaaggaccuucuugagcucaucugcacagaucuccauguccugaggaggaagggagaggagggucaugguucaggaguacagcagcuccuggcgcggacacuuugcaaaacaaauuccaccuggcuguguuuguaaaaucccugucggugcuauuaugucaugggaagcuggggcuuuucugaggaagacagggggccagauacugcaccucagcuaucaggaccaccgugggcagcucagagcaaaaaggccucugagccccccagcagacguggcaguccaaaacucaagggcuuguggauuugugugcuacgcacacauccccuggcuccaccaaaguccaaagugaccucuaccaaacaauaaugaaauaauugguaaucugagcaguuaauccaggagagaaggaagcaccugugggcguccugggcuuggagguacucacaucuccugcuaucugcuugaaaauguuccggaauuguugcuguuccucacuuuccugaucagagcugccaggcuguggcuguggaggcacaaaggaaaacugguucacaggggucagaggugcacaggccugugaggcaagcuccucugggccaagggagccaagugccuaaaacggccggagguggcagcaggagcuggggacgggcaaaugcagaccuggugagcuggagugagaugcaucgaggccucagggacucuucacaccucuccagcccugacgcccccagccaaaggagauauggcggccauacagccuccuccccgccaccccaguccccaccugcaagagcccccuccaccaucccaggccugaccauuccaacuaaaggugcccgcaggucaaagaaggucugaccguucugauuccuccagccacccugucaucaaggccaaguccucagagaaccuccccuaggccccacugcaugaggccccagauagaagaggggcucccagacagaagaggggcccuggauagaagaggggcccccggauagaagaggggcccuggauuggucuggagacuuuugccucuaaggcucaccuccacuaagcucccacuccaaucuaacacccucccgugagcucuagaggaccccauuucugaagucagccccacuuuucugcuccuauccuuuaucccccuauugugaaaugcucaaggccaccaggagacaagaguugcgccuccgcucucaagcugguucugucucagccuuugccuccccuucucuguauccuggcuggaucagcuccaugggaggcucagccugccaguccacuccuagaauggaacccccauccugggauauucacccaagcagcagcccaaauuucaggggaacuugcugaaagaaaaggucagugggacaaauucaaaccuccagauguucaagacaaacuccugggaagccuccagccccuguguaucccaagcgcauaggaagccccuguagcgugcuggccaccccacccaugccacaugcccagacaccuguggggacugcuuuugcuuaucagggcuuguuuugccuuugcccuccucugacuccugguccacacccagcuccuuguugcuguuugcucuguccgaaacgaagaugaugggcuggagagaggagggaggaggcaggaaggaagggaggauuacagucugaacaggcacacugaggcagcaccucucuuggagcagcuuuauccagugagaagaggaaaggaauaggcgggagcucuucaaccucgguucaagcucuaucucugccacugacaagccgugugacuucaguucuuuaucuuuucauacccacuccaucccuccucaugguagaguauugagagcucagcacgugaaaugcuaagaaugcuaaaagcagcaugaucuagugcagugauugucaaguauuuuguagacuuuuuuuuuuccagauggaaacacuguucaaauuaaauuuccugcagaaacaugguguauauaaaaacacaagcuucucugauuaaugagaacagagcucuuugcccucagcaccccacaucaccauggcagcuacugaggcaccucaaaggaaccucuacaacccugcaaaguauagauugaaaaaggacacggauuaguggcauggucagugggugagccaucagaacacugggcuggaaucccagcccugccccucauauaagaaauauccucucuggccgggcacgguggcucacgccuguaaucccagcacuuuaggaggccgaagcaggcagaucacaaggucaggagaucaagaccauccuggcuaacugggugaaaccccaucucuacuaaagauacaaaaaaauuagcugggugugguggugggugccuguagucccagcuacuugggaggcugaggcaggaaaauggugugaacaugggagguggagcuugcagugagccaagaucaagccacugcacuccaggcugggugacagagugagacugucucaaaaaaaaccaaaaauauccucucuggccucaguuuacucauccuuuaaugguaaaaucugcuuucccuccucauagggcucuuguggggaucaaaugagauacugaaugcaaaaucauacugcaaaaacauuuaagaugcuacacaaacaagggauauuuucaagacaugcucgugcaagugacaaggauaugaaaaggacggagagcggcugcugcauggugccaacacuguggaugcggugcaccuguagggaaagccgggggaaggcaaggcuguggggauugaggcugcaaugcagagaacaacugggcaggcagagccucucggagcagaaaagcagcccgccuggacucaugcaccacugcccuuccaugcugcucaucuaggacagcucaagcagauagacccguggaaacggcuccccagcuuuggcucccagcaggccccagaggccuuggcuugcucugccuucuaagcagugucuugcucaagcagcugaagcuuguggggaucccagagcaaauggaggucacagucugaggggggauguguaggauggauaugguguggccauggagcaucccugccaggcacacacuggcaggcccgagugugggucuggacaacacaggccuugaaguguagggggcuggcaucagagaaagagggcaagaaacacagguuuuggaguaaacagacaugguuuccaguuccauuuuccccacucauuaguucuguuccuugggcaaguucacuucuuugagucuaucucaccugugaaaggggaaaaauaacagcaccuacuuuguagauacuguuauaauugggggggaaaaaaaagagagggacugaccccaagcacagugccuggaaugugguagugccugaggagugucagcucuggucugggccagcaccaguaccuggaggaccccugugauggauccaucaccaccaggcaccaccagaaaugcuagcaccaaaucugaugguguaugauggccucuugugguucaggacacggacucuggacccagacugccuggcucuaaguacuggcucugccccucucuggcuguguggccuugggcaaguuagucaagucuguaccuuuucucccucugaaaauggggauaguuauaguacuaaucucauagggcuguugugaggaaggaauuaaucauggaaagcaccuaaaagagugcuuggcacguagccuucccccagcaaaucguaguugucauuacugcacgcucggccccagcagaagcucaggaaggagggggaggaagaggcaagucuggugcauggaugcauaugagcucacacaugcacacuucacaugcaugcacauacauaugcaugaguacacacacuucaugcucucuacccacacaccuaccuugguuuuuuucuuuuucugcauaagaaaaggaaacaguaaaugcagaauaagugaaaaguaaguucucagaaccgccaguggcuuuuggcuucccuguauccuggucuuuagcuugggguggggcuccaggguccagaaaucugaaucacauggagccaaaaaggggcauggagggugaagggagaagagaauucuucuuucuccuccaugcccagacaccagugacugcucugacuuuguuuuuauaaucuacucuuacugcauauggcaaggaaaaagaucuucuggcuaagguuuucuuucuuccuuuuuuaaaaaaugaaauugguggccgggcgugcuggcucaugccuguaaucccagcacuuugggaggcugaggugggcggauuaucugaggucaguaguucaggacuauccuggccaacauggugaaaccccaucucgacuaaaaaauacaaaaauuauccaggcgugauggugggcaccuguaaucucagcuacucaggaggcugaggcaggagaauugcuugaacccgggaggcggagguugcagugagcugagaucaugccauugcacuccagccugggugacaagagugaaacuccgucucaaaaauaaacaaauaaauaaauaauaaaaaaaugaaauugguuacuaaaacaccaaaaacauggcucucucaaacugaccuaacaauggauuuugacuuacagaauauuuuuuaaaaauuuuugagcaagcauuuaacauagggagauuuucuuugguaaaagccccagcuguggcaggcugcccugggccuguaaucccugcggcaacuaucagcugagccaagggcccugcucccugugucuuccagauugccccacgccccaacauuccuguugacccucgacacuggagcgaaaugucaauugagaacugcagacaacugugucagugcagggacaucaaaaccccugcaccugccugcucuacucacgugacgugccagcucccauaagcuuuuggguuugcagguccugaucaauacugcacaccgaugaccagcauccagaugaccagaacagauccccacacaccuaccacuaaaaccaaucgccuguggucauucagaaggcacuuggagaccuggcacuggcucagggucaggauuaugaccaugacugucacugcccagaagacaguucagaggggcauuuguccucccauuggccuacgucauccccacagagcacaaaggacugucagcugacuacagcccaaagccccaaggcagucacaagacuccucaacacacagagcccaacacacagcacucugugcuucggacuuugggcuucucacugccuggggcuggccucagcguggaggugcggaaaaaccuaagucuggagucagagagucugaaugugaguuccaacccugccacuuacugagcucugugaacucagagaagucauucaaccccauugagccucugcuuccuuucuugaacaccagggauuauaaccccaucuaccucucagcaaccuugcaaguaucgcgaugacacaugugaaaaguaccuuguaagguguaaagugugaaaaagcaccucuguuugagugcccaugcugugccagacacuucacauacaucaccucauugaugaagccucacaaaagccuugcaaggcacauuaucauccccguuuuacugaguaggaaacugagugagagggauuacagaaauuguccaggucaccccgcugguaaguggaggauccaagugucaacaccagguccggcaccagcuuacuuucuuuucucuaugugugaaauccaauguuauccagucucagaauccaguguucgcugcggcucuugucaucccuuccuguggccuuguucccuccgauuguucaaauugcuucuccuuuccaggacccucuuccauauuucccagccccugaacugccucaauggcccccggugcuuaaggccgauuacuucuggccaugccaaaguaggauuugcagugccaaggagggacugcucagcacagcccagacucccauucccucugccagugcccauucuccccugcaccaucuguccccugcauggucagggaaggggacccucuggacuuuucgcacagaagaucuaaaccacucaccacuggccgauccacggagaugguauuuucaacuucccugugaggaauacagacauguggggucucagugucaccagaagcaagcaggaggcccguggacgguuugcucuggugcacggcuuccuggcagccaagccagaaccagccucuagagaaccccuggaacaccccaaccccaggaaccagccccaugucagcaccauccccgacagccaagcccaggcacgcagguucuuguuaguauugcucagagccccccaaaggcaugacccagccaccuacccauggaccuggugcaucuuccaaggacagagaucagaguggcaggggcuaugagcucaucugugguggccagggacaggauguggcuuuccuggccaugcuaaccuaaaauuucaagcauccccaacaccuccuaucccucuucccuacuuuauuuuugcuccauaucaccucuccaaaucuaacaugcuacauauguuuuuccuauccauuauugucucauguuagaauauuaagcuccaugaaggcagggauuucuuucuguuuacuucacuacucuauccuuagugccuaggacagugccuggaacauaguaggugcucaauaaauaucacagaauggaugaaugaaugaauggggguaauguggccaguggcucaggagcagcagaaggacccuggaggagacgugucuagcugccucaugccuucaaccucuggagugggccaugugagcuuuuagaaacacgugggaaagcugggccagcacucacucagagagguuccucuuuucagagaagacccggaggaugaauucccccuccugguggggcucguagguggagggcacgaugacguacucgcugggaggcaggcggaagcgcugggacaccucccgcauguugauguagguuuugcuccuggccuuggaggcguuguacaggaagaaguccuucugcaggugcugcuuguucccgugcaucugagagauggggagagcccagggcacaugagccccucgggaggaacauccuguccugccacagccaccuccaagggucccuucccaacucccuggucacccaugucacaguuucaaccucccuacuuccgacucccaaggcuuaaauagccucccuaccucacuuccucuuccuuuucuguugugauucagagugaauggcaaaugugucauccccacacucagggacacuuaccagaacagcugcuccucagcuccgaagccccucaggcuggaaggacccccaaggaggccuagaggacuuggcuggguucugagggaagugauuccuccaucccaagcgggcagccacccucagaacgcgucugugugacuguguguguggcuguaagcguggaggagggugagugugcaaaggcaugugugugacgugcagugucuggugcgagggagaaagugcacauccugggggugguagucaugggucaugcaaugcccugaggcaccugcucugcaguggaaauaacacaggcaaggcccucuccuaucacaguccugcccacaaaccccaccaggaagcuucucgacgagccacagacagacucggggcccccuggguagugcugcacacaacugcuggccgcugcugcugcuauaccucuuugggaaccuugagaagaaacagaaaggaagaugcuucagaugugaaugaggaugaggagccugcggaaggcaaugccagcaacugcagcccgcaugcggaagccugacccccaggcaccuguucugccaggcccgcuccacugccucucuaaugcccccccugguauuuuuugcuuguuacaaacacaagugguccugauaccaggagcucugugggucacuggguauugaggaagccagagggccccucuagaagccccuggaagcguccucccugggaaaguauguuuccugggcuggagccaaucaggacugcacaccucguagauggcgaagccaauggugaagagacuggccccuagcuuccgguccuuccgccgguucuucugcaucagggccaccaggaagcugcaaaucaccuccgagucaucagggucaucguccuccuccaggagcuucagacgguacugaggguugguccagaaaguaucugcacccccagaaaggaagcacgcauucacagcugccucucagagggcaggaaggggaugagacagagggagccauuuauuucuauucccuacaucuaggugcuuaggaaauaucaacagaaaacacgauucaggcauuucucuaaugauuuggggggggggggggcgcuaccuuuauucagauggagcuguacugauuguauguguggcuuuuccuuccucucugggcuuucauucucagucuuugcugaugguuuuguuuuccuuaccugccccuuaaacgcuguuggugacuagaaucugguccugggccucuucuccucucaccucacccuuccugccucccuaggcaaucuuucuuacuucugcuuuuuaacugcccccuacacgcgcaugaugccugagccauauaucccagccucaaucucucucacuuuuuuuuuuuugagacggagucuggcucuguugcccaggcuagagugcaguggcgcgaucucggcucacugcagccuccgccuccuggguucaagcgauucuucugacugagccucccaaguagcugggauuacaggcacccaccaucauccccgguuaauuuuuguaucuuuaguagagauggguuuucaccauguuagccaagcuggucucgaacuccugaccacaagugauccgccugccucagccucccaaagugcugggauuacaggcauaagccaccacgucuggccucuucuuuccuuuauuccucaaauauuuuuugaguucuuaucauaucaccaagugccaucuaauaugcgcauccgaugcucuauuacaaaucuucacugggacacucuacaggaaccucaaacuuuccaugucccaagcuaaauuccuuucccuagaaccccacaauuaacuccaccaaaaacaaacaacacgcugauauuuuucucuugugugucuuuuuuuuuugaggcagggucucacucugucacccaggcaggagugcaguggcaugaucacaguuuauuguagccucaaccucccgagcucaagcaauccucccaccucauuuuuuuuuuuauuuuuuguaacgaugaggugucacuauguugccugugcuggucuugaacuccugggcucaagugauccuccuggcucugccucccaaagugcugggauuauaggcaugagccacccacccgaucuucuugugugucuuauguugcaauguugucagguccccaacugggaaucuugacaucauucuucuuccuucccuacaucacccaauaugcucucccuaaaucugcugucuccccuccaucucugcugcuacugacuuggucuagguuuucaucaucucugacuugaacuauugcagcagcugcuaacuugguucuccaauagugcccuuacuguuacugacacaguacucacagucccugacuuaggaugguucggcuacaauuuuuuaacuuuacaaugugaaagagaugcacauucaguagaaacuggauuucgaguacccguacaaccauucuguuuuucacuuuuaguacaguauuaaguaaguuacaugagauauucaacacuuucuuguaaaauaggcuuugaguuagaugauuuugcccaacuuuaggcuaaggucaguguuccgagcauguuuaagguaggccaggcuaagcuaugauguuugguggguuaggcauauugaaugcacuuuucacuuaggguauuuucaaagauggaugggcuuaucuggacauaaccucaucguaagucaagcagcaucugcauuguucccacaguuuccugcuucaaaguugcuaccagcucccuauugcaaacuucucagcauggugguuuccuucucaguaaaacagggaagguuuaauaagauaguggacgucuggaacagagagacuuaauaagcacuaguuaggcuucuucugccuggaacuuuuucggcuuagacccuccccccaucaagagcaucucccaccugggaaguugcggcagccuccggcagagcaaccccguacccagcggcccucguucacagacacuguccaggucugaagcuugucagacugcagagcaucggccgugagguugcagaucuccaacuuugugaaaugguagaugaaauccucauaggacauccugagagguuggaagaagagagagagccauaugggagcaggugaggagggcugggaacggaagaccccaggacuaacacagcacaauaauaaaauaguucacaggaacuuggucagggucccagaggagccugucuuuccuuuuuagggcaaacgcugucacuucugauguaucuacuccaaaccaucaucuuuucuaacaaugauucaaaaaugugccagggccagaaagauaaaugucgcaugcucucacucauaugugagagcuaaaacaaagcauaugucauggaaguagagagcagacagugguuaccagaggcugggaagggaaggagaggggaggaugaaaagaggguggcuaauggauacaaaaauacaguuagauagaagaaauaagcucuagugcucaccagggugcuguggcucaugccuguaaucccagcacuuugggaggcugaggcagguggaucaccugaggcuaggaguuugagaccagcuuggccaacauggugaaaccccaucucuacugaaaauacaaaaauuagcugagcauuauggcgggcacuuguaauccuaguuacuugggaggcugaggcaggagaaucacuugaacccaggaggcggagguugcagugagccgauauugcgccauuguaugccagccugggcgacaaagugagacucugucucaaaaaaaaaaaaaaaaaaaaaagcucuaaugcucaauagcacaguaagacaaacauagcuaaacaagaauuuauaguauaguguguguguguauauauacacacacacauauauauacagacguguguguguguauauguguguguauauauauguguguauauauauguguguguguguguguguguguguguguguguguguguguguguauuuuuugagacagagucucgcucuguugcccaggcuagagugcaguggcaugaucuuggcucacugcaaccuccaccuccugaggucaagggauucuccugccucagccagcugagcagcugggauuacaggugcacaccaccacaccuggcuaauuuuuguauuuuuguagagaugggguuucaccauguugaccaggcuagucuugaacuucugaccucaagugaucugcccgccucagccucccaaggugcugggauuacaggcauaagccaccacgcccagccuauauaucuuucaaaauaacuagaggaaaagaauuguaauguucccaacacaaagaaaagauacauauuugagaugaugguaucucaauuacccuaauuugaucauuacacauuguauauguguaucaaaauaucauauguacccccaaaauauggguacauauguacccccaaaauauggguacauauguaccccaaaaauauauauagcuaugauauauccauaaaaaauagaaggccaggugugguggcuuacaucuguaaucccagcacuuuuuuuuuaagacagugucuugcucuguugcccaggauggacugcagugguacaaucauaguucacugcagccucaaccuccugggcucaagugacccccugcuucagccucccaaguagcugggacuacaggcacacgccaccacaucuggcuaauuuuaaaauuuuuuguagaguuggggucccauauguugaccaggcccacaugccagcauuuugggaggccaaggugggaggaccgcuugagcccaggaguuugagaccagcccgagaaauauagcgaggcccgucucuauuauaguuuuuaaauaaaaaauaaaguaauaaaaacacaaaaaaccuuucccuugacauuauacuaagacaacauuuuuuuuuuuuuuuccaagacagagucucucuugucgcccaggcuggagugcaguggcgcaaucugggcucacuguaaccucugccucccagguucaagugauucuccugccucagccuccccagcagcuaggacuacaggcgcacgcugccacgcccggcuacuuuuuuuguguauuuuuaguacagacaggguuucaccguguuagccaagauguucucgaucuccugaccucgugauccguucaccucggccucccaaagugcugggauuacaggcgugagccaccgcgcccggcuuaagcaaacaauuuuaagggugaugagcaucauaaauuaaucccaguccucggggaacuuagggggcucuccuuaagcugagacuugaaaauucuccuuaagcugagacuugaagccugaauagaaacaaccugagagagggugagguugacguuggaagaucaggguaaguggagcuuccuaggcucagaaaagaauugugcuaaggccagggugccuguggcuggaauagaguguguggcggaggggcacacaggaggcaagagccaugucauguuggccugguccugggcucaguugucccuguggccuggaaggcuccucucagaaccucauccuugcugggccuugggcuggaggagaacacagcccagaucucccaagggcuggaaucugauaaccuuagcuggggacugaggucugagauuuccccucucuuccccacccuuacccuucugggucuuccuggguucuggacucaccagaacucuccauccucagugaccuggugcugcagacgggccuucucaucuuuguccacaaagcuccaguccuuccaucuggugggaaaauggaggaauuaaggaagcaggaagaagggaaggccugauguagguugggacaggagguaucagagaaauacaaagaguugcagcugcugugaacuaccaaaaugcugacuucaccuguuaaccucagugugaaacccaauagcaaugacuucucacauccucaagacugagccuaaacuccuuaaaugggcuggugagggcuugauccuucuuuucaucauacuuuaaagguuaagaauugaguucugggcugcucgcaauggcucacaccuguaaucccagcacuuugggaggccgaggugggcggaucacaaggucaggauuucgagaccagccuggccaauauggugaaaccccguccuaauaaaaauacaaaaauuagcugggcgugguggcgggcaccuauagucucagcuacucaggaggcuaaggcagaagaaucacuugaacccgggaggcggagguugcagugagccaagaucgcgccauugcacuccagccuggguggcagagugagacuccgucucaaaaaaaaaaaaaaaaaaauggguucuggacauagacaaacugggaguuccguuuaauaauagggcuagcuaugcaaccuugggcaggucacuuaaccucugucagacucugcuuccucaauugcaaaaggaaaaugauuaugucaccuguucacagggcugggaugggcagaugcaauaaugcaugcaaagcuguuagcauagugucugucauauaauaagaaacucugauuuacuaaggaaaaaggccaagucuguaaacaucuccuuuccugugcugggaaauaaucaagcauugugcuucuaaaggcugggcaguuuucacacucucucuccucacuaugguggcaauaaagugcauguguguuucaggcucacagaggagaauucaacuaaacugggugcucccuggaaagguaagggguggaggaagcgcuuggagucagucagagaacacugcaggggacauggagauuccugagaccaggaggagggaugcagcaaagggaaucuccuugagugaacagcguuggguccacuugucuccagccccugugauggcagcaucaugguaagcagggcagggcugcacaccaagcucugaggcuggagaacacagcaagcgucccugcaggugacuugggccagugaaguagacaacugaggagucacugagggccuucccagagcacagagcacaguuccaaugucacucccuccagguaaccuuucucuacgccuccccucccacccaaacuaggugcagaggcccccucuuugugauccuuacuguggcacucaucucaauuauuagugugugcuugccuguccuuccccggaccuuaaacccacaggcacagggcccacgugucuguguucauuucuacauuucuacauccccagguggguagccuagggccuggcagaagucagcacugaggaaguaaggauagguguagcgugcauaggugaaggaaggcaugagaaugucugcaggaggcagucaggacaugaggaucagccccuaaucacaguguaucaagggaggcuauggguucacagaauauccccagugccuugaccugugccuccuauguaguaggugcccaagaaacauuugcuaaacgaaugacugaacgaaccaguaauuacaugcugggcuaagaaguacccagcaguauauaaguacaggagccgaggggcccaggcugccugggugcgguccuucuccucuacugaguccugccaucccccucucgaaauaagaggcgcuuauggcucauucaguaaugaauugccucucauucaguggagguaaucaggaaccaguaggaccauggagguuuugcaaaugugcuggagccuucauaauaacuucgcauguuuguuauuuuuguugcccccagucuauuccuuucaaugauaagcaguaaaauucuuucaaagggcccuugugccuuuauacagggacagcacggguaagggaaucuuagcaauggcucagcacuugccaaaaacagucccauuuacuccucauaucagcccacaagguaagugcuaauaauacuguucccauuucacaggaaaggcaacacaagaccccaagaagggaagucacuucucuagcccagaacccugcauucauacgcuuuuccugccuggaccuuccccacgcuuucuggaauccuuccuuuccagccaaugguugucagcaaccucucuggguccccagcaccccgcuuccacuccuggcccuucccuggagccaacaccugugccccucuucucugcggaucauugguuuugagggugauuuuauaccaagcaucuucaauacucucauggcucaguucccaacacagccuugucccggacccuguuccccgccaccgccaaucccgugggguccccucaccuaccuaucacuccaagaaccguuccacuccaccuggccccacggauuccgcagccgcaccagcuucacuuucucaccuuugaacgggaccuuaagcacacagaaagagcucucaugcucugcagccucucuggaaagggaaucuucugucuugcugagggcugggacggggcuggggggcaaaucucuuacgcgaggguguucugccuggcucuggccaaggagauuaaucacaagugugcuggggaauggcagggggugggucagaccuuuccuccugagucugccuaacuuagggcuuggccaucuccucucuaucuucuaagaggcaauuuucucaggaacauccugccguuaugagcuucgggggaggaggugaggcauaaacaguagggcccugcuaacacauauaaauuaggugucuucauauaaauuagaaaaaaggccccugcuggccaggcgugguggcucacgccuguaaucccagcacuuugagaggccgaggugggcggaucacgaggucaggaguucgagaccagccugaucaacauggagaaacccccaucucuacuaaaaauacaaaaauuagcugggcauggugacacgcgccuguaaucccagcuacucaggaggcugaggcaggaaaaucgcuugaauccaggaggcggacauugcagugagccgagacugugccacuacacuccagccugggcaacagagugagacuccgucucaaaaaaaaaaaaaaaagaaagaaagaaagacaaaaggccccugcugacugaggaacuacaaacaagcagacucccuccagucugcugcaaugggugaugcaggcaacugccccucucagcccaucccucuguacagggcacaaccugcccaacugugugcaacaggucuuacaacguuccugucucagacaugguccaggaaaacccagaagucccagaaggagcaaaacagaacagucagccucucguauccauggcuuuggcauauaaccaauuguggaucaaaaauauucaaaaaaagaaaaaauaauaauacaacaacagaaaauaauaccaaaaaaacccaaugcagugcaauaacuauuuacauagcauuuccauuguguuagguaucguaaguaauccagagaugacuuaaaguauaugggaggaugugcauagguuauaugcaaauacuacuccauuuuacagaagggacuugagcaucugcagauuuuguuacuguuggggcuucuggaaccaguccccguggcuacccagagacaacuguagcuaucugaacacgagagaacaggaagcucaagaacacaugaaaccaacuuuguaaaagcaaaguuaagugauauuucaauuuguucauuggaaauguuggaaaaauugccaucuuuagcacgaaaagcaaagauaaacugugcaccaacuguggcaggauccaccucuaccaguuucacaggccccucugcucccaggcguggcuuggaccuugaacugaauguccugauuggaggcaagcucugcagacagggaaggggccccaacagcuaaguccugacuucaugagguuaacccaggagggugcccuugccccaccaagccccaccaggcuuaccucauccagccccgugacagaguaggcgugaccucugaccagcccgcaggccauucuugucucauacugaaccggaaugauugucuguagagcaguaaccagagaacccauuaggggcgggggaacagaaguucugcugcuuggaggcaaaguucauacuaguucauuuuccgggcucugugaagacacagaccacucugcucccugaaagugugccucacgaccacgaacggaccuucaguggcccuuuaagagugccaagagacacagcuccagacaggcuggucucccugagaaggcucuguccugaccaucagagagcaauguggaugcugggaugugggguggguaacaguguccugccccuccuuucuggaccccuuaguauccuucaaaggaggaagggguagaguuggaggcugcccugggcuucaggaucccccuuccccugaagccauccaggguugacuauuccuggaagagaaagagguugagaaaagggguuaagugacacauguaagucuagcuuuuucuuuuuuucuuucuuuuuuguuuuuugagacagagucuugcugugucgcccaggcuggagugcaguggcgcgaucucggcucacugcaaccucugccucccguguuccagcgauucuccugccucagccucccgaguagcugggauuacaggcacgugccaccaugcucagcuaauuuuuuguauuuuuaguagaaacgggguuucaccauguuagccaggcuggucucgaacuccugaccucaggugauccacccgccucagccucccaaagugcugggauuacaggcaugagccacugcgccuggccaagucuagccuucuuuacauccccucaccuccuccacacccaccuggaacauaauauucaagaaaucaagagucccagugcccagggagagaauucuaagaaagcccgaggagaucccugcucagacaugaccgugccuaaggaguagcucuuccauuugcagaaauuuccaaguugcagccaugggggauccuuggcagaagggcaggaucacuaaagucccaugagcccuggauaggcucucuauggcuuccaugugccuacuaacguaacagcuuuaaaaggagcuucccggagccuugcuaggccgcggaauuccuagagcuguuuucagggcgagggguauggguggagccagggcuuuugguaucucagccucucccagaucucagucucuuccagaucucaguccucaugauccagaucaugcugaauagacugggagggggcgggagacucauuaauccuuaguucuagaccuaggaagcugcuugaaaugacucuucugucauuaccuaagcauaucauucaacccagcaauucuacugcugggaaucuguccuauggaagucaccauggauguauacaaagauguaucuauugggauguucguuauagcauuuuagaauaguagcaaaacaaaacaaaacaaagaaaaaaaagaacucaacuuuccaauaauaggguauuggguaaauaaauuauaacauaucuguguguuugaauauuguguagcuauuaaaaaauguuacaggagaauacuuugggcacauuaagaauaucaaacuaggccgggugugguggcuuacaccuguaaucccagcacuuugggaggcugaggcagguggaucacuugaggucaggaguucaagaccauuccagccaacauggugaaaccccgucucuacuaaaaaauacaaaaauuagccaugugugguggugugugccuguaaucccagcuaugucgggaggcugaggcaggagaauuaguuuaacuuuggaggcagagguugcagugagccgagauggcaccacugugcuccagccuagggaauagagcaagacuugguuuccaaaaaaaaaaaaaaaaacaaaaaaacaaaaaaaacuaacugaaaaaagcaggcugcaaagagguacauacaauaugauaacauuuuaaaaauaaaaauacagauucagugugugcauagaaaaauccuggaagaacauauacuagauguuaagagugguuaucuuuacauggggaaaaauauaagugaaauuuuccucuguguuuuucuguauggcucaguauucuccagugagcagguauaacuuaugaaaauacuagaauauaaacucuacaagagggagaccuugcuuuuuccacaaauauugaaaaagaggagagaauuugcuuuguuugcuagaggagugccuggaacauaguaggagcucaaaaauaaguguugaaugaauaaaugaauacauuagaagaggaaaaauauuucaaaauaaaugaaguaucuuuacaaguauuucugucugauaguucguuaugagaggaacugccuggaccauggaauaugcagaaacuccagcagagauucccuccaaaauccugguucuugcacccucuucaggagccuuggcugagcaaguuauuucaacccagacccuugggaggugccagguggggguguguggguaaggcccuggcugcugaggggagucugacacuaauagggcggggucauguggguuggagggauggucaguucugauaaucggagguguacacacccgggucggucuuucaucugagccucuggggucgaggucugaguccuggagcagugaguuauccauauuccuuaccauccgugcaaucaacucccccauguucagaccagaaggagagguuccauaggucauguucgugccauccugaggcccgauggagaauguagggaacaacacaggggagggagagaacaaacacagaaggguggaaagggaaggagagaggagaaagagaugggacagacaaagggagagaggagagaucaacagagcacgaauggaggaaagacggagaaaagugauacagaaaaaaaguucauccaugguguugugugcuaacugaccuuccaagcuguccauugggcguguugggagaagaaggggcaggaauucagcuucagccccauccuccccaauggaaaccacuaagauuaucauaucaauauacugagcagcccucagggaaggcaugcccccugaaggaggccuggccaugggcggccaucucccuacccuuggcuccugucucaguucacagcauuucuuugcacugaaaggugcugcaggcuuagcuucucccagguaacaacacaaagcccacgucucaagcggggagguguggugaaagcccagugacugggaggcuuucuuagggaaauggugggcucagguccacagccaaguacguggccagcuuaaugggagcgugcugagacugaggagcaccagcaagggaggccuccacugacacaggccucuggacugauuuccacugacauuccagggcuugaaauguccuugaccagugucuuuauugaaaauccggaagaacuguucucccuugagaaauucccaguccucaaaguugagagccaguuccugcuuccucaaacaaaacauucgcucugucccacacaaaagcucuaugcugcccuucauuggguaaaaggcuuccugacacuuggagcuccccacccugugccccacaccccagacuuacaucaauggagcagcccaugagggagccucucucgauggcuuucuucaugaucuuguacaugucacuaggagcaucccugaucucaaaaaacucugccaccccuccugugaaguccuccauggccucugugguguucccaccuuucagagcuucguaggaaccauggagccuuagagagaggaugaagaccaauuuggggucacagaguuccagggaacaaaacccagguaccacugccaccagaacuuuaccucuuggaugcugugauguucuuucaucaauuccacauuaacccuaugagcucaugggauggaaacaaugauucccuuucuucauaaugaagaaacugagcucaagaggcuaagugacccacccaagaccacagagagccagaagcacugggauugaaacccagcuauccccacuuccugagagcucuuuccacuacauccugaacguugaggaagggcugcauuaaagccauuagcagcugccggugugguggcucacaccggcaaucccagcgcuucgggaggccaaggcugguggauugcaugagcccaagaguucgagaccagucugggcaacauggcaaaaccccgucucuacaaaaaaauacaaaaauuaacugggcauggugaugcccgcauguagucccagcuacuugggaggcugaggugggaggagcaccuugaacccaggaggucaaugcugcagugagccgugacugcaccacugcacuccagccugcauuacagagugagaccuuguuucaaaaaaauuuaaaaaauccauuauuagcaucugggguggagcuuuuaaguugagagacaacauggcuuuauaaaucugcuauaagcacaugagguugagccaagcgagacccugggaucugagcuccagagauacaaugcucugauccaagacuugcaaugccaccauggaggugcaaugaaagaacucgcuaugguaagcuaaagcuaaaggucuucuaugcaaaucuucauuucuacucuuaaauuuaauguuuuuaguuagagcuguuguugccuggaacugaucucuaacuuugggucacaguuggacuugcaugcccacacauaugcacguauagaggcacaugccucuuccugugagugaggucucggcuggauuuugcaacccacuuucucaccucuagccccaccucacauucuaaaguguugcuuacuuagcauaagccuucuccagcagagcacuccagaacucauugcggugguuggacuuggugaaaaccaguugauuguuguacguuggcaggcagucaucuauaaccacguccacccacucuccauagcgccagaacugcacagaagcgucacgcacagagucacauacucaaauuacuguuaggaaauguguccuuccuccacauuccucaggggguucuugaaucccaaagcagcaucauuuccuggacucugcaucugggugccuguucauccuauuuuguguuugggguguguaaaucugucucuaacuggacugggugcuuuuugagagcuggaagugaguuacauauacuucaugucuuccacagaguccagcccaguaauggguagaguaggugcuccaugagugucuuaggauguaagauuuucauucuccugcucagcaggucuggggcagggccugggugucagcacucucaggugcccccagcugauucaauguggccaggauugggaacuaugcagugaaggcacugugcugauuuagguauuucuugaugccaaacugaagaacaaggauugaaacggaggaacaaagugacccagaaucuauucuagcuguagcaggaacauuguucaaucauuucaaguuuggaugucgcucuuuuuugaaugaaucaguuugaacugaaaagggccaaaugugguuuagucuccuuuucaauggcacuuucucccucauugaaaugagaacagaaaucuaucugauauuuguauguaaggcccuuuagaucugagacccuuuaaauaugccauguucccaaggcggcaggagggggagucugagccuggagacagaccuuuucugaggccuuccgugcugaggugcaagacccggggagcaagaacugauaaugugggucauccugggacaugagggagccuuugaagcuggagacaggcugacuccccagcaucccggaagcuacgagacccucacagguagaauucaguuugguucugcucuagcaccagcucuaugccaaggugacugggacccagaaaauuuccaguagcuggauggauucuagaaccaucagauucaguucuagggcaaacaagaagccugauccccagguuaagcagacucuucuuccagggcuuggaagagaggagugauagccuugguaccgccaugccuuagagaggaagaaguauacaggagcccuggacagggguuccuguacaaccugaaggguccuguggugucacagugcuaauaucuuagggaccuacuugagaagggcugcaggcaauaaaagcagccagacagcugcaaagacaaaaauagacccacaguaaacaggaugucuuccugucuuucugggacauaguggaagguggugggggagggauuagggagccagagauaagcaacugcuuccucccaggcuugaagccuuaaggggguccaugccgacuguugccgcugcggguagaugggugggaaguuuccuccagcuucugggaagucaaggccaggagaccagcgguggguggccugccgcuggcccucuuaacuacacucucauuaccucaccuggaaguggaagaucccugcguaguuuucgaugaaacuuugaucaugggguaugacucggaaaagaaggugcugguucagggucaggcaggcaauggcugcgagaaaccagcaguccccugcaggcagacacagggcacagaucgugagcacuccugcuccuccugggaagaaaaagccccaaucccagccagccacuccacuucccugaacggggacucccuuggugcccacucuccuacuuccagaucugaccuuacagaggugucaacccagggaaggagaauuggacaggaauuccuugacaauaugaucaacagguaacuuacucccuugugacuagacauuuuccucaaggcugcaggcaguuccuccaacugcaguauaaacucacuuccuuuuuaggccucaauggagacagagcaguaggugaucauaacuggguuguucuuccuaacaccuguaggaaaucugcccugcccugugccuuugcaaugugaguccaauuccucuucugacuucagcgaagacugagccucagagaaccauccaccaagaugauuuguauuggaaggaaggccagguaggcagcugcccuggaacccgucuauagggggcaguaagacauugcuggcaacggaaugagcucgggacguuuucuuauucucugaaccucuuuucugacagaguacuguauguaguuggagguaacacuuugcucucuuucucucucucucucucucucucucucucuguguguguauauauauauauaauaggggguguaccuggucacagagcugccuucuaaggaggauggguuaagugaaaugcaacugagagugugcaggggagacugagagcugccugcagccacucuccccuacccuccuuggaagcagccagucuuuccuuggaaagagguuauugguuugaaggucccagauuauuaugcccagggcucugcaggaagccuucccucaggugcaggaacccagauauucaucugauuuauucucagccuccccuucuggaaugaaauaagccaaauuccuuuggucuuaggugcccccuuuuccucaaauuuaaauuguuucuguugguguucucuccaauuuuacuucacagagcuugcuuauaguccacaccaaagacaauacuuucugaacaagaggucgagagagaggaagaucagauggagcagucaagcuaaccaaucaaagagaaaauuggaugcucauccacauggcggaugccaucuuuguggaaagacucuuuuaagauggagcuaugcuggggcaauuuaaacaaggguuccaguuacaagugcuuuccuuggcgaugccuuuuguguguguaucuagaaucuccaugcccaaggggcaugcuuggugcacagucacagagcugucuuccaagaaagacgauacagugaaaagcagggcuuuugucaugcugagugggguauguaaguguccuugagauacuggagaggaggccacaggaugcagauacccccugugaugcauggcagagugcuaaagaggcauguaggaggaaaugaagcaaucgccagcauguagauaaacgaccauaaagcaacuguuauaaaaaaucuuccaaaaaguuacuggaagcaagcacagauugucccuuuaccuccuggaaggggaucacaccuuguaaucaccccuugaucaucuggcaggaucugaccugaggcacuuuccuaccuagcucuccuugacagaugucaguucuguuggcuccaucaaugauaaaucggggauucucgcaaauuuccugugaaacaaaaaggaaaugaccagguaagaauaacaguagauagacagauagauagauagguauuuuuuugagacggagucucacucugucgccaggcugcagugcacuggugcaaucuuggcucacugaaaccucugccuccgggguucaagugauucuccugccucagccucucgaguagcugggacuauaggcaugcgccaccaugcccagcuaauuuuuguaucuuuaguagagauacgguuucaccauguuggccaggauggucuccaucucuugaccuugugauccacccgccucggccucccaaagugcugggauuacagaugugagccaccgcgcccggccgcaguagcuauuauuuauugaguuccauuauguaguguuccugauaguauuccauuuggcccugugaagggaauacuaucauuguuauuuuucagauaaggaaacugaggcccagagagguuaagaaacucgugcaaagacacacagcuaguaaguagcagaagccagaaacaugccuccuuuuuacauugucccaugcugcuucccacacugucauacuauucgaguaaggaugcaacuugagaguuagggcagugucggcugggcgugguggcucacaccuguaaucucagcacuuugggaggccaaggcggguggaucacuugaggucaggaguucaagaccagccuggccaacauagugaaacccugucucuacuaaaaauacaaaaauuagccaggcguggugacagguaaucucagcuacuugggaggcugagacaggagaaucaaaauaauaauaauaauaauaaauuaauaaaaauaaauaaaauauagauucaguguuuuguauuguuuuugagacagagucucacugugucgccaggcuggagugcagugggcgacacaggcuggaguacaguggcgcgaucucggcucacugcaaacucugccucccagguucaagcaauuuuccugucucagccucccgaguagcugggacuacagaugugugccaccaugggugguuuccauauucuuaguagagagagaugagguuucgccauguuggccaggcuggucucgaacuccugaccucaagugaucugccagccuuggccucccaaagugcugggauuacaggcgugagccaccgcgccaggcuagugaucugguuuuagccccauucuucucagcuucauggagucuuggcauuccugugacacaguucaaacagggucucucucuccaccuucccccaacccccaucacaacaacccaauauacccaagugagcugaagcuccugcacucagggguguauacuccuaguagauggaaagucuugcuuaugcuacaccccacagcaugcgucccaucugcaacucugaguggaauggaaggauaaaccaaaacaaucguuuucaaaaacguuuaccuauauggggagggaaggaauaaggugguagaaauagggauggaaguagaacucugaauauaacuguuuaaaaauaguuuugacuuaggaaucauguaaaguuuuaaauaauuaagagccaaaauuaaagaaaaaauuauuuuaaaaagccaucuguaaaagcugaaagcaaaccgaagcaaagggaccuaacugcauaaccauucacagaaaaauaauuacuucaagucacuuaaaauguaacauuuuggcugucuaucccuuuuggaauauauccuaaggacaaaaaccaaaaccauaaagaaauaugaaccuugaauguuaugaagauacuaagaaauaugaaccauaagaaauaauaauauuguccaggugugguggccuacaccuguaaucccagcacuuugagaggccaaggugggaggaucauuugaggccaggaguucgagaccagucugggcaacauagugagaccccgucucuacaaagauuaaaaggauuaguuggacaugguggcgcaugccuauagucccagcuacuugggaggcugaggugagagaaucgcuugaaccugggaggcagagauugccgugagccaagauugcaccacugcauuccagccugggcgacagagugaggcucugucucaaaaaaacaaaaacaaaaacaaaaaaccccacuauaauuugaaaauauuuuuccuuaaauaaaaacacauauuuaauacuacauauugauugaaagggcaaauugaauauugacccagaaugaccaacaugaauauacauucuagaaaauuacugggauucaaagaaaaaaaaaaacauuguuuggacaucuagggagaaagaacaagugacuuuuaaggggaaaacauuagauuauuaucagacuuuccaguagcaaggccuuuuuaugccagaagaaauuggagcaguauauuuaagaugcucaaggaaagaaaaugugaaccaaggauguauauacaauaugacuuccuuuauucauuucaagaauaagggaugugggcaaacuuuucuaauacauaagaauucagggaauauuguucccacgagcucuuccugaggaauauacuagagaauaaccuucagacaaccagguauagaaggacacuaacauaaggacugagaauaaguagucaguauuucguuauuuguagauuuaaaauuacaugauggccgggugcaaugacucacaccuguaaucacagcauuuugggaggcugaggugggcggaucacgaggccaggaguucgagaccagccuggccaacaugacgaaaccucgucucuacuaaaaauacaaaaauuagccaggcaugguggcucaugccuguagucccagcuacucgggaggcugaggcaggagaauugcuugagccugaaggcagagguugcagugagccaagaucgcaccacugcacuccagcuugggcgacagagugagacucugucucagaaaaaacaaaaacccaacaaaguaccugaugauuaaagggaggauguaaaguauguaauauauugccuauaguguucgggcaaugaacaacuauuuaaaaccauuuuaaaucaaaggagaaagaagaaagccuauggaaagacuguaaacuguuuucaggaauuauuuugguagugauauuauuaauauuguuauucugcagcuuaaucagacaaacaaaaguagaggaaauucauugccagcagaccugccaugcaagaaauguuaaaagaaguucuuuagggagaagaaaaaugauacaggucaggaacuuggacccacauaaagaaaggaagagcacuggagaggaaauaaauaaaugaagauaaaauaaaaucuugauuuuaaauucuuaaucuaaaggguaacuuaguuaaaucauaauaaaaacaauguauugggcaauuauagcauacagauaagagaaacaaaugacaguaaugucauaagcaaagaaaggaaggaaaugguaauacuuuguucucuguuauaaaguaccuagaguacaaacuaaaugguauaguguuauuugaggguggacuugguugaaaacguauacuggaaacucuagcaugaccacuagaauugaaaaaauaaauauaauugauacaccaagagaggagauaaggccgggugccgugguucacaccuguaaucccagcacuuugggaggccaaggugggcagacugcuuaagcucaggaguuugaggccagccugggcaacauggcaaaaccccaucuuuacaaaaaaaaaaaaaaaaaaaauauauauauauauauauauauauggggaagguggggggagagaccccguuugaacugugucacaggaaugccaagacuccaugaagcugagaagaauggggccauauauauauauauacacacacauauacauacauauauauauacacauacauauauauacauacacacauacacacacacccacacacacauacaaacauauuaguuuggcauuguggcaugcaccuguagucccagcuacucaggaggcugagauaggaggauugcuugagcucaagaggcagagguugcagugagccaagaucauaccacugcacuccagccugggugacagaagccagacccugucucaaaaaaaaaaaaaaaaaaaaaaaaaaaaagacaaaaaagaagagguaaaaggauaaaauaggauaaaauauaaaacuuucaguuaaaucagagaagccagaaaaaggggcagggacaagaacaaaugcaauaaauggaaaucaguuauaaacauguagguaguaaucuaacuauauuauaaucacuuacaugugaaugaucaaaauacaccaauuaaaagacaaaggcugugaaaguggauaaaaacaagacucgacuauauguugucugcaagaaacccacuuuauuuauuuuuuugagacagaguuucgcucuugucgcccaggcuggaaugcaauggcacagucuccgccucucgguuucaagcaauucucccaucucagcauccugaguagcugcgauuacaagcaugcaccaucaugcucggcuaauuuuguauuuuuaguagagaugggguuucaccauguuggccaggcuggucucaaacuccugaccucaggugaugugcucgccuuggccucccaaagugcugggauuacaggcgugagccaccaugccuggccaagaaacccacuuuaaauauaaaaacucauagauaaagaaggauauaucaugcuaacaauaaucaaaagaaaguuggaguuguauuaauuucagaaacugcagacuucagaacaaggacaauuaucagagauaaggagaggcauuacauauagaugaaaaggucaauuggucaauuuuccaagaagacauacaaucuuaaaugugugugcaccuaacaacagugucaaaauacaugaggcaaagagugauagaacugaaaggagaaauagacaaauccaguauuauaguuggugaugucaacacucucuuucaguaauuauagaucaagcaggcaggcagaaaagcaauaaggauauuguugaccugaacaacacuaucaaccaacuggaucaaauugacauuaauagaauucuacauccaacaauagcagaacaaaccauuuucucaaauucauagguaacaagucaguaagacagaacacauucugagccauaaaacacaccuuaaccaauuuuuuuuuuuugagacagagucccucucugucacccaggcuggagugcaguggugcgaucuuggcucacugcaaccucuaccucccgguucaagcgauuuuccugccucagccuccugaguagcugggauuacagaugcaugccaccaugccuggcuaauuuuuguauuuuuaguagagacggaguuucaucauguuggucaggcuggucucgaacuccugaccucaugauccaccugcuucagcuucccaaagugcuaggauuauaggggugcgccacugcguccggcaaccaauuuaaaagaauagaaagccuacagugucuucacagaccacaguggaaugauacucgaaaucaauaacaaaaagauaguugaaaaaucccaaauuauuuggaaaccaaacaacacaguucuaaauaacacaagggucaaagaagaaauuucaaaagaacuuacaaaauguuuuuaacuaagugaaaauaaaaauauaacaucaaaauuugugggaugcaacaaaagcaguguuuaaagggaaaguuauagcauuaaaugcauaaguuagaaaagaaagaaaagaaaaaucaauaagcaauauuccaucuuaguacacuauagaagagauacuuaagccuaaagcaagcagaagaaaagaaacaauaaaaaaucagagcagaaaugaaugaaauaaaaaacaagaaaacaauagaaagucaaugaaaacaaaaaugguucuuuggaaagaucaauagaauugauaaaccuuuagccaugcuaaacaagaaaaaugaaaacacaaauuacuaauauuaaaaaugaaggagagguuaucacuuuugggaguucagucaggcugguggcaaaaauuuuaagaugaauuuauaggauauaaacacaaacccucuuggaaggccuagagguuugcauaaaguguuuggcugaaggcagccgaauccacuuaauagcuuagggcacagauacauaggaauguagaggaguuuaucuaaagagcuuguuuacucaugugguccuaaaacuaacuuuugaucacucacggcaggauagcuccccccggggugggggcaaccagauuaauuacccacagguguguugacucaaagccuuugucauuaaaacugugcuaaauaaaugcccacagggcuagcuagucagggccguggcugcugacucuucacagcaccuuccuuaguaucugugagcggcuuggaccccuagcugcucuuucacuaaauauuggugucuugguauguuauucauccgucgcacgagcuggggucugcaggacagacuccugcaaucacuacugaacuuuuggacauuaaagggauaauaagggaauauauggacagcuccaugcucacaaauuugauaacaggugaaacugacaaauuucuugaaugacaaaagcuaccaaaauucauucgaggauuagauaaucugaauagcacuauaccuaucaagaauauugagucaauaauuaauaacccuccaaaaaagaaggcaccagaaccagaugguuucacuaaugaauucuaccaaauauucaaggaagaaauaauaugaauuuuccacaauaucuuccauaaaauagaagcagagggaacacuuccuaacucauucuaucaggccagcauuauccuaauaugcaagccaguaaaagauacucuaauaaaggaaaacuacagaccaauaucuguuaugaacauagaagcaaaauccucaacaaaauaugagcaacucaaauacaacaauguauaaacagacaccaugaccaagugggauuuauuugagguacaagguuuguucaacauucaaaaaucaauuaauguaauuuaccacaucaacaggcuaagaaaagcaauuauauaaccauauuaauugauggagaaaaugcccuugacaaaaucugacacccauucaugauuuaaaaaaaccucucagcuaacuaggaagagaggagaauguccucaacuugguaacgaucauccacuuucaaaaauaauaacagcuaacuucauacuuaagggugagaaacuagaugcuuuccccuuaagacuaggaacaaagcaagauguccuccuguaccacuccuauucaguguccuacuggaaguccuagcuaaugcaacaagauaagaaaaagaaaugaaagauauaaauauuggaaacaaaaaaaaaacuaucuuuauuuacagaugacacaauugucuauguagaaaauuccaaacaaaugacccaaaaaaauccacugggaacuaauaagugaguauagcucaguugcaagauuccaaguuaguauauaaacaccaauuaguuuucuauauaccagcaaugaacaacuggaauucgaaauuuaaaaauauuccuuuuauauuaacacacuaagccaagaaauauuuaguuaugucagugugaacucauguuuagcuuaguauagauacaaauggcuuuauauagaaauauuuacagauaugugagaugguuauacauagaaauauuauagauauguguauacagcuggcuuaguacacacacauaucuccuuucucuacaagcugagaggaacagaagcaaucacacuccgguagcaaugagcagacuuagcaaccagaucuugauaucuaauaccuuuuucaauaaaagaaaccagugcuccuuggagaaaugacugauucuaggauuggggcaggagauacacauuaugagcugguagugccagaaaguaagaaagugcucaaggaaaaaaaaaaaaacccacaaacaauuaggguauguuaaauagacacaggagccaacugagagcucccagugaagaaagcugggacaaccuaagcaacaaaauaaagcaguauuggauuacgacuuaaaauaaaaaucaagauccaugaguccauauugauauaaacaagugacugaauaaauaaacaaauggggagaauagacaaagcucccaugcagaaugauucccaauaauugaugcagauucucugcccucaagagggcagagcacaauucccccuugcuuaaguaugggcuuaugcuuagugucuugcuuccagaguauaguaugaaaagaggggaagaaguaacuucacaguaaagaaaccugacaagcacuacuucagccacaugaccaaggucaacaccacaaugagaaggcauguuuauugcccgcauccuugauauauaaugugacaaaaacggcacuuuacccuguggucuuccucccccaaacccuuaagcccauaaggagaaaaaccgcagacaaaugccaauugagggucauuauguuacagaauaccugacgaguacucuuuaaaaaacugugaaggucauaaaacaccagagaaggcagagauacugucacagccaagagaaggcuaaggagacguuacuacuaaauguaaugucauaucuugggugggaucuuggaacagaaaaaggacaucagacaaaaaacuaaggaaaaguauggacuucagcuaauaauaauauauuaacacuggcuaauuuaauuguagcaaauguacuguacuaaugcaagauguugguaauaggaagaaauggcugcaagguauaugagaacucuguaccaucuucacaauuuuuuccuguaaaucuaaaaccauucugaaauuuacaguuuauuuaaaaaauagauauaaauacuucuaauaguuuuuucauccacuccaauggaucaucuugcagaucuacugggcuguauaugcccuccucagagccuacuggucuagagaguuucuugccugcucuaaaugcagugaacccuuuuuggagcucugagccucuccaagcaggaagaagggccuugugcuacacacucccaagcacuuucacccacucaaguugacacaaggggcuucucgguugcgccauaagguagccugacacaaacugcuucaucccguaaggagucuggcugcucagcacggaccuuucuguuuaaacagaagcgacagcacaugaaugaacaagccuuaggugaaagauuaagaaggcaggucuccauccuuccauuucuuuacuguucaccaccuuccacagaacucucccggaaacugugagccuuaguacuucuaaccacucuacucucccaccccaaaacaccugcucugaaaaagacacaugagaccaggugaaauggaucuugccuguagucccagcacuuugggaggccuaggcaagaggauugcuugagccgagggguuugagaccagccugggcaacauagugaggccccaucucuauaaauaaauaaauaaauaaauaaauaaauaaauaaauaaauaaauaaauuuuuauuuaaacaaauaaaaaugugguggcacaugccuggggucccagcuacuuggaaggcugaggugugaagugggaucacuguuugggccugggggguugaggcugcagugagcuauaaucaagccacugcacuccagccugggugacagagcaagucucucucucaaaaaaaaaaaaaaaaaaaaaaaagagacaugauauucgauuacaaugcauuagcucccuaaaaauauuuacgauuucagggacccauaaaguauuauaauaaucucuagcucaggaauagaaaauaacaucuccaguuucaggaaggagcagaaagguauuuuggauaaagagacccuugauaagucaauugcccagaggagggauccauggccucaggcucuggaucacuuggcuucuuguuccccaagagcuggcuccugaagucccauccccuccaucccuaccuuuggccuuuuccaugugauggccuaaaucuugguuuuguggcucagcucaugggaggccagggccugaacaccugcuaggaacacacaaucuucaaagaggcacuucugggccagacaucuuugagaacgacaaaauccugccccucaaacuugaggggcugugcgauggugcccucuccauuucuccugucccucucuuggaucacacagucacagaagaauccugacagcagguagggcauggcgaaugcucugggaguagagcugggccuucccugcugccucuuucccacugcacccucaguccacgccuaauccucuugugaauggccuggagccuaauauagcucuuccacccucagcagcaccaugcauggucagagucagcagcuuugacuggaggccccugagcccguggucuaggggcaacucugugagagggagccagggaggggagagagaguuccaaggacagccucaggacagaccgcaguggucugaggaccuuuagggaaccuucaucacccuuugcugggauucuuccucuaaaaagaaaauauuacuauaguuacagagaggcuuacuuugucucagcaaaagauguucaugccuuugacacuggugaucaaagggcuauagcauggggccuucugauauacuaauccuauacaggcuacugaaugcauaggaggaaucugcuccaugccauuguuuggggguaaugacgccuucacacuccugaugucccuggcccaccccucaaagaccuugaccagucauuuagggacucucaucugugaaaaugaugcagaggguagguaacuugacugcagauggaagucccuguuagaguaggucccaguggcagugagcagauauccacuguugcaaauucaggaccuuuagggcagagaaugugguggauggggaaagcagaugaaugugugucaugugggaauuauauucauaagaaagcccagccuuuucaacuuucacugugcuuaaauaggcagcucuaauguaagagcagggagcugacaugggaggaaacucaggccuggcagcuugcccgcuaggaggacacccagucucccugucugcucaugaaugccugauggccuuugucuacucugugcuucucaaagugugaucuuugaacuucaugcaucagaaucaucuggucugccaguugaaaauacagauucccagggcccaucccagaccugaggauuugguaggggucugggacucugcauuuugaauaggcucaccaggagagucuuauguccacuaaaguugaaaaccaaugacuuuacuuauuuauuuauuuauuuuugagauagggucuugcucugucacccaggcuggagugcgguggcaugaucucggcucacugcaaccuccaccuccuggguucaagcaauucucccgccucagccucccaaauaucugggauuacaggcacccagacaccaccaugccuggcuaauuuuuguauuuuuaauagagauuggguuucaccauauuggcuaggcuggucuugaacuccugaccucaggugaucugcccguuucagccucccaaagugcugggauugcaggugugagccaccguggcuggucgaaaccaugacuuuggcauuacaggguaaauaauagcuuaaaauaauuuuuuuguuguugagauggagugucccucugucacccaagcuggagugcaguggcacgaucucggcucacugcaaccuccgccuccuggguucaacugauucuccugccucagccucccaaguagcugggauuacaggcacccaccaucacgccuggcuaauuuuuguauuuuuaguagagacgagguuucaccauguuggccaggcuagucuugaaguccugacuucagguaauccgccugcuucggccucccaaaguguugggauuacacgugugagccaccgccugggugaaagaaugagaccuugacucaaaaaaaacaacaaaaaaagugacuuuuguuuaaccauuuuuguuaaaagaugccuaggaauaaaucugacaaaagauguucaaggcaggcugggcgcagugguucacaccugugaucccagcacuuugggaggccaaggguagggggucaccugaggucaagaguuugagacuagccugaccaacauggugaaauucugucuuuacuaaaaauacaaaauuagccaggcauuauggugcaugccuauaaucccagcuacuugggaggcugaggcaggagaauugcuugaaccugggaggugauguuugcagugagccgagauugcaccauuguacuccagccugggcaacaagaacgaaacuccaucucaaagaaaaaaaaauguuaaagaugucacugagaaaauuauaaaacuuuuauuaaaagacaccuauuuaaauggagaaacaucccugcuucauggauaggaagacucaauauugucaagauguguauucuucccauauugauucaauguaacugcaauaaaagucccaacagccuuuuuuuuuuuaauuuuuaagauuuuuuuuuaauuuuuuuaagauggagucuugcucugucacccaggcuagagugcaguacuaggauuuuggcucauugcaaccucugucuccuggguucaagcgauucuccugccucagccucccgaguaguugggauuacaggcucccgccacuauguccagcuaauuuuuguauuuuuaguagagaugugguuucagcauauuggccgggcuggucucgaacuccugaccucaggugaucugcccaucucggccucccaaagugcugggauuacagguaugagccaccacgcccagccuaaaaaaguauucuugagagagugaagaggcaagucacaaggugggagaagguaucuguaacacaucuaaccaagaaaggauuaguauccaggauauauaaagaaugccuacaauucaaauugaaaaagacaacucaguagaaaaaucagcaaaaggcauuagcagguguuucauguacagugaaauacagaugaucaaggaacagacaaguguacaaaaaagaugcuuugccuuauuuauaauuaggaaaaugcaucuuuucuuguauuucuuggccauuucugucccagccccucucauugucagcauuaaacugcugagucacuuuaauuuguucaccaugaugucuacagcucuguccccaucaugacccccaggaggagcugcugucuuguagaauauaauagaaguugcuccuaaaaguuacuuauauaauugucacuuucacugaaacauaugcaccuuccccauccccccuacccccgugaugacacuaucaugauucucugcugaguagacagaaggcuggcucucaaauggguaccucguuuugucuuucaguuacuaucaucauuauuuauugacucauuguauuauguuauguauagaaucucauuuaauccuuacaacaacucuaugaaaguaggaauuuucauuuucuucucacagaugcagaaacugagaccucggaauggucaauaauuugccugaggucacaucguuaaucgguggagcugggauuugaaugaaguuugccugacuucagagccugugcucugauguuaugugcucugauguuaugaagucauaacaucauuguguuaugcuccuacccuuugcugccuaugcuaauaguaauugcuaccuuaccuugcacaccuacuaggacgcugaaugccacucaaaacagcccuaugaugggaauauccuuauccucauuacagaagagaaaagcgaaacuuaaaaaaugugacuuacuuaugugacuugcuaguggccgagucaguguucagaccgggucuguuugguucuaacucuagcuguuuuauccacucugcacaaugcccccaguucuuccucucuguggcuaggacagugaccucacuucucuguaaacugucugacagaagguaacacucuuaaagcagaucacaagcagaccacucgcugagccagcuucauuggaaagauauauaauuuuccugggagaagaaacaacugggucguaggcacuaggagcagagagcuuccugccacagccuagguuuuucugugauucagcccccucccucucuucucaugcuggcauggaguaacuuuuuuuugugugccaaccuaggauuucuucuuuucagaacugaguaacacaggucaaaugacuccuggcugagaagauacacaggagucaguauuaauuuuagaggcaguggggcacauggaagaggucauuagagcaagagaccgucugguauggacagaaagcuuccaacuugaaagugcugaugugagaccaggcgcagugacucacgccuguaaucucagcaccuugggaggcugaggcagguggaucaccugaggucaggaguucgagaccagccuggccaacauggugaaaccccaucucuacuaaaaauacaaaaauuagccaagcguggugccgggcaccuguaaucucagcuacuugggaggcugaggcaggagaaugaauugaacccaggagauguauguugcaguaagccaagaucgcgcuauugcacuccagccugggcaacgagaguaaagacucugucucaaaaaaaaaaaaaaaaaagaaagaaagaaagaaagugcugaugcgauggccaagugcuggggaaguugguggccaucuguccucucaaucuuaugcccuuucuuucccucccuuucagaccaaaggaacuggguuucuugaagaaaugauucauuccaguuguggggcaacaaauguacaagaugggcguggcacauuuuguuguggccagaaaacaagaaagggauaaaagauuaauggagcaacgugaaaugauacaggcaacauacaggggcuccuacuguccaaagauggaacaauuugaacaugaaaaagaagaaugacugcaauggauuaaaacaugcugcaauacuucauacugaucacauucuuuuuuuuuucuucuuuuugagauggucuuacugugucacucaggcuggaaugcaguggcgcaauuuuggcucacugcagccccaaccuccguagcucaagugauccucccaccucagccucccaaguagcuagugacagagcaggagcaucaccaucuuggacaagcaccaccauuuuaaagugccccuugaucaaaaacugccuaaauccaacccaaagggcaucagccuaauggcuaaugucaguaugaccauaaaccacaaaugacaucuccaaccagaaacauuccaaccguaagauaaacucucucccugaccagagacaagccagccccaagauaaccuccccuccaaccagagacauuccaaacccacaaugaacuucuccuccacacagaaacauuccaagccugugauaggcucucucacccugaacccuuaaauacacuuagucuguaagagagaguacuccugacagaaaucagccagaagccccucucagguuuauucuccaaaauaaaccugucuuuauugagccauuuuucauguuucuuuccucuuucuuuuuaacucuuacagcuaggacuauaggcacaaaccaccauaccuggcuaaucuuuguauuuuugguagagauaggguuucaccauggugcccaagcuggucuugaacuccugggcucaagugauccacccgccuuggccucccaaaaugcugggacugcaggugugagccaccacgcccagcccacauucuuaauagagcauuguuucaagcuguaauauuuaagaauacagagaaaaugaaguauagucaauacucauuauucuugguaguuauguuuuauaauaacgcugagaacacuguauuaguaaauacugaaccauugcuccuaggggaacuacagaguuagaguccuaugagucucuggucacauuuucaucaaccaaucaauacagagccuuauuuuaugauguuucugcuuaaagacaccuuauuuaauauugauucauuaaauuauuguuuauugauugaugauucaauaacauugaacucacagccaacugacuauaacuugugugugaacaaagcuuaucugacacacguauuuccuccaugaggcacaccacagccuccuagaaugcuagacagcauuucagcacuaugcuuggaggucaccaauaaaaagcacagaaaugagaaaaacauggcacuaaagacgucaugaaaaggacauucuuuacaguaucaaagcugaaacaagaaggcugaguguugccuuguuugaccugagcugggaacaggcauguggggugacucagauuuuucacagcucuguguaugcccacaaaugacugcaaaaacaccucaaguacuaauuuugaggagacaaaccuuagcgaguaggugaauuugcaaauauggcaucugcaaauaacaaggauuggcuguguaagguuuauagcacugacguccuccauguuggaaaagccaugccuauggcauaaaguuggaacacuuuugugacugaucugaauuaacuaaaagagggaugacaugauucaaaaacaggauaugccuguagucccagcuacucagagucugaggcaggaggaucacuuaaacccaggaguucaaguccaguguggacaacauagugagacuccuaucucuguuuaaaaaaaagagagaaaaaaauagggaggguuaccauacagggaaaaucagcugacucuauuucacugucuuuugggucacagccagagaaaauauauuacauuugcaccuggaaacauucuaguuagaaauaaggaugaguguucagacugugaaaguuacaagcuguagguuacucaaggagauggagccauccuuuucucuuuaaaaccuuuauaucaggaaagaaagccauccaucuggaaaggcugaaaguaguucccauuuuugguccuauaucucugggguauuuuaaaaauagcagcuuuuauacuauauuucugguguucuggaguauauaauacacuucugaaaguucugauggugauuguuuaaacuugaagauugaaugaaaauggaaaaguacgugucagcuccucuucagcagaaugccacccaguguuagcugaggcaccaggcuuccuugugaauugucuugaacaccacuccauagccucugagagggcagagccuccucacucccaccacaguucagccgguuccuagcagcuccuuucugugugcuucucucuccccacacuccugugcuuuccacacucugaguguuggcucaccccugcuuguguaaaccaaaauaggaaccuccacccucuaccaagucacuugccucagaaguuucacaagcacucggaaagaauucugugagggaggccgggugcagagccucaugccuauaaucccagcacuuugggaggcugaggcgguggaucacuggggucaggaguuugagaccagccuagucaauauggugaaaccccaucucuacuaaaaauacaaaaauuagccaggcaugguggcgcaugccuguagucccagcaacuagagaggccaaggugggaggauugguugaaccugggagguggagguugcagugagcugagcuggagacacugcacuccagccugggcaacagagcgagacccugucucaaaaaaaaaaagaaaaaaaaaaagaaaaaaaagaauucugugagggucgggucguggagaggaagaacaccagguuaggggucgucacaagcccuguugcuuccuccacuccauuuuccuuucaguucuagcucuccucccucuuguaaguaaacgggcagguguuuuucuuucuuuucuuccucgaaaacaaucauacuuaauucuccuucccccaccccagagauuauuguaauucuguaauuauaauaaucuuucugauuuuuucuuacagguuuuccucgagaagagagaagauguuucugccauguuaaggguucagaaagugagcacauuuggcgaaauaaauuuaaagacuugacaauaauuccacaguaguaagaagaucuacccugaagaaugucauacuuuuuuuucuccugguguaacagcccuggcacaaggaagaaguugguucugccuggaugaugaggaccuugggaaggggcaagagaccaggucauacagaaagcagcaaaaaccagccgguguggcuggguccaugucgauagacagcacggaagaaagaaagagccugggaaaaggaauagguuggggauggcaggguugugaguuagaugggaagggacucuuugucuuauuuuuccauucugaaugcuuuucucccucacguuuuacauuucacaauuucccucacauuucugaauuucucucacaucucugaaacugugaugcaacuuacauuagaaagcuuccuucuacugcacucagcugggugauggucaugaccuuccauggacacccucugauaagaucaagaaaguacuaguauugagaaucuucuagacuugggaaaauaagguucaugaugaauuauagcuugggaaacuuaucuaaacucuauucuuaaaauaagccuaauucaagagauuucuguguaccagaauacaaggaauaaagucaucuauucagaggacuaagaggcugcugccgucugucugggaaagagguguccacagguccagguguugguggagggcacuagcuggccccaggagugaagaagagcagggcuaagggugagguuggacuacugggcaaagcacagauggauauggguaugauaguaauaccuggcaggaagaaaggcaaacaccagagaaauguggcugaaguagagacccagcucugagcugggaacggguggggcccuguaaugacagagagguggggacaggaguugagggaaagaggugaggggaaaaggugaggggaaaagacccauagcuggagcuccagccaccaucagcaagugagaaggcacuggaucuggaguuaagugggaagguggcaagcucccccaacucccaacagcaaauagaggagagagcuaagcagaagguugcgaugagaaacugcaaggcccagcuaucagcccaaggagcuuggaggacaguggaggaagggagaacggauuuccuagggaaggagcuggagguuaagcuggagguggcuguauaucaaugaugcaguuuugacuccgauucagggcugugaacuggaggcccaaccagaaauaaccucuccuagcagagccaagaaacacugagaccaugcugauggagggaaguuuaaccugaagucuggguuaauccagcugcuaaauacggugggcccuuccuucuccaagcucuagguuagggugggucuggaauaacauggaauuuacagaaaggugacuccaccuagcaccagagacaggaggagcccaggaaccucauuguugucaggguccacugcuggaagcccuggccagcugagcugauggugcagggcagggcccuguggagcaauucugggaucccauguuaccaagggugaggagaggaccagauaccuuuucaucacaagguccugcaacuggcccuucacuucucaucccuccaaaagaagcagggaucuagguugccccugcuuugggaauugcaggagaugagagagaagaagcuuaagaacucuccaccuggcaugacugaggcacaugcagaugggaaaaacgaagcccuugcucagcaaguuggucucagugagccuuuaaagccaaucacugggcaaggugccaaguuucccagccaagugugaucccucuuuuguagucuccuuccuggcucuaugauacacucagauuuucacaaccaaauguacauuuuauauuugauguagauaacuagaauugcccuaaaggacaagcaguccccugcccaugaggggagcauucacacacacauccucaugcugagauggauggaugcauuuagaccaggcaugaaguacucaaacacauugcuguagcuaauaucuugacuggucauaggcacaaauuaagcuggaaaaauguuuaugauguugccacuuuuaagagacugcauagcugcuuguaggcaguaauaagaguagucuauguuuacugagcacucaaccaugugcuggucuuaagccuuuagccugcauuaacucauuuaauccucaauuaauuaagagauggguucuucaauuaugguuuuucuccauuuuucacauggagaaccuguggcaaaaugaggguaaguaugugaccaagauuaccuaaguguuagguagcaggcccagacuugaacuuagguuaucugaccucagagccugggcucuuagccacugugccauuccaucuccaacuuauagaggcugaugcuuucaggggcaaccccuggggugucacucaaugccuguugugucuugaggaggcccaauaaaugacaccuuacuuccaugcaugaguuuugagccaauaaaggaauacuacaaaagugcagggcaggugggaguccaaaaucccacauuuauuguuuaauaaaaauggauauugacaucuaaaucucagaauuagauagauuuggggcucuagagccagauuguguggguuuaaaucccagcuccaacccucacuaacugggagaucuggcgcgaguuauuuaaucccucugagacucaguucccuccuuuguaaagugggacaauaaugguacuuccucacaggauuguugugaagauuaaaugaauuaacauauggaaagcauuuaguuacuggcauguggugaguucucacucaagauuagcgauuaucuuuacuguuaaccacacauuaccagguggcccagggacuccugcaugacuccccauggggacuugccuccagaaaacuuacugcaaggagggcagagagcagaagccaugcuucuugcaggcagcuugcuucccagagaaagacagaagccaagaacugggcuuuacaggucaaguucucuuuacaaacccaccaugggaaggagacaggccaggaguguggugcaauugaaccuuccaccccauggaaugaaacacgaccugcccucccauccccaaccuaucccuaguauauugggcaccagcaucccagaagcccuguucuagaacccauucuauucugcccugggaucugucaucaagaaaacuugccuuaacaguugagaaguguugaauaauuuguuugcuuucugauccuagaaauagaucauauaaggaaagucuagaggaaccagauuguuugcccuggaaacucaaugcaugauguucccgaguagaggaagaaagucugugagguagcacuggugaguaagagaagagauuacaggugagcugggaacagucggccagagccuguuuucuuuuaagagggaaaggcugaaagugcagcaugcuauuuuaacuagaauuauaguuggccaggaauaauucucccuuuaucauuauuaucauuaucacuguaauuauaauaaauaauacuugauggucgaaaaaaaauucagauugguuuccaaagguucugugccuuagacaguaaaagcaggaaggccuuuacucaccuguguggugcuucuccugauaggacacagucuuuucagacugcauagggcuggcaaaggucacuacaucugaagaaguuuauggagaacugaugucuccaagaagugcuuuacagucagaaaguucuggagucauuucaguuuuucaguuccaagucaacuuguguggcuguagauaagucauuugcccuuucugggccuuaaucaccuauaaagcaaggacacuggagcaccucuccaagaaucauuccaacucugaccaucucuaauuuuauauuucucauuuaugcuagugaacccaaugggcaguguuccugugaucuuaaccccaggggaacaugugggcauuuuauccaagaguggccuuuguuaucugguccuuuagugacucaaacaguggaaaauccaggaucuuuguuguuggugauggugguggugggggcacaauuuagaacagacaagucuucugcaccccucauuucaaacauggacacugcccaaucuaguaccuagagcauaacaggcccuuaaagaauuuuuauuaauuuguaagucucgcuugaagacucaaguccaccaaugauuucacugaaaacaguauuuguagguuuuaauuuuccccauucugagaaagagcuuuuauuuuuuuaaacuuuuuuuauagagauagggucucacuauguugcccaggcuggucuccaacuccugagcucaauugaugcucccaccucugccucccaaagugcuaggauuacaggcaugagccuccaugucuggcccaagaaagggcuuuuaggaacucccugccugggaacgcaggccuauccugucucacuggucaaggcccuugggcguggguuuucacucaccagcaucagcugaguacccacuaugggacuggccugagcuuggugagggggccucaaagaugaacaggaaggauuucugcucucagugagaggaaaucagucaugagaaagauugaaggaagugacaccugagcagagguucagauaggaacaaaaaaggcaugucaggcagacagacagcaugagcaaaggccuccggugugagaagacuuggaacuacagagcagcuaaauguccaagcacugcuggugugucaggaucuggggaaagaggauggacaugggccuggacagguaggcagggaccagcugagaagggccuauggcuuggcuaaggaguuuggacuuguccugaaggcagugggggccgagagagggaugucacugaagauauuucagcaggggguugugacauguccaacuacucugauagcagaguaguguuaucuucuaaacugaaggccuucaggacaguuaugggccuuaccauagaaccaagaagagccccuauggaauauacaggguugucuaguacuccaccucagguuuguuguuguuauuguuguuguuugagacugggucucacuccugucacccagccuggagugcaguggcaugaucucggcucacugcugccucaacuccccgaguucaagugaucuucccaccucagccucugaguagcuaggaccacaggcaugugccaccaugccuggauaauuuuuugaauuuuuaguacaaaagagauagguuuucacccuguugcccaggcuggucucuaacucuugggcucaagcaauccuccagccugggccuuccaaaaugcuggguuuauaggcaugagccaccaugccuggcccaccuuagguuaaagaaaaccauggcuaaucaauaguauugggucucagcuugucaucauuuccucagagaggguuugucucccuggaccagguuagcucuccuugccacaugauccuguggcacccagaacaucgucuccugacaaugucacucuuguucaaugcccaucuucccuucaggacccuagguuccaagacagcuggaauuuuggucuuucuuacucacugcuguccccccaguugcuugcccagugcuggcacuaguagaugcucaauaaauauuucucgaauuaagaacaagagucacacuggagggaugaucagagaggugagccaggggaaugugauuucccuccuggcgaucacuguaaaugaaacccagaggcugggagaguuuccuaaaacagaaaguuuuaauccgggcucugucaugugcccacuagauauauuucacucuagugugccuugacuccucacuuaugaggugagguagguggacaaaagcgauugcuaggucucucucucuuuaaccccaacauuuuaugcaugaaaaaauauuccuugccuaugacucuucucuuucuaggguuucuguguuucagaaagauauggccauugguaaauuaaagaagaauaacaucaugauuuuagccagagaaacugaaauaaucuuacaaagaugaauaauauuuaaaacgaacagguacaucugggcugucuggaauuuguucugagaaaggaauauuuauuuuuacaggaugaauuaaacugaguuccacccacuuuuauaaaaagcaagauuuuuuuuuuuuuuucagagagaaagagccagagcauaagaaucagccccaccuccugcgcucucccucuggauuuugcugagauuuggugaaauaucugagaccuguuccucuccucccugcuucacacuuaaagacagagcccagcagagcugcugccaggauccuucccccagugcccaugugcacagcugagcugccggaggugcugagugagaggacuccuccguggggggaaaacccagccagcaagcaggaagcuacucaccggaggucucuuccagacgaacuggauggggaacuucuggcuauaaaagagagaggucucauccggugggaacucaggguccacauaaagaacuuucuuuucuagacauuucuugugaaguugcucgaaugucuucucuuucacuccgauaauaggaaaauugcggcugaugauggcugaauagaugccacuuggguuuccacccccagccucaguggccuugcucugggccgggugaggaacuggcccuggggaccggggcucagccgcuguccuuggagccacagaugcgcuaaugacggucggcauggcaaguggcuuuggaagaaaaagcuuuuuaaagaaaauaagauacagcuaccuucaaggaaaggaagcaacugcaaaggggaaguuggaguaauucugucaucugagagaaaaguguccacauccaguucaaaguugaaagcccaucagaaggucguacagguuauguccaucuuaaaaaccgagcugugauucugaagccauaaguucuccugagaaaugagugcuaaaggauuucugaagcaauguugacuugggggucuccuaccagcagcaugcaugccagagggagagagaaagagagug

SEQ ID NO: 191225 - RNA, 44710 nt, Homo sapiens
ucaauuaguaaaaguacuuuauuuuccucuuguauuugcuuuauaucuugcuuuacaaaguuacgaaguucacagcuuuauaccaaaauguaagaaggcuauuugcuuauaaacauuuuugcagucaggugucaucugauuucauucuucuaauccauauucaauauuaaaaaaaucagaaaccaagggugcuggagcagcucuagggcauauauuucucuuaaauaggagaaagauuuucaacagcuuuuccuccuugacccccuccuuucccaauuuauuugggucacuaccuugaauuuagagugaaucugggaaauguagucaccagguaacccagcagggccauauacuugggcuuggaggugagguuagagguuacugucuaauacaguaggucugguuucuaugaggagcucauauccacuugcauaaggaaaccuagucuaucccaaaucaccuccaccacaacuucuauuccugucuauuagaccacuucucuuaaacccgaggaaccugaugauuugggggcagggauaaaaccauuauuuuauaaauguggcagguauggccuucguaauucuagaagcucccguuuagguaacagaaacaaaauuuagauguaagcauaaacugcaguuauuugagcaaaccagagcauaugugcuguucaaaucccacuucacaauauacuucaaucucaccuccaaugaauucucuuccauaaaauaaaccauuccacuaaguauauaccuacucccaccaaaucauccacaugccucaucacuaaaguugucccuuguauaaucuaccagcaaaaagacaaaauaaaaccuguguuaagcaaauaaucacuuaaacaguaauaauauugccucuaaauuaaagguaagucaggagcugaacacucaacuguuaacucuucuggggaagaagaaaauuuuucccacaaaagcaggagugcaguaguaaguaaugacuuucucucagauucaaguaacaucaggucaagauaaccuuugcuguuagaguuuuguuugcaugguguggaacugcuuuauaaacugaguagagacguaugccaaaauuauuuuuaaccuaauuaaaaacuuucacagaaaacuugaagugacugauacuuuaucacaacgaacugccauuuaaacacuagcauagguacacaaaaagauuuauacuaugguuuucuuggcuuuaagccauuagaauuagacaaaagcaaccgagaguaacauucuaaaaguggcuucaacuacuuuaaagacaugagucaguuuuugucaggucauuuaaugguuucuuuccuucacaaagccacuaaaugccagagucaacacagaucccugagccauagcucuucucugaggggaaacaggguuauaaucagucacaacauuguggaagacauuaaaaaaagaaggcaaaguucuguauaauuuucaagacucuuguaaguaguaacacacagccauaagcagccaaaaugcuuauggucccuuuauuucuuaauagagggcuagaaccguucauuugggguaacacacuaaucugguguuaaaagaauuucauguguucuugaaacaaaggcauacugccacugcuucaaaaaaagccuuugugaaaugaagaaaaauaugacaaacacagguucccacacguacacauacauacaaaggaaccugcacacuugcacacacacaggcagguauaggcacacaguuccaccaaagcgaaguccaaaucagaguucuuaccgauucuaccacucuguaauacucucagaaguucccacaacugcccaacaccucaccuacccguuuccugcugcacaaagucuccuucacucucaucuuuucgauacaucgucaggcagggcagaagggcacuacgccgcagagcauucgaggcucucagcacacugccagccagcgugaaaaugcggcuucacuacagcccagagaaaagggccagguuuagucaucgauccagaugcauuuucccgggaaaugaccauucccaaacccacagaacaguuuggcuucucuggauauccuuauaggaaauaggggugagaggugggaaaagcuucucaaucucauacagaaacagcacaaauauuuaauacaccuuuugcaacaagaucuucucuguucuccauuaagcaucauguaaaucucacuagugugguuaacaaaauggcuuuccccaaggacagaagucaagagcuuguggggccauauauuaucuaguacuaggccauucauuaucuccuagauuaacucuuuuuuuuuuuuuuuugagguggaguuucacucuugucgcccaggcuggagugcaguaguaugaucuuggcucacugcaacuucuaccuccaggguucaagugauucuccugucucagccuccugaguagcugagacuacaggcacauaccaccacacccagcuaauuuuuguauuuuuaauagagacgggguuucacuauguuggccaggcuggucucaaaugccugaccuugagugauccacccgccucggccucccaaagagcugggauuacaggugugagccaccaggcccggccuccuagauuaauucuugacauuuuuuggaucaaguaagaaccacuggagccuuuccuggaaaaaagaacacauacucagucucacacacaauuucugggggcucacagacccucuugaagccuauccauaaacccccuggugaagucccccugcccgauagccugagggaagacaugugaguggauauaugugcacuaacaggggcgaagacagaccuggauggucugcaaucccagagagcaugaggcaccaugucccaaagcuugguauguggcccugggcuccucccccaauuuuaucucucugaagaagcugaguuuuuuuuuuuuuuuuugagacggagucucacucugucaccaggcuggagugcaguggcacgaucucagcuuacugcaaucucugccucccggguucaagcgauucuccugccucagccuccugagcagcugggauuacaggcgcccaccacgcccggcuuuuuguauuuuuaguagagacgggguuuugccauguuggccaggcuggucugcaacuccuagccucaggugaucugccugccucagccucccaaagugcugggauuacaggcgugagccaccacgcccggccacguucugaguuuugaggauccagaaacaaaaggcuggaaagcgacacuucuacagguuuacugaugaguccggagaaaauccaaaaacaaagccccacugaggguuugugaauuuggcuguucucaguggccaggcagagucucugcuccacucuucuuucccagcuagcagggaagugaaggcaaagaacugucucagaaacaagucucuaggaagucugcuugagguccugaaaacuguauucagaugcuuuauucuaacccccucucccccaccaucuuaguugcugcagggggguggaaaacaccccgugagcccagaggaauauucgauggcugccaucggucuaggcacggccauacagugggagagauggaggcuggcaacugaacaaaccaaaaggguucaaaccaacauuaggcuugcagggucagacacuagaaaggaagauaaagguacaccuccaguucaacagccugacaggaucuguaacagguagugcccagguucaacagcagauguaaagguagacguuaggucuacgcacugccucacacugagcuuucuauccacauuuacagagauuuacuagaaguggugucuguaaggacuugucacuaugugauuugcuuccugaauuccuaaaagauagucagcagagcagccacuguuugucaaaaaucuacuguguccuuuagcacuuaaagccagcucuaucuauaaagcaagaaaacagugacacacacugcacauaauuguuaagaaagaaaacuauuugcuuccaguuuaaauacccagcuauuacaaauggagaaauuaaaacugauccucaaagucuggcacuuaaacaaacuuguacuuaaaagccugacuauagguuuaaaccaucauaagaacauaaauuaaaaauugcaaacugaaaucaauaaaauauacauaugauuagggucaaacuggguaaccaauuaggaucuguaucuucaauaaacaucuggagaacgcaaauagcauauaucacuauaugccaugcugucccagagaaguaugguuccuuaacauuugucuaaaucuauuuaaaaccuccagcaagaacuuaaaaguguaauuuaucaucccauagagcugcccagacuuaugcuagggguaugccuggcuaguaaccacuuucuccuuccuuacuucaccaagaaagggaagagaguggccuguguggggggccaaugugaaaauaguucaacuaaugacuucccaacgugggaggcaaaaaacuucaugaaucaauuuugcugucaucuucagcaugucguucaauauguccugcagcauccuaggaaugaagggaaaagggcccaugagagagaagucgauaguaagacaggagaaagucaaagccaaggaaagccauguggguccauuccaccuaggauccagacaggaaaggcaguuaggagccagcacuuugcuaacuuacgugaaaccauguacuuaaaggugagcuguugucucagcacaagagcacuguaauaaaucuccagguucaguuacuggauuugaaacaucugaaaacauucucuuuaggcccuuucucaaaaaugaccuaauucuucauuugcaacuucauuaagcuaccccccaaaucucugaaucauaaaaauaaaaaacccuaggcccucccuauauauggcaauucucaauaauaaaaaagguuugcuagccccugcucugagcagucuacugaaucccaggcaaaccucaagucccacuaauguaccuguuuggauccuuuccuagcagugaaaaaagcaucgcaguucuuccagcgacauuucagagucuggaaguugggauuaguguggucggucagcaaguguuguuuuaaaugaucuacaacgccaaauaucagagagcaaccaugccacuggagagaaagaaaaugaggagacucggugaaaaagggugcagugaacgugaaucagaacagcccccagcuggaucccauaagcacuauggaagcaaaaagccagccccuuauuucaaauuuauucuuggcuagaaaagacaacaaagccaaggcaaccaaaauaucaguauaaugaggaaccuugaaaauacuggaaaaaucuuuugauauuuugagagggcacagcacuaacguagcaauuacaacuucuuaaaucaggaaaaggccagcaaauguuuauggguaaauuaccaugaaauucuguuuaaacuguauuuuuugauguugccaucauaaaauugaguuucuaucuuaguuuauucaauacaaaaggcaaauaccuuuccuauaauaucgaaagggcuuuuuuuuuuuuuuuuuugagauggaguuucacuccuguugcccaggcuggagugcaguggcacgaucucggcucacugcaaccucugcccccugcccccuggguucaagcaguucugcugccucggccucccaaauaguugggauuacaggcgugcaccaccacggccaguuaauuuuuuuuuuuuuuuuuuuuuuuuuuaguaaagacaggguuucaccauguuggucaggcuggucucaaacucccaaccucaagugauccgcccaucuuggccucccaaagugcugggauuacaggcgugagccaccgcaccccgcccgaaagggcuauuuuuaacaauucuaagaacuguugaauguaaaugugaaaauaaaaaugucugauaaagaaaacuacauuuguggaaauauuuauuguagaauacuguguuugccauggaagccugacuuuacucacaaccuuugucacuugaaucucaaucuuaugaauaccuacuuauuuuuuuaagcuauaauuuuacuuauaaacguggcuuaauuucauguauuagaaagcauaagcuagugucuuaugcuuccuaagugguggcucagugggauuacacccuguaaucccagcacuuugggaggccgaggugggugguucacuucagcccaggagcucgagaccagccugggcaacauagugagacccuuucucuaccaaaaaaaaaaaaaaaaaaauacaggccgggcgugguggcucacaccuguaauccuagcacuuugggaugcugaggcaggcggaucaccugaggucaggaguucaagaccagccuggccaacauagugaaaccugacucuacugaaaauacaaaaaucagccaggcguguggcaugugccuguaaucucagcuauccaggaggcugaggcaggagaaucgcuggaacuugggaaguggaggcugcagugagccaagaucgcacuccagccugggugacagagcgagacucugucucagaaaaaaaauaaauaauaaaaauaauacaaaaauuagcugggcauaguggcacaugccuacagucccagcuaccagggaggccgagguagggugauugcuggagccugggaggcugaagcugcagugacuguugugaccacaccgcugcacucccgccugaguaacauaacaagacccugucucaaaaaaaaaaagaaaagaaaaacaaggaagcacaaagacucucugucuuggcuuuucccuacaggcuuguugguaaagucuugugauucuaauucgaacacauguuuauuucuuaaaaguaaugcaggccgggcacuguggcucacgccugucaucccagcacuuugggaggccgaggcaggugguucacaaggucaggaguucaagaccagccuggccaacauggugaaacccugucucuacuaaaaauacaaaaauuagccaggugugguggcgggcgccuguguucccagcuacuagggaggcugaggcaggagaaucgcuugaaccagggagucggagguugcagugagccgagauugcaccacugcacuccagccugggcaacagagugagauucugucucaaaaaacaaaacaaaacaaaaaaaguaaugcaaaguuaaguuuuuccucugucaguacuacuccauccuucucucuauaaagccagagguaucuuccccauuucucucuauagauuaacucuauuuguguacucuggauccugucguucaguagugccuccuuauccaugguuucacuuucugagguuuuaguuaccugugguuaacugaucuucaaaaauauuaauuggaaaauucccaaaauaaacaauucuugaguuuuaaauugcacauuauucugagcagugugaugaaaucuccugccaucccacuccaucuugcccagaugugaacugucccucuguccaacauaucuacauuauauucgcuaccgccuguuagucacuuagcccucuugauuauuacaucaaaaaaacauagaccauaucccccuuggauaaagaggaacugcacuagauucugcuugccuucacugagaaaauuaaaaagcaaagauaguaauauguaaagagcuaaaaagucacuaagcugugggcaagcguaaagucgaauuuuaaaauggagagugucaaguucacgccaucaaugcugaaaaggaucuuaggguuuuagggaaaagcuaccauuguuagaacugacgaaaaaaaaauuaaggcuuauaagaaauagugugaaaauuuuaaggguuaaucaucaguccuaaccccaaaauaaaaaccacacaauucagccugaugaacuaagguuuagaacuuacaagaccuuaaauuuuuuuuauuugccuauuccucaaaaaccaaugaggacacaaaccaaaccauuaacacuaguaaucucugaugagcgggaguagagggggcagugccauuaccaaaauaagcacuuccgcuuuuuauuucauauauuucuguacuguuguuuucuaagcauguauugauuuuauaauaaaacaaaaccaccaccgaggagacaaccugugaucuacaguguaaggcauaaaguagaugcuaaaauauaaaaaugcuacacugaugauaaugaagaucuaucaauuagccuagggugaagcaaccuauagaaguccagugacaggaagaguuucacuccuuacccaacagcgguaauucugcaucagauuaagccucacggccugaauacugccaucauaacagccaguguaaaucuggagaaagagagguuuauaauaucagaccaaaauacauacaaacuacaaaacacccucaaaacaagagucacaagcuccuugcagcagcuacaagaaaacaaacaccuaaaucaaaaccagcuccagagcaggagaaugggaaaguauuuuccagaucuucuagucuagguauuuugcagcugugcuccuuagaaagccacuugggaccagggcagagaggaguggcagggcucagaggcacccacuuguccuuuauacuuuaacugggguagcccugguuucuaucgggugcucuauguuaggcaccuguauuucccuggaaaagaaaggauucuacuacucagagucugaaaaacauccauucugguucaacuccauaacuuaaaaauaaaaaaaacaaggcuuagcaggguuacgugaguugguuucuacuuuuaggucugcuguaaccaugccacacuggccaaaucuccugacuccauuccaguguuccauucagaucaugucucuggaaaaggcaccacucaauuuuuugaagcaucuuaaauuuaccuucuauuaaacuguaguugauacuaccauuuuuauuguaauaauuuuggcuauuaauagacaauggaauauucaacacuguccccugguuacuucccuauuaugccaagagaugggaagguacuuaacaaugaggcauaucagaagcagaugucacuuuuggaagugacaagaauuuuuuagcaaacacauucaaaagcaaauaucuuacaugacaaauaacacucaccaugcuuuuauggauggucauacacauaaucaugucuuuguguccuccauaaacuuguaaucgaucaugagacuuaggcagaaaaaaaaaaagagaauugaaguuauuuauaccuugcguuuaauaaguacagucccuaaaggccuuuggcagguuuaaaaccacaccugaggcgccaaguggaagcaccaguagcauucuaacagaaauauaaucuaauggcaauuuuucuuuuacauucuacuacucaaggagggagcugguaauuagaaguaauaaaaucaauuuuguuagaaucagaguuucaaacuugaaacugcacacaaggagaacuagacagguuuuaagagacuggaguugcucuccagaaauuaaguuuugacacccaugacccagaucaaguaucuuagagugguuucugaaagcugcaguccacaggccagcuguuucauaauuaucuagaaugcuugugaaaauacagauuccuggguuccaucccaccuuacuguaucaaaaaucaacacuaaacccaaauagacaaucuccccaaaucauucaagcaaaauacugaaucuaaauucuaccuguaauucauagacacgaacaaauuuauccaggcaagcagucaccaucacuuuuccuaggauauucaccacagucacugcaugauugugaccuuuauagauccgcacgagcucaccagucuaugucagaagagaaguaagagucaccagacugacuuucgagacuccuuccugguuauaauucuauaauucuaagaggcauaauucugaggauacuguacacauauaauuaauacaauuaauuguauuaacuguacaaauacaguuaauacaacuguauuaacuuuaauagcagaaguaucccacaaucauuuauuacauauacaaaauauauggauuguauccugauggaaagacucuaauauuagucauggaaagaaagcggccaaaacucuaucuguauuuauagcuuuccaaguacuuucacuuuuuucauuucacuggaucuagaccacaagucuaucaggugggaauuauucugagguuaugaaccaggaacugagcuucaaaaagcugccucuaugaccugagaacagucucucagcuguuucuguuguucauuuuuuuaagagauggggucucacaggccgggcacaguggcucacaccuauaauuccaaaacuuugggaggccgagcugggcagauuacuugagcucaggaguucaagaccagccugggcaacauggcaagacuccaucucuacaaaaaauauaaaaaaauuagccaggcauggaggcucacgccauuagucccagcuacuuggggggcugaggugggaggaucccuugagccuaggagguugaggcugcagugagucaagaucgcacuacugcacuccagccugggggacaaagugagaccccuaucucaaaaaaaaaaaagaaagaaagaaagaaauggggucucacuuggucacccaggguggagugcaguggugcaaucacagcucacugcagccuugaacuccuggggccaaauaauccucccaccucagccuccugaguagcuggaauuacaggacgcacugccaugcccagcuaauuaaaaaaaaauuuuuuuuaagagauggggccacuauuuugccuaggcuggucucaaacuccuggccucaagugaucuucccaccucagccuucugaguagcuggcauuacaggugacagccauugggcccagcucucagcuguuuuuacuaguucuauuuuaacuacauaucauauccacuuucuggaagccucagcugcucaguuuauuucaaguuuaaaugaggcauucaaacuaaaccuuacauaaagccugucuguccaccauuaaaaacuuugaugagguagaauuucuaaauuacacaauauuauccaagagcauaugcacagggaugauuacgaaucccuucgguggauaaagggcuuaauuuaaauugcaagagguuuaagaaaaccaucaagcuuuaaccauuauuuuauucacaguuucuuuacacaacaccaacacagcuuacgugaauguugugagcauggacugacugaucacuggagccacugaacacgagaucauucaccaccuuaaagaaaaaauuaaacaagucagauucuguauacgguucuuaauuuucucuauaacuuguaauacacauuggcaaauucuaauuuccauccuauuuugagaugagcacgaugaacuagguauaaaaguuucucagaugaauuuucucagcugaaacuuacaccccccuaccaagcaugcuaaugaacugacaauguauuauuacguuuguuaccuuuccagaaugauuaugaagcagccuagaagggcauucgaguauacccacaguauaacaaaauacacucauuguuucucaaaugaaagugcaucacuuggugauguugguguaaagaaaagguuugcaaucuccuugcucuuuccaagguggugcuucuaaaugaugcaugagacaacacgggaaaugccauuuaaaacccuucuuuguuuuguuuugcuuugcuugagucaaggucucacucuguugcccaugcuagaguacaguggcacaaucauggcucacugcagccucgaucuuuggugcucaagugauucucccaccucagccucauaaguaguacaggugcacaccacaacaucccgcuaauuuuuguauuuuuuuguagagaucgaguuuugccauguugcccuggcuggucucgaacuucugagcucaagcgaucccccugccucacccucccaaagugcugggacuacagacgugagccaccucgccuggccucaaaacccuucuauuugugccagacaacuccgauucucuugcacuguacuugccuucaugcaaagaaugguuuugcuauggcccuccagaguucugaggagcaguccauuccgggcaucgcguacacuaauugugcagucauaagaccccacgaccagcaguuuucgggcaccuuccugagcuguagcaagacagcugacugcccgagggccauggcauucaaagaucucaagucguuuguuguucuggaaaauaagccaagauuacagcuaaaaccaacuuagcuggaaaauucaacuaaccaacaucauuaccuugguacaaacucauuucugucaccuguacucaaauuuucauacccacucugcagccuuaacuuauccaucuccgcuauuucccacuccaacccuuuuuacugaaccucccccauccccugaucugaggagggcaaacgcuuacauuauaaacucauuuauaacuucaacccacaccaucuccauccuaauuagaaacugguucucuuuuuaugcuuucuuucaccaccuguaaguuaauaauaaugaagggugaaccuuuuuuuuucaaacucuagugcauauucccugacaccgacccaggaacuauuucugucauccaaaauuuaggcaaucuaugugucaugcuguuuccaaaaaucucuauuuagaauuaccuuccuagguaauuucaguaagucucaaauucuccacuuuuuuuuuuugagacggagucucgcucugucgcccaggcuggagugcaauggcgccaucucagcucacuccaaccuccgcuuccuggguucaagugagucuccugccgcagccuccugaguagcugggauuacaggcgcccgccaucacaccuggcuaauuuuuguauuuuuguaaagacaggguuucaccauguuggccaggauggucuugaacuccuaaccucaggugaucugccugccucagccucccauuacaggcgugagccaccacaccuggccuaaauucuccaccuuauuaugauguucuucuggcaccugguuccaugucaucucucacaacaucauuuaguagacuauagaagccuaauuauaucagagugguagggucacauccugaaucccaaaacauucuuuuaucucagauuuuagacuucuuuccuucaucccccagccaacccuguucauuaagccucccacuuccacagaaguuuuuuaggugcaugccuggaguaaggcuccuaaaacuaagcagaaagcgacagcugggagccuacauugcugagcaaugauuucaacaguguugaagugcuagggagacagacugaaaggaggucaggacccaaagguggaccggcccugguaaacaguccuggcucucuguugugacuccagaagcacuacauucuaagaguaugggcaaccuaggaaaaagcccagcccucaucuucaaaauucacaucuaugcagagauucucaaaugucugucucuaggaccaucuucuccagggcuuuucaauccuuuaaagaacuuuuccauuugaauuucuugucaucaucucaucauuuugccucaagauugucuugcuccuuacuucugucuacuacuuaaaaaaaaaaaaaagagagagagacagggucucacucugucagccagucuugaguacaauggugugauuauagcucacugcagccuugaaguccuggccccaagcaauccaccugccucagcuuccugaguagcugggacuccaggcgugugcuaccauacuuagcuuuuuuuuuuuuuuuuuuuuugagaaacagaggucuugcuuuguugcccaggcuggucucgaacuucugggcucaagcaauccuccuaccucagucucccaaagugcugggauuauaggcaugagccaccauacccauccacuucugucuacuucugauaaucucacgaaagagaagguaauuaggcaauuaucacguuuuagccuuuaaaauauuuuaaauuuacuuuccucuccauuucuauugcccuaauccaauuuaaucagacuuagaacuugucugcaucuaaaaugcaaaaaucuucacuaauugcccuucugugauguaucauaucgaacagaccaaaucacuuggcacuugauuauauacgugcuaaauucuucucacuugaucuuaaguuuccuguaggcagaaaccaugacauauuucaaugcacaccuucuguuaguuccagcuagcaugcagccuaugaaugacacuguaauaguaccauucuaacacaugguuacaagaugaccagaggauauggugccacaacuaauuagcaaucaaaccuaucgauucuaccucuuggauuauauauuuccuccauucccuucucuucauccuguuuaaccuuuuucaugucagcuuccacuacaaaaccuccuaaauggucucccugccuuugcuaauaccaaucuuucccaaucuuaucaacuccagugacuuuuucuaaaauauaaugggaucaugucucucauacuuuacagccuguaagaugaaguccaacuaccuuaacaaagcacacagggccaucaaaaacuaaaccuuauccuggggccuagcacauaacagaugcucaauaaaggcuaggucaacaaaugaauuuaucucugguuuaggaaagaaugaagccauaugggcauuacagcaaaccucuuaguucaccucacagaugggccgcccucaugaaacccuaaaccagugccaaaccacaccaaugucauacucaacggaauuuaaguucauuuuucuucauuuuuuuuaaaauauguaaugcuucaugaauuugcgugucauccuugugcagggaccaugcuaaucuucucuguaucauuccaauuuuaguguaugugcugucaaagugagcacuuaaguucauuuuuuaugaugucauucuuaaauugagacagacuaguuuaauacaugacucauuauuuggccccaaaucuucagacuugguuuaauuuaguggaguuacauuuugguccuggaacauuugaguagaagcagagagaauggaggaucuuguuucacuuacaucagaagauaacuguguuugaguaguggcuaauucugcugcuuccucacagaagaaaauaggaaaaucccugccugcuacuucuucccacacaugcucacacuguuuucaagugcaugggaaguaagccuuuucuccuccaaccacuaaccuuuauguugaaggugaccacagugccauuugccagucccgcauagaggauucgccaucuacuguggaggcagaggacccggucuuccagcuguaacugcuccacacacucucggcucugauaaaagcacacaaccuuuaaucagcagaggguacuggcaaaugagaugucaaaaacaauuccuccagaaagcagacuuuaaaaugacucuuaugcggaagaaagugugacauccucuauuuuguaggggacuaucuuagaucuguuucuccuuugaaauaugaggccuaagacuuccaagcuguagguaauaugaaaaauaaacauaaauucuaguaauguuacccauguuucuaacuuagaauguagaaauucuucaaaggguacuaugaguuaggucuuagccucuuaaauuaagaggccaaauauaaaagacaaagcucuauuuugacaucuaaagaggaaaaucaggauuauaguuauauauuugauaaaugcacuaaucaaauaugugguuuuccgcacaugauucucuauuucaauagcucccaaaugucuccuucaaacuggugccagguuagcugggcuaaauuacucaagaggcuuuuaaaauacauagaacccaagcuccaaccccaucccugagacucuuaauucagugggcucuagaaucuguguuuuaaaaaauuucccuaguaauucagaugcacaugcagauuuaauacccacuguuugaucugaccuucaaaaaacgauuucuuuuugagacggaguccugcucugucgcccaggcuggagugcaguggugcgaucucggcucacugcaagcuccaccuccccgguucacaccauucuccugccucagccucccgaguagcugggaccacaggcgcccgccaccacgcccagcuaauuuuuuguauuuuuuuaguagagacgggguuucaucguauuagccaggauggucucgaucuccugaccucgugaucugcccgccucggccucccuuacaugcaugagccacugugcccggccagaaaacgauuucuaccaauuuccuccaacuagauuguacuagcaaaucucuuuaucuagaaccaagaauugggacaggacauaguaaauucaaaauuuguuguugaggccggacacaguggcucaugccuguaauccuacacguugggaagccgaggcgggugaaucacgaggucaggagauugagacuauccuggcuaacacggugaaacccuguuucuacuaaaacuacaaaaauuagcugggcaugguggugcgugcuuguagucccagcuacuugggaggcugaggcaggagaacugcuugaaccacggaggcggagguugcagugagcagagaucaggucaccacacuccagccugggcgacacagcgagaccccgucucaauuaaaaaaaaaaaaauuuguuguugaaugauacugaagacccagguguagcuuuuuaagugggcuuggcuguagauauuaaaaucaagaugguuacaauuggguaggaugagaaaagcuguggcuugucaaauccauuggucucgucucccaaccuucuuucauaccuaaaagagucagucacuuaaauuauucaauuucuccccugaaaaaaucacaaacauaagugccauauaugaaauuguaagauacagcaaaagacaguaaauaugccuaaauauuaagauucauguugcuucccauuaauccuaugagaucuuuuguaacuuuauaggggaaauugaacauuacauagcaauaaaaaaggaacaaacuauuggcacauguaccaauacagaugaauuuucaaacauuauggugagcuaaagcuagacauaaaagaacacaugugguacaguuauacugauaugacagcuaagcacagagaaaaguaaucuaugacaggagucaaaauagugauuagcuuuagaagaagguuaugcccagggaggcauuugagggaagcuucagggcuaugaaauggucuacguuuugaucuuugugguaguuauacaaacaaauaucugcagaaaaauucaucaagcuguauacuuaaaaucugugugcuuuacuguaugaaguuaugucucaauguuaaaaaaugguuacaaaaucuuuuucacuaguguacgguccugcuaugccaaagacuacacguuagaacccuuaauacugaaaagccuuuuaaaagaguuuuugcuaauauugugaguaaaaaugguauuccuuguacuuugguuuuaauuugcauuuauuugcaagauuguauuuuuuucaguuauuuguuauuucuuuuuaagagacuugcuuguuuuuugucaauguauguuuagggauuuacuuauguauuuguuuuuugaaagacaaggucucgcucugccuccuggcuagagugcagugacgugauuacugcucacugcagccuugaccuccgaggcucaaggaauccucccaccucagccucccgaguagcuggaacuacaggcgugggccaucgcgcaugccuaguuaauuuuuaaauuuuuuuggagagaugaggucucgccauguugccuaggcuguucuugaacuccugggcucaagcgauccucccaacuuggccuccuaaaguguuaagauuauaggcaugaaccacugcaccuggcuauaggaauuuaaagguguaagccccuuacaacauauaccaaaccuguuuguccuaucuuaaguuacggcuuuucccccugguuuuauguaagacuauuuauuaccaaaauaugcuuacaauuuuuuuuuacaaguuuguauaauuuuuuacagguuuguacaagucgccuagcuaggcuugaacuccuggccucaaaugauccucccaccucaacaucccaaagcacuagaauuacaggcaugagccacugugcccagccucuuuuucuaguuucuuggauuuuaaagcuuucuucuuuucuaauagaagcaauuaaaaccacgaauuucccuuuuagcagugcuuuagcugcauccuacaaaugauacguugcauuuucauuuaguuagguauuuucuaauuucccucgugauuccuucuuugaaccacaauaauuuagaaguaucuuauuuucaucucccuauauuuggggauuucuuagauuucuguuacugcuuucuaauaaaugucauugugguuagagaacauacuuuguaugauuuuggugcuuuuaaauugauugaaauuuauuuaauagcccagcaugugguccugguaaauguucuaugugcacauucuugaaaaaaauguguauucugcaauuuugaguggaauguccuauaaauguuaauuggaucuugaucguuaaugauguuauacgguucuuuuuuuuuuuuuuuuuucuugaaaugaaguuuuucucuguugcccaggcuggaguacaguggugcaaaucucagcucacugcaaccuccaccucccagguucaagugauucuccugccucagcuuccugaguagcugggauuacaggcacguaccaccaggcccagcuaauuuuuuuguauuuuuauuuuuguuuauuuauuuuuugagacggaguuuacuuauuuuuucagacgcaccacacccagcuaauuuuuguauuuuuaguagagauggguuucaccauguuuuucaggcuggucucaaacuccugaccucaggugauaugcccaccuuggccucccaaagugcugggauuacaggcauuaagccaaccacagccagccuaauuuuuuuguauuuuuaguagagaugugguuucgccauguuggcuaggcuggucucgaacuccugaccucaagugauccacccgccucagccucccaaagugcugggauuacaggcaugagccaccacacccggccaguguuguacaguucuuguauauccuucaugguuuuuuauuuaguagucuaucaauuauugagaaaggguuguuaauguccccaacuauaacugugaauuugucuacuccuuucaguucuaucaguuauuguuucacguauuuuagagcucuguuauuagguaccuguacuuauaauuguuauaucuuucgggugugcugacucaucauuaugggauauccuccuuucuccaguaguauuccuugucuuuuucauuuuuuaaagggacagcgucucacucugucacccaggcuggagugcaguggcauugucauagcucacuauaaccucaaauuccucagcucaaaugauccucccaccucagccucccaaguagcuaggacuacagguacauauaaccacgcuugccucauuuuuuuauuuuuuguggagacgggaucucauuauguuaccgaggcuggucuggaacuuacagucucaagugauccucccaccucagccucccaaagugggauacaggcaugagccgcagugcccagucacgugucuuaaagucugcuugcucaauauuaacauaaccacuccagcucuguuacuauuugcauaguauaucuauuuccauucuuauucuuuuacuuucaaccuauuuugucuuuacauuuaaaguaugucucuuugccugggcaugguggugcaugccuguaaucccagcacugugggagaccaaagcaggaggacugcuugugcccaggagcuuuagaauagccuaggcaacauagcaagaccguauuucuaaaaaaaaaaaaaaaaaaaaaauuuaauuggcaaaccauagugacaugugccuguaaucccaauuuacucgggaggcugaggcggaaggaucacuugagcccaggaguucgaggcugcaaugaguuaugaucacgccacugcacccuagccagggugacaggccaagaccuugucucaaaaauaaaagugugucucuuguagacaacaaagauuuugauguuacuuuuguauccagccaauuucugucuuuugauuuuagugucaguucacucacauuucauauaauuauuaaauauggguaaauuuaggucuccaauuugcuauuugcuuucuauuugucucauuuuuauuccucuauuucuccuucuaccuucucuuguauuaaguauauuuuuauuuauuuauuuauuuuuuugagacggagucuugcucugucgcccaggcuggagugcaguggcgcaaucucggcucacugcaagcuccgccucccggcuucacaccauucuccugccucagccucccgaguagcugggacuacaggcgccugccaccacgccuggcuaauuuuucguauuuuuaguagagacgggguuucaccguguuagccaggguggucccgaucuccugaccucgugauccgcccaccucggccucccaaagugcugggauuacaggcgugagccaccgcgcccagccuuaaguauauuuuuagcucaccauuuuaauuccucaauugacuuucuaagcucaauuucuuugcauuguucuuuuuuuuuucuuuucuuuuuuuuuuggacagagucuugcucugucgcccaggcuggagugcaguggcaugaucuuggcucacugaaaucucugccuccuggguucaagugauucuccagccucagccucccgaguagcugggauuacaggugugcgucaccacacccgacuaauuuucauauuuuuaguagagacaggguuucaccagguuggccaggcuggucucacacuccugaccucaugauccucuuugcauuauucuuuuaguaauuacucuagggcaguauuucucaaagugcgguccccaaaccaucugcaucaguaucaccuaauaacuuauuagaaauguaaauucuuuuuguuuguuuugguuaauuuuuaugcuuuuuugaggcagguucuuguucugucacccaggcuguagugaagugacacaagcacagcucacuauaaccuugaauuccugggcucaagugauccucccaccucagccucccaaacagcuaggacuauaggugugcaucaccacacccagcugauuuuuauuuuuuauagagacagggucuugcuauguugcccagguuggucuugagcuccuggccucaagcaauccuccugcucuggccucccaaagugcugggauuacagacaugaaccauaguaccucgccuagaaauguaaauuugggagcuugaucacaagccuacuggaucagaaacucuggcaagggcugcaugugguggcucacgccuguaaucucagcacuuugggaggccaaggugggaggacugccugaccucaggaguucaaaaccagccugagcaacauggugagacccuguaccuuaaaaaacaaaaaacaaacaaacaaaaaaaacaccucugggaguggggaccaguaauauguguuuuaacaagcuguccaggucacugugaugcacacuaaaguugugagccagugccucuagggauuauauuuuuaaaauuauaacaagcuaguucaaauuaauacuuauucccaguaaaauauaagauccuuguccuagcacagcuccauucccucccccuucuuuauguuccuguuaucacauauauuccaccuauguuauaaacuuaaugauagucauaaauucugcuucacauaccuccaucuuuuaaagaaauuaaaaacauauuguauauaauuuuaaauguaauuuucucaugucuuucagugcauuuagguuuaaaaaacucucagaggagauguccauuucuaauucugcagauuuaaaaaguuuauacauuuugcucuuuuuuuuuuuuuuuuuuuccugagacggagcuucgcucuuguugccaaggcuggagugcaguggcacaaucucggcucacugcaaccuccaccuccuggguucaagugauucuccugccucagccucccaaguagcugcaauuacaggcaugcaccaccaugccuggcuaauuuuguauuuuuaguagagacaggguuucuccauguuggucaggcuggucucaaacucccaaccucaggugaauccacccgccucugccucccaaagugcugggauuagaggcgugagccacugagcccggccuacauuuuucucuuuauucuaucuaggauuaguuuugacauaugauaugcauaacauuuauggcaaagaccaaggaagguauauuauuaauaguaggaagugaaaaaauacugguggagagagacagaaaauaugguuuauguguaagucucauaucuaccuagggcuacaacaaugugcuaaacauuguuuagaagcaaaaaggagaugguggguagaaugaagcgucugccacagugucuccacuccacacaguaaauacaaaggcgacucaauaugaaccacuuuggauuucucuggacccaccuaccuuaacauuauagcagcggaugguauggucacuggacccgguguaaagggcagcauucuucccggaggucugaguaaccaggaggcaguuaacuuuggagguaugacccucaaagacaccaauacauuuccgacucuaaaguuuaagcacagaccagauuauuacuuaugagauauaggaggauuagauaauauauuuccucaacaaaaagaugcuaaaacauucaguucacugcuguauccucaugucuaaaacagcaccugguacacaaaagaugcucaguaaauguauguucaccaagugccuagcaaacagucacaggcaaugagguaucugaaaguauauguuaguugagccauaccagaaaauacuuauggcaacacuguaagacagccagaauuuuaauuaacguuuagggcaaagcuuucugacauauggaccaaggaccuagcaaauccaaacugcagcuaauuucccacaaaagaugagcauuugauaagcaguuugugagaaugcaccaugguauucaaaaacgucaggugcuaucacaggucuagugguucugguguuguuucuuuuuuuuuuuuuuugacagagucucgcucugucccccaggcuggagugcaguggcgcgaucucagcucacugcaagcucugccuccuggguucacaccauucuccugccucagccucccaaguagcugggacuacaggugcccgccaccacccccggcuaauuuuuuguauuuuuaguagagaugggguuucaccauguuagccaggauggucucaaucuccugaccucaugauccacccaccuuggccucccaaacugcugggauuauaggugugagccacugugcccggccacuggugguguuucuuauggguacauuccaaauguuaucucagugcacauacugagaucuauuuagaauguacauauauacauacacauacauauuuugauauccuguuccccuagaucuuacacuuauacauccugguagcacugcuuccuuuuuucagucauucguguuaauccucauaucauuaagcuaaaggaaucuacacaccuguugccuauauagcaaacacauuuuccugguccaucaucuaacuuuuuaauuuucacugacucuagcaauuuuaaauauuuucaugguauucauucagacaucauguucuucaaauuucuuaagcuuucauuguucauaaacauaauuaguuuauuaacaaauucaaauucaaaacucaaaaguucauucuuuugagaguaauaagcaucagauaauacuaagugugaggcaguggaaaaguguugcucuccuuaauaacuugaacucuguaaucaaucacuugucagggaaaauaccuccuccaguacuuccccauauucacuucaucccuccucuauuauguagcugcuaugcaagugaccccauuaccaacuccagcauugggaccugaacaguccaagaccacugguguaaucccaacccccuuugccacaggcaaaggugaucguucagggaguaaaacacaggacccuucugugcuggugggagggaaaaagagacuccaguggcuccugacauuuacccuguaagcaggaggggaacuagcuuucaggaagaggugauaccagagaaggcagaguagggagacaaaaagaaauuaaguccccagugaccuugcugagcuucuggauuaaaugcaucuaaagucaaucucaggcccaccccuuccuucagacagccaacaaauucccuuuauuguuuaaaaaaguauaaacuggauuuuccaaaaccugcaaccaaaaacauucuacauguucuaucaacuuaccaccagauuauaaacccgaacaguuuuaucugcugaacagguauauagcaaguucccaaauaucugaauugcauuuacggcagcuuggugucccucaaagcuuccuucuguggguucaucaucaucuccuggcucugaagauauuucuggaaaacaagaauagguuucagagacaugucugcuagagucugaaaagauacucaaaaaucagaacuauuauacaauacaguagucccuagauuaaaccaaaaguagaucccuuaaaucuuaguuccccuaucagacuacuacaauuuucaauacccaucuucacuaugaagacugcaugauaagcaaaggcagagaaggccuuucacuuaggaaaaagauagauaauuauauaaugagcuuuugggccaggcguggugacucacaccuguaaucccagcacuuugggaggccaaaauggacggaucaccugaggucaggaguuggagaccagccuagccaacauggugaaaccccaucucuacuaaaaauacaaacauuagccaggugugguagcgugagccuguagucccaguuauuuggggaggcugaggcaagagaaucacuugaacccagaggcagagguugcagugagccaagaucacaccacuggacuccagccugggcgacaacgacuccgucucaaaaaaaaaaaaaaaaagaaaaagagcuuugagugauacuuggaagguauccaaucucucccacacuuccaaaaaguuauuucuuugaguaauguaguauuccuuaagcaguuccuucugaaagcaaauauccuuagagccaaugaaaccuuaauacuaauuaguugaacagauaagggagccggauaagacagaugagaaaggccaggcaugguggcucacgccuguagucccagcacuuugggaggacaaggcaggaggaucacuugaggccaggaguucgagaccagccuggccaacaugacgaaacccugucucuacuaaaaauacaaaaaaaaauuugccaggcgugauggcgcgcaccuguggucccagcuauuugggaggcugaggcaggagaacugcuugaaccugggagguggaaguugcagugaguagagauagcgccacugcacuccagcccaggugacagagcaagacucuguuacaaccagucaaucaaucagauagaugagaauaagaaucugaaagaccaggauuugagguuuuaagaauaucagaacuguugaucaaggcaauccucuuggugauaaaccccuccccauucuccuauucuauaaauauauuuaaguagguuuaaauccuggcuuuaauauuuacaaggcuuuuaauucugugguuaacuuaaauaaaacugaacagcaaauaccugaagaauucuuugauccuuuuauggaggagaucacagucugaguuucugccacacuacaaaauaauagcaaaaguguucucagcaucugugugaacagggcagguaguaaaaguaaaaauuucugacucaaaggauuuuucuaaacaaugggcaaaguagcaaugauauaagagauuagauuuuccaucugaaauuucuuaaugaagggaaauaaaagcagagugaauauuuauaacacagucaaaagagaaagcagaaaaucucuacugcugagcuuuaauuuuuccauauccacaaucucuacugcauucacauaaaguuugguuuuuaaagaaauucugauucauaauuucaaauucuauuuaaaaaaauaaaguuggugaaaguuguucugacuggaccaauacaauauucuuaccuuacagggaugccaucuuuauagcgagugccaauuucacugguagagcuaacuucaucacacccagaacgagacguuucuaguggguuuugcucuguagaguuccaaauauccuuuuuagaugggcugucugguuucucuucuccugauucugaagaaucaauggcuacuacuucuaacugaggauuaggaauuucuaggacuuccagagacgagucacuaucuggcucaucucugacacucuccugcucccgaccaguccugcugucuucccaaguggagguuguuacuuuccccccuuuaauuaacuuuccagcuuuuacuuuccuuacagguuuaacagucaaaacauccuguucagugucacuauucucaggaacaugggcagcccguagacuuuucuucuuccggaguuucuucuuuuucuugcuuccccuagucucagcugaugucaaaguggauucugccuguuguucaggcuggucagcuggagagugggguuccuucuccaaagggguuucugaagcaaaagacaaucuuagaaaagaacugguacaggcuucagacccacuauugccuuugguuggcucuuccccuucuuuauuuaugcuagaaagaccagcugauugggaagagggagaguuuucucuguuucugguauuucuuugcuccacagaaaacuucaguucuuggcuaggcucauggaaacuuucuguugacucugguaaggacaaucuagcagugaugacuggauaaacuggacaacugucacugaucucuccugaauugagaggaaaaaaauuauugcauccuuuuuuguguuugcugcaauuuaucacugacugaaacucuaccaaauauuucaaugauauguucagaaaaccaugacuguuucagcugguaucucaccccucaguuucccaucaccuacauacacuccuaugacaacacuuacuacccucugccuugcgugaaucucacaaacacugugugucuuauucccuacaaaagcuccuuguggggagggauuguuucuaucaaucuuuuuucuuguuuuaaauguccacacauuuaacauugugguuuauucuuaguagacacuuaaaugucuacuuagcugaaguccuuuuacuuuuauuucuuugaaguuuucauuauccacacccauccaauuuagcuacagcuuaguaguuaaaaaaauuugcugacuuagaaaugucaauuuccuuugacuuaguuacuucaugucuaggaauuaaaagugaugaaauaaucacagauguacucaaagacauauacaaugcaguguuacacagaauaugaaaaaaguuagaaaacuaaauauucaaaaaagauucaccacauaaauuauuguuuagccagauuaugcaacuauucaaauauuaugcaacuuguaauauaaaauacuuuagauaaauuauuuuuacaacagaaaaaucauuauauauuaaauggaaaaagucagguuauauaugacugcuccuuuguacaaguucuacauguaaacacaaaaauaugauuuaagaaagauugaaauaauauguaauacgaaaaauaauaguaccaaaauauuucauguaauccauaaauauauacaccuacuauguacccacaaaaauuuaaaauaauuuuuaaaaauaugcuaggggcugggcaagguggcucaugucuguaaucccagcacuuuggaaggcugaggcggucggaucacuugaggucaggaguucaagaccagcuuggccaacauggugaaagccugucucuauuaaaaauacauaaauuagcugggcaugguggugggcgccuguaaucccagcuauucgggaggcugagacaggacaaucacuugaaccugggaggcagagguugccgugagccaagagcaugccauugcacaccagccugggcaacaaaaagcgaaacucugucuaaaaaaaaaaaaaaaauauauauauauauauauauauauauauauauauauauauauauauauaugcuaagucacgcgcaguggcucacaccuguaaucugagcacuuugggaggccaaggcggguggaucacuugagcccaggagaucaagaccagccugggcaacauggugaauccccaucucuacuuaaaaaaaaaaaaaaaaaaaauuagccgggcaugguggcaggcaucuguaguccuagcuccucuggaggaugaggugggaggaucaacugagcccaggaggucaagccuguggugagcugugauuaugccaccauacuccagccugagugucagagugagacucugucucaauaaauaaauaagcuauauauuugauacuaacaucuagauuaauauugcaacauaguacugguaguaaaaucuagaguaauuuuuuaaacuuuuugcuuuugcucaggaaaccacacaaugccaguuuguuggacuuaauuuucaaauacagcaccacugugguaaugcaaacuucuaacaggauuuuacauagcuuagacguauucucaaaugauaaccagguaaguguuauuuuuugaaaagagugaaaacccuggcuauuucucaacagcaaguucuuaguagaugauuccaaaccccaucauggccaccugccucucacgcuuauauuaauccugguuuguauuugagauuauauagacaguaagugcaaagaaauucagaggauagaccuuauucagaaaauuggcugaauuaacuucaaccccauuuauuucacacgaaacaaauuuuguacuuauccuaauaaauggaaccuugugggugcuaauacaaagucaacucuaacccuagauuagaggaaaugaaagaaaaugacugauauuuaaauuacauucucuaaaauauuuuaaaagaauccuccuguauauaugaagagaauuccagugacaaauuaguuguacuugcucauuuuaguuuuaaugagcaaguauggcuuauaucacucauauaaaaaugccccagucucacuacugggaugcccuuaacccagagaaaagcuuacauacuauuagcuuccaguaauuccuuggacacauugcaggcagagcuugguggcacagcauucacauucucaucuuguucaggagacaugggcucuuguuuaaucugaacugaugagucuggagcagggacacugccauggguuuggaaaguaggagacgugguuauuugaagagaggcuccggugggugauggagacacaugggaagauggaggcuccagaaaaagugggaaaaagggagugggcagcagugcggcaucaauggauguuugagaucuacuguuccuucguucucgugugaggcuacagggaaccuggucugggugcucagaagguucauauguuucuagaaugggaaacauacauacauagaaaugcaaaaauguuaucugaaaagucauuugugucugagcuaauuuguauuuuuaaacauuagaaaagaauuauaaauaaguauauuaguauagucccucauaauucuccgaaauauggagaauauaaucucuacaaccaccaaggauacagagagaauaggcaucaacauucuuuuuuuuuuuuuuuuuuuugagauagggucucgcuuugucacccaggcugcagugcaguggugcaaacacugcucacugcagccuugaccuccuggacucaagcaauucuccugccucagccucccaagcagcugggauuauaggcacaugccacuaugcccagcuauuauuguuauuauuuuuuugagacagagucucacucugucacccaggcuggagugcaguggcgcaaucucggcucacugcaaccuccaccucccggguccaagcgauucuccugccucagcguccugaguagcugggauuacaggagcacgccaccaugcccagcuaauuuuuguauuuuuaguagagaugggguuucaccauguuggucaggcuggaauuauuauuauuacuaauaauaauuaucaauaauuuuuguauuuauuuguagagacaggguuucaccacauugcccaggcuggucucaaacuucugggcucaaggaauccaccugccucagacucccaaagugcugggauuacaggcaugaggcacugugccuagcaacauuccaauuuuucaaauuuuaaaugacuuauccaaaguuauauaggcuacuaauggaagggagaagauuugaacccaggccuuuugauuccuaaucaaaacucuuuccauaacauauugucuguugcuaaacauuuuugggaugcacaguuuacagaccuuucuauagaaggaagaaacuggccaggcguggugguucaggccuguaaucccaaccauuugggaggucaaguuaggaggacugcuugagcccaggaguuugggacuauccugggaaacacugggagauuccaucucuauaaaagcauuuuuuaauuuuuauaacuuuuuauaauuuuauauaacuuuuuauaaccuuuaaauuuuuacaauuuaaaucauaauuuuauaaaauuaaaaguuagaaauuuuaauaaccaggcauggugacacacgucuguagucccagcuacuggggggagugaggugggaaaauugcuugagcccaggaggucaaggcugcagugagccaugaucgugccacugcgcuccagccugagugacagagcaagacccugucucaaaaaaacaaaaaaaaaggaugaaaccaaggagacaggagagaaauaacaugaccuuuucaugacuacuuuucauccccucaaagagaacaaaaaggccuggugcaguggcucaugccuguaaucccagaacuuugggaggcugaggcaggcggaucaccugaggucaggaguucgagaccagucuggccaacauggcgaacccuguaacccugucucuacuaaaaauacaaaaauuagcuggggguggggugggcaccuguaauuccagcuaaucaaaugcugaggcacgaguaucacuugaaccugggaggcagagguugcagugagcagagauugcaccacugcacuccagccugggaaauagagcaagacucugucuccaaaaaaaaaaaaaaaaaaaaaaaaaagcagagaaaacaaaaaaguaacacgcuauagagggcccaauccaucagaugcccucugaauaccuuguaaucccuguagaaucuguauucuauggguccucagugcacucaucuccauaguuaucuaaaaauaaaguauuuuauuaagcauuuugaaauccaacuuguaagguccucuaggucuccccauuuuucuucuauguccugaccaaaaaucagagugucuugacugcucugugacccagccagccgcagguuuucuccagcaggcuugaacccuaccuggggccuugaagauucccaggcacugauaaaaguaucuagguuguugcccaaaacacugaaagaaauuggcccuggcccugagccaaauuccuuaaacccucauauaaacuccacaucccgcccccuggcuguggauauaccuagggagaacacccuuguggggacugcugcagccuacucuguaaguaagcucuccuaauaaaugcuuuggacucaucacccuggcauuuagugcuucuuucuuuggaauccuaacugucccccauuaggcacagucuggggcacuucccuuguggaaacuccccugccauugcuuuuggggugacuccagacauggguuuggcagcacaaaacaagauuucggagaugauccauuuuuauuaaauccuccacaugcuguuaccugcugcuugagcauaaguagccucugaacuuccacauaagcugucugaagggcugcacgggcuugcagaagauuguuauccaugcacugcaaugacuuacuaaguucuuccucccuuaaagaaauauucagcagcuggucaaccugagaacguucugccaaaagaaaucauaagguucagguuaauacgagagauuucccucucaucacacagcucagaagacuaaacuauacccauuauuuaggauaagacuuuauguucuccucaguaggucauuggaaauucauaaaacauuuagucaagcacaaugauaucaaagcuaggaaccaaaagugagaacugcuaagauggagguaucucauaagcuccaguguaccaucacaucauucugucucaucuaaucaccgccuucuaccaccaccuuuccaggugaaaucugucccaugcaaaccaccuguucuaggacucguuucccauucuuccuuuaucuaccacugucuucacacaggacuuuugcuuagauuggacucuagaccuagacugcuugcacucucuuuccaauccauauuuagucuguuaguugacuuaaaaauuguuuuuauuagagaagacuuccugaagaaaauacagcuuugaaauaguacauuuaacuuaguuugaauaaaauguucuguguauguauuuaccaucauuguguuugucuguuuccuauucaauaugccaggaccucucccuuaagcuccacacccacauauccaacuacugacuaugauauuucuagcuagguuaucucaaagguccuuuaagucaaagaaucccugagggaauucaucaucuuucucuauucucaaucugcuccucucauggaguuuucuagcucuacauaugcuccaucugguuggcccagccagaaauguggguuguccuugacuccucccuuauccaucacauccacucacucaagccucauccaaucacuuccaggacuagcccuuauacuagaacuggguuagagucaaggaaaagcaagaaucacagaaauacaucaaugagggagcaauguuaauaacuucuuuccauaauucacuuuagaaaagcaaccaaggaagggaguguggagguggggcagcggggaagcaaccaagaugccucaaaaacugaaagugagagaaauggcuauacaugaccaagagggccaacacauuucaucccacugaaaaggcucaaggaaacuuccuggcuuuauauuguccaagugguauacuaaccuuggcuuacaagucuaugugacaucauauauuucuucuacaguuguuaacuggauguauuaggaaaucaaacuuuucuuuccucuuaagcaaggcaacaaaaauguccaaaaaaaguaaauggacaaucaguguuugauaaaugacaagcuaugcucugugucaagcugcacaaacgcugaacugcuacaagaaccucuuggggcugggcacgguggcucacaucuauaauccuaacacuuugggaggccaaggugagaggaucacuggaguccaggaguuugaguccagccugggcaauauagcuagacccugucucuacaaaaaaauaaaagaauuaauguagugucacauaccaguaguccuagcugcucgggaggcugagagaagaggauugcuugagcccaagaguuggagguuaccaaaaacccgcaccccccaaaaaaaaccaaaaaacaccaacuucuuucuuccaaaauauucugcaccauaccuuuuuuuccuuuaauuuuccuucuuuuauuuuuucucucaagacuugggaguucaggagaagauccauccuggaaggauaaagaaaacugaauaaaauccaauguguaaaagccauuauccaagaggagaaaaaggaaucaauucuaagauagccauacacuguucuucacuauugcuaccaucucuaacaugaucguagaagucucacgcacgugguaccaacgcaaacuuuaguugaauaaacguaucugauuuaaaaaaaaagaauccagggugaagugccuccuagcauccuagagguaggaaagcccauggaggucagggaaagcauuucaucuugguguaguaaggcacaaguagaaguauagacaaagccaguaaaauaaauauaucugauuuauaacuuggcauaguuucuacuuuaaauuucagcaagaaaaccuuuacaacaaaaagcuuaacaguccaugagacaagcucuuugucauaggacaaucccucagcuugaaguguauuuuaagucauccaguaacauccacuacauauagcaucuagcucaaaggagcagaauugcaauuugaagcaagucuaaaauucaugaccuuaacuacuaugcuuaucaccucaguauuaaaugagagaagcccagcacagugacacaugcuuguaguccccgcuacuugggaggcugaggcaggaggacugcuugaguucaggaguuccagagcaguauggacaacauugugagaccucaucucuaauauaaauuuuaaaauauuauaaaauaaauaaauaaauaaugaagagaagaacccauuuuuuuucacauugccagaucccagacuguaucacuaccagcaacucuuucuuuucagaaagggauacugagaggguuaagccaauauuagcggcagaaaugccggaagagcagaagugguaucagugaaauaaaagacucuuaaaggccaggguggguaacugaaggacgaaggacagaguuacacagacuaaaaauauuucuauacucugcucauauauaugcacucuaauaguauuaaaaccaucuuaguguuaagccuaucacuccugaauccagcaaucauccaugcccuacaagugcaacaguagaacgccuuucuucaguagcagugcagaacgcaucuaugaaaacagauuggguuacagcugaauaugugacuuauccuuggucaggugauacaaagaaucauuggcuuggacacugguuuuagauaugacuucauauuuuccugguacuguacauucauauuagauuacauuuaauuuagcagaauuacucaguguaagaaaccaguaggaugaaaguaagaaccucacaauucuucuagaaguugagagaaucacaaucccagauacccaagaaaaacaguugaaccuuuuuucauaagcaaccaacuugccacaugcgauguucuacaaaaagcagagggaauuauacucacuccaguggcucuucguuucuuucuaauacuuuggccaucauuuuguucagcaccagagguacagcuacuaucuguggcugcauccgcuaaacuggagaucgcaagggcugaggaugcgcuugaugacagacaguuucccucuccauuacucuccugggaauucugauucucugacggugguauagaccucuccuggcuguucaagucuuuugccaaaugcaucaaagguauuauauggucagaggauaauugugcacuaugucgccuuuggguagcaacauuuucagcccuuucaccuguucggagggaggcagcccgaggugucacuucuuguuugaggugcaugguugcuuucuggcucuguccagcccucaaugaguuacuaggugaaaccaucugcuggggcucauuuucuuugccuguaccuuccucacugaagaagcuauacacagaaggagcucuguccaugaucacgcugcucucagaaaggcuucgcuuucuugccaagccaggggacgaggaaauggaaacaccuucccacuggaauccuucuagacuggacagaucagguuccccauccaaaucuaaggcuucuuguucauuuugaacaagggguaccauuucuaugccaaaccuuaaggaagaaagaaaaaaugaaaacauaaauuggauaugguuguugggaggggcauuauuuuuuaaugugccaggcucucucaagcacugagguuauaaaaaguaagguggcucuugccuucaaggggcucacagucuagucagugguacagauauaaauauauuacguugucacaaguaccagauuagagguuuguauacagcuauaauaauauauuugagggaguaaaaauugaguuuuguuucauauggagcgcuaaaucuauaauaauacauacagcauauaauuuuuaaaagcaaacaaaccaaaacaaaaaaaaaaacccuuuuacugagcacuuacaagugcuuuauacuuacaauuucaaaugcuacucacaaggugugggaaaggaaaguggggggaaauaaacccauuauuucaacaaguacagaaaugccccugaagccuggagaacuguaucaucaugcagcagaguuaugacuuucaaguagcaaacuuacguugaacacuguuuuagcauucagaaaagucuaguaccucaacauaagaugaagagccaaaauauuacacaagcgcuuaagagaaagcauguuguagucauaaagauaaugcccagaguacauacagaaaaguuaacuauucguagguucuaaguaaaagguaaugagaacaguuguauuuaaaaguuauagcacgcauuccaaaauuaagaucuagaaaaagacagagaucuauagcucuacauuuuuaugcugucauuuucuaccccuauaaagugacggauuuuaccccuguaaagccaugacuuuuuuccuacgucaccaccuuguuucucaaguaggugugcuuccauuuuaaccugcacucucugcuaggaaauacuuuauuccaucugucauagaguaucagucacuauuugauauuaaaucaagacaucuacaacagauauuguuggcaaacauuuaauuaaaugaaacacguagaauucucuugaucagggucaaaggguuacuuuaaaagaaagugaggaaaaaaaagacaccgaaaagcagcacacaccuggguaagccuuugcccagcucuugcuuuuucuugguuacuugcugaaugaccuguucccaguugacauuucuccgagaugcauuuagaaucugccguaggguuggcuugagcccagacuccuucucugucucacucuuucggugaccgcuaauauugcgaaugcggcgggcacuauugagguuuggcucaggaagguguacuccaguuuugcucuucaaacuaaugugccggguuagaucccucugaagugaggcaggaaagccaagcuuacuuaguucaggcaggagagggcccgagggcugacugaugucacuuuuuugaagcucugcauccaagcuagcacucucaaagccuucuguuucauaagauacaugagauuuaauagagucaucaaccugugcaucuucuagagagguuuucaagucuagcaauaagccaggguguggacuggcugcagaugucauuuguaauucagauucuuucuggcgaacuaugggauuacauggggaaguggauagcucucuagaagucuucaggaugcggucauccuccucuuucucaucagcaguucgagugcugccagauaacaauucuguaguugcagaaccuaggguuccaauuuuuguuccaugcuuuuccgugucagaugucucuccaucacuuucaucuucuagugcgugcacuugaaacucaauuuucaaagacccuuuuucagauucuucuacauuucuacuugcuuuugcauaguuccugguacuuuuagaagugcuaagaaguggauuuugcaaugacucaugacacuguagcaccucuuuggccuuucguaaaguaucauuuaaauuaucaccagauugcuuuugagagccaaauguacuuuuauucccuuuuaaaacaugaggacaugaacuacgcaguuuggauauguaaggaccaugguuaucuuccacagugggcuuguucgagggauuugaguguucuccaggggaaaaaaaauuuguuuugguguuuuuugagauauucuuuggaucuugcuuuugagacaaugauuuaguggcuggacauggaaggaguggggauuucaaugauggcauuuuauuugguguaugcucuuguucagguuuuucugcaguggggcacugucucaccaccucgaaggaagcagcggaaucagaagaggccuugugauuaagagauccaguauguauuucuuuuuguguuuucuguguuggggaauuacguguuucaucaguuuggggcuccuguauuccuguaguuaucaagcuaaaaucaaagagagguuucucuaucauuucugacuuguuaccagugaugucuuucaaucccgacuguaaauccagagucuucugagaaggguaaggcguccagcgacgaggcuuuucccuugccgcacugccauucuuuccacuaacuuuggaaguagcagugucugcuuguuuagugguuuggcuuuccagcugcucaaaauugaagucgaguaagccuucugaaggaaauuuaucacuuguaaauccuucagaaggaccucuauauguggcaacuguaccaaguuugucauuuucuugccgcugccaauuauaucugucgugacuguauuuguuugacuuauuagauuucuuguuccauagcauagucaugucuuccauuugacaguuagaauuucuguuucugccugguugaaauuugucuccagggccacuguaauuccaauuauuuguacuacguacacuggauuuccaguuuccguuacuguuguucauaugccaacuggaaaagccaccuguuccuucagaaagccaacuggaauuccuuccuguaccauuaugauuccaaucuacugcuccacuauuugaaagccaaccaccuccagaauuacuaugguugugaaaccaagucgaggagccuccugcaacacccuuaugccacccggaacguccucuugguccaccaccauuccucaaagaauguggaaagcuguuuuuccuaguauuauuaaagccaucuuuuucccauuuccaaucccgcuguggagguccacgaugaugccaugcaggcugacuguaacucucucugucuugguaaggaauucggucuucucgucuccauuggggucgucugucaucagaguuuauuucuugguugcuauuggaagguucaucuugucuggaagaaaaacaguuuuucauuagcgauuuaaaggaauuccuaugcuaccuugaaaggcauaacccaccaaacuucccuuguacuuuccucccguuacuuagaauauguaaccgagucugguuuuauaucuaauagugguuguuuucauaucuuuaaaugauauauuuaaacguauauuccucaacuuauuaauuuaaaaauaaaacauuuuaaauuacuuaaauuucaaguaauuacaaccaucucccccaucacucagaaauauuaaaaauuuggcacauuuggccaggugugguggcucacaucuauaauuccagcacuuugggaggccgaggcgggcaguucacuuuaggucaggaauucaagaccaacauggccgacauggagaaaccccaucucuacuaaaaauacaaaaauuagccaggcguaguggagcacgccuguaaccccagcuacucgggaggcugaggaaugagaaucacuugaacccaggagguggagguugcagugagcugagauuaugccauuacacuccagccuggguaacacagugagacucucucaaaaaaacaaacaaaaauuuggcacauuuauauucccucccuuucuuggucuuguuuuucuuggcauguucugagauuuugucccuaucauccaauuauuauuuuuguauuaugcagguuuuuuggaaaaagaacaaguauauuuuauagcuauaguuaucuuuuuuuuuuuuuuuuuuuuuugagacagagucuugcacuguuggccaggguggagugcaguggcacaaucucaggucacugcaaccucugucucccaggcucaagcaauucuccugccucagacucccgacuagcugggauuacaggcaugcgccaccacacccggcuaauuuuuguauuuuuaguagagacgggguuucaccauguuggccaggcugaucucaaacuccugaccucagguaauccacccaccgcggccucccaaagugcugggauuacagggguacaggcuugagccacugcgcccggccuaguuaucauauuuaguacaauuuuauguucagcugcccuuaauaccaugauuuuuccaguuguagguucuuucugaaaaacuccauuucuuaaccuauuuuaaauaagaugauacuuugcaugguuauuuuuauuaauaaacacuuuguccaguacccauucaauaacuguuagugguauaagaagacuuuuauguacaguuccaguuugugaaggccuuagaaccuagcugagacaguaaggucacaaacaggaggaaaauagcauauaccaaacaaguaguaaccauaauaugugcuauaaggagcuucaugagccagagguuuuuaaaaagaaacuacagcuguuucauguucaugucagacgaggaguccacagaaacaugaauaagcuucaguaagcaucacagcaauagguguaaaaaccauuuucuucuacaaacugccuauggugugcaugggcauggugcuuagcaugugguaagugcucaaaauacugaguacugcuagcuaaaauuuacugaguaccugagugucaggcauuuaaugcuaagcaccuuauauagauuaucucacuuaguuuuuauaauccugaggcaaguauuuuuuuuuuuuuuuuggagauggagucucgcuuugucgcccaggcuggagugcaauggcacgaucuuggcucacugcaaccucugccucucgaguucaagcgauucuccugccucagccuccugaguagcugggauuacaggcucccgccaccacgccuggcuaauuuuuguauuuuuaguagagacgggguuccaccauguuggccaggcuggucuugaacuccugaccucgugauccgcccaccucagccucccaaagugcugggauuacaggcauggcauguauucuuauuauuccuacuuuauagaugagaaauugagcaguagagagaauacauaacuugccuagaauaagauagccagaaagcaguagagcagagauuuaauccuuggcaaucugacuccagccagagucuauacucuuaaccacaggccuucagagaaucaacaucucaaaacaaaguuuccacauuuaaguuccuuccucugaccuugacuuaaaaaucuuaaacucaauacugacuuuaauuggcuuuaaaggcuuucaaugucuaugauauuuuggacacaaauuggaacuucuuccuuuuucacaagacggaauuuaaaagucuauuuagaaguucaaacauccacucauauuauauaaauuacaaucauuucuaaacaggagacucuuuagaaaguaacaaguauuauuacaugcaguagcagaauuuuuuuauaaccauuaaccaaauugccuuuaucuuuugauucuaugcaauaugcaacuucuggcauccaaggagaccacugacucagcuauacugauaugaucagaaaugggagaacugggggauaaauaaaucacaaaguagaauuccuagaucaucaugaauuggcuagauucagaagauaggagcauucagcuaaacccauagaccagaaagaauaaucuaaguuaaaaauucaugaaggaaaaaagaaaaaaaaaaauacuccugaagaaguagaugauuuuguccaggugugguggcucaugccuguaaucucagcacuuugggaggccaagguggguggaucacuugagcccagaaguucgaggccagccugggugacauggcuaaaccccaucucuaccaaaaauaaaaauaaaaaaaaaaaaauuagccacgcaugguggcgaugcaugccuguaguuccagcuucucgggagguugaggugggaggacuguuggagccuaggaaguugaggcugcagugaggugucaucgugccacugcacucaagccugggugacagaccgacacccugucucaaaaaaaaaaaagaaguagaugauuuuauaaauaggucaucaaggaggcacaucaaaagacucaaaaaauaguaacuaugauacaaaugucuaaucuauucugacuuaauguuuaauuauuuacacagauaaagcuaauaauggcacuaguauguaagaacaaaauagaagucucccagaggcuccaacugccuaaagcaggauaaaguaaacugcaacuauauuaaaaguaaugaaaaugucauuugaaggacuaagcuacuaaaugauuuaagaaccaugugguuugagugucccguaucugaaaugcuugggaccagaaagguuuugcauuucaaacugcuuuggauuuuggaauauuuuugcauauacauaaugggauauuacgggaaugggacccaagucuaaacauaaaauucauuuauguuucauauacaccuuuuauacacagucugaugauaauuuuagguaauauuuugaauaauuuuguaaaaugaaaugagguguggaauuuuccacugguggccucauguuggcacucaaauguuuuggauuuuggugcauuuucagacuuuggauuagggaugcucacccuuuacugauauuuuaagaugaagaaagucuccuucaaggaauuguucaaaaaacuuuuuuuuaauuuuaauuuuuuguuguuguuauuacauagauaagggcuuccuauguugcccaggcuggucuuaaagcccuggccucgucuccucaugcaccaggacaauaggccugagccaccguuccucccggcaaaaaaacuuuuaacauauagaguaaaaacaacuuccuuuuuauaguuaagccucugacuaaaaaggagguacagacgggguauaacuaguauucaaagaagaaucuuuaaauuuuuauuuuagaaucugaaaugauucucuucauguucugggacuuaaaaaauuaucccaccucauaagugcuucucucucucuuucccucacauugaaaauuucuaccucauuaauuaaacucuuuuuaacaaauuuuauaauuaaacucuuuagaccagaaagcaguaagguaaaaacauaaaugccuaauaccugaauguauaaauguagguaugaaauuaugcaguacaaauuagaaaauuuauauugcuuaaauuaucuugacacuuaucaaaaaaaauuuauucaagaaagcacugugguagucacuggggauucaaagacaaaaagauaaaucaaauuuggcagaagcaacacguuaauucacaccagucaaaaaauauuuuccuaagaaauguuauuuggcaguaagacuauacuauauacuauagacuacacuguuauuuuggcgauacgacuauacuauauacuauacgauuuauacaaugaagcuuauauucuaacaccuuuccacuggaaaauuuaaacgccaaauaaaaacuuauugguauucaaaagauuuggauacuggacagguacgguggcucacgccuguaauuccagcacuuugggaggcugaggugggcagauugcuugaggucaggaguuugagaccagccuggcuaaugggguuaaaccucgucucuacuaaaaaugcaaaaaaaauuagccaggcaugguggcaggcaucuguaaucccagcuacucaggaggcugaggcaggagaauugcuugaacccagaaggcagagguuacagugagccaagaucacaccacugcacuccagucugggugggugacagagugagacuccaucuuaaaaaaaaaaaaaaagauuuggauaccaauaaagccauucucaacauaguuaccaacauggcaaaaauuucagauauguagcuacagcuuauguaggaacaauacuaaguuugcuuuuuuaagaagauauuacaguaguucaagaaaacauuccauugcccuuugauuaguaagacaacaaccucaagcuaaacuuuauaccuaaguuuaaaugccaugggcugaccaguacaaagauauaaaauauauucucugcuguguucuguuauagauaggcuuuuuuuaaaaaaucaauuacuuaccgacuuuguucuuuccuuuguuuuauuaacugaaugaguuccuugucaaaauaaucuucuuccucuuccucuccuuuuccaucaucuucucuuuccugggcaucaacguuaucuuugugcaacuggccagaaaugugcuuugcauaugcagaaagacccacuucugugaccccgcacacucggcacucaugacuaaugucccuagggaaagagggagaugagggacauucaauucuccccacuggcauggcacacucaccagaucuguuauuguuuccucugaaggacacugcacacuuuggcacagugaaaaauuagugcuaauuaauuucaaugcuccuuucaucacuuuuaauaaguuuguuuauaaguuacuuuugaaaugauuuuaagauucuuuuccagcaaucaagaggcaauagacuucagauaaaugucguuuaggaggagaaaucuucuugaauugcuguacuuaaaaucuugucagaggaaacauggugaaaggggaggcagggcagggggcucagagcaagcagaaguugcucuggagcacacccauggugccagcugcacuc

SEQ ID NO: 191226 - RNA, 85943 nt, Homo sapiens
gaguucgcggccgguggcggcgguggcgacagcggcgaccuagggaucgaucuggagggacuuggggagcgugcagagaccucuagcucgagcgcgagggaccucccgccgggaugccugguacuguuuggagagaaaugggagugcagugggcucugaaggccuggauuucgggucugaagggauggcugaccggagggggcgggguggcaagcauggcggcggugacggggaagggguuggagggcccuaaggaggggguggggaaacguuagcuaagaaggcuugguggucgugaggaaagcugaaaggcuguggggccucuggcgaacagauuuuagaaaacauucuuuuggggggagguagaggcgccagaaggacguggcgggggggauggaaaaaggggcggggagagaagagguuaggaaggaggggaaagggugucuacgagaaggugaugaaaaauagggagggauagucaggcuuauuguaaauaacgaggaauggugacuugguaggcaugauaggaaagugcuugcagcaauuauaaauauaauauucuaauuggaggaguccugaaguggucccguuucccagcucuuguacuuccgccccauuauuuagguuuagacugcgugagcaaggcuaguagguuacacggaacugaucuuuuguuauuccauuccaggggagcagauggacccuacuggaagucaguuggauucagauuucucucagcaagauacuccuugccugauaauugaagauucucagccugaaagccagguucuagaggaugauucugguucucacuucaguaugcuaucucgacaccuuccuaaucuccagacgcacaaagaaaauccuguguuggugagugauaccuuguuugaagaagauugagcagauuuuuuuuuuuaaaccgaaaaccagcaaacauaaguauuuagaagaucauuaccuucucaauaaaguugauuggaaaaauuguucacaaauaguagguuucauuuugaacuauuucauauauaauggggauauuuuguauguguauuuucuaggauguuguguccaauccugaacaaacagcuggagaagaacgaggagacgguaauaguggguucaaugaacauuugaaagaaaacaagguugcaggugagguguuuaaagcuaucuguccccuuugcauuuuuugggugcucuuguuggugcuggguggauuuaaacuuuaugugguugugucgaauguauguaaggaagccuacugugguaucugcguaguagucacucaaaaguugaugugcuagugucacugauuagauugguauugucuguauuccugauuuuguauuaagguuuguugguaaaugucuuucaugcuaauauccaguuauuuuuuucagacccuguggauucuucuaacuuggacacaugugguuccaucagucaggucauugagcaguuaccucagccaaacaggacaagcagguauacaguguuugaagggguuuauuuaaauguauuaucagauuuguucuuuuaucuguaccuguugccucaucccaaggauaaaaggauuaaucucuuucuuguggauuaggaaaugggacuugaggguuguauuagauaguauuguaauaguacugauagcuggaaacuguuuugugaagguaauaauuuuuauaccuacauuauucaaaucaugaucugucuugugcaugugaaacaaaauaagcauuccuccuaguagaaaaaaauuauuaaaaaguauuuaggggccaggcaugguggcucaugccuguaaucccagcgcuuugagaggcugaggcggauggaucacuugaggucaggaguuugagaccagccuggccaacauggugaaaccccaucucuacuaaaaacagaaaaauuagcugggccugguggugcgugccuguaaucccagcuauucaggaggcugaggcaggagaguugcuugaaccugggaggcggagguugcagugagcugagauuguaccaguguacuuuaucuagccugagugacagagugagacuccgucucagcaaaaaaaaaaaaaaaauuuaggaguauuaucagaacuauuaggcauguuuuccaucuaucaacugaaguaccccaccaguuuuagaucuagaauguuuaauucuuacccuaaacaagauucaauuguuaccaugucuuuugcauaucuuuauaauacccauuuuuugaguucaugcucuguguuagguccuguauuggacguuuggcauauaguauaauguuauuuaauccuauucuuaaagcagcuguacgaugaagacauuacauuacuuccauuguauagacgggaaaauugauggacaaagaaauuagauaacuugcuuuagaguacauugcuaguaaguggcagagcuggcuuugaaccugguccuaaugacucuaaugccuccucuuucauucuaacuaaucagugcuucucagucuuccgccccaauauuucuaagguccaaggagaauguagagaacuucaggaguuuuggggugguagaaaggggaggugguuagagaggagaauguuagcuugagaugguuaaagacuauuguuuuuucuuaaaaagaaaugguuuuuggcugggcgcaguggcucacaccuguaaucccagcacuuuaggaggcucagacaagaggaucacuugagcccaggaguuugagaucagccugggcaaccuagugagacccugucucuacaaaagaaaaaaaaaaaggacugggugugguagcucacaccuguaaucccagcacuucgggaggcugaggugggcggaucaccugaggucaggaguuugauaccagucuggacaacguggugaaacccggucucuuaaaaauacaaaaauuaacgaggugugguagcggguaccuguaauaccagccacucaggaggcugcaucaggagaaucacuugaaccugggaagcagagguugcagugagccgaaauugugccacugcacucuagccugggugacagagcgagacucugucucaaaauaaaauaaaauaauaaaaaaaaaaauagcagggcauggugguccgugccuguagccccagcuauucaggagacugagauagaaggaucacuugagccuggaagauugaggcugcagucagccgugauugugccgcugcacuccagccugguugauagagugagacccugucucaaaaagaaaagcuuuuuuggagguguguuuuauuuuacacucugugucuguacguaauuuuuuuuuucucacaaaucaucaaguaaaauaaaugcuuuagaacaaccugcaaaccgaugggcucauuguggccugcagaaguguuuuauuuggccuacauaggugguaaaauguuaauauauuugaauuaauugacagaauuuuagaauggggaaauuucucauaaaacuuagacuuccagcuucuggcauuucuuguuucuguuggcaacaguuggcuggaguuaugaguagcagucagccucugcuuagauggagcauuagugcuaugauuugccauagucacuacaauucauuauuguacuuggacacugaggccagguguucuuuugucauuuaucauagugcuugugcuuuuguucuuacacccagcugcuucacucaucuauguuaucuugcuuugauuucugugggcauuuaaguuuaugguaccucuuuaagaacaugugccaggcuuaucuauguuuuuguggcucagcauccugguuugagccaguggggacaggaaguaugcacgucccucauugugaaugaagcaaugcuauuugagaaguuucaugcuacuucuuuucauguuaaauaaaugugcaggcacuguggcaugugcuuuaaaggggcuuuugccauuguggagcuuauaauuuaauaggagagacagauguuaaaugagucauuacaucaguagcuauuccauuacaacugugaucauugcaaagaggagaaaaaauauauauaacguaaucagaaggauaaggggacaccucuuuguggaauacaaucuaaacaauaaauaugaauuuguuaggcauaguugaagggcuuggagggcauaguugaagagcugcacauuucuaugugcaguaugaaaggaggagcuguccaaacagaaugaacugugugugcauaggccaugaagcuggaaagaauuuggaguugauuccaaaagaaugaaaucucuucaaaacacuuuuuuuuuugagacggagucccacucuuguuccccaggcuggagugcaauggugugaucuuggcucacugcaaccucugccucccagguucaagcgauucucuugccucagccuccugaguagcugggauuacagguguccaccaccacugcuggcuaauguuuguauuuuuaguagagaugggguuuccccauguuggccaggcuggucuuaaacucuugaccucaagugauccacuugccucagucucccaaagugcugggauuacaggugugaaccaccuugccuggccaaauccaccaaauuuauucacauuuccuguuuuacuucuuuuuauguguguguguaugcguguguguauuaaguuuuacauaguuuuaucaccugcguagguuugugucuucaccacaacagucaagauacaguucuaacacugcaaggauguuuauuguugcccuuuuauagccacaccuaccuccgucuuuugcacccaaaccccuggcagccauuaauccauucuucauguguaaaaugucauuucaaaauacuauauaaaaugggaucauacagucuguaaccuuuagugauuggcuuuuuuuuuuuuuugagacagggccucacucuguugcucaggcuggagugcaguggcaaggucaugguuagugcagccuccaccuccugggcucaagcaauccucccaucucagccucgcaaguagcugagacgacaggcacaugccaccacacccaacuaauuuuuuaacuuuuuguagagaugggguuuugcuguauuggccaggguggucuccaaugccugggcucaagcaauccuccugucucauccuccuagaaugcaggguuacaggcaugagccaccaugcccauccuugggauuggcuuuuucaaucagcauaacuucuggggcuccauccauguuuuugcauguaucaauaguucauuuuuauugcugaguagucuuccaugccguggauguaccacaguuuguuuaaccauucaucuguugaaggacaucugcauuuuuuuuucuuguuuuugacuacuauugagaagcuguuauaagcauuuaugaacagguuuuucuuuucuuuuuuuuuuuuuuugagauggagucuugcucugucgcccaggcuggaaugcaaucucagcucacugcaaccuccacuccaggguuuaagugauucuucagccucagcauccugaguagcugggacuacagccgugcaccaucacgccuggcuaauuuuuguauuuuuaguagaggcgggauuucaccauguugaucagacugguuuugaacuccugaccucaggugaucugccugccucagccucccaaagugcugagauuauaggugugagucacugugcccggccauauguacagguuuuucugugagcauaagucuucauuucucuaggauaaaugcccagauuugcaauugcugggucaugguaguugcauguuuguuuuuuuaagaaacugccaaacuuuucuagaguggccguacuguuuuauagucccaccagcaauguaugagugaucuaauuuuuuuucauccuuacuggcauuugguguuuucaguauuuuuuauuuuagccauuacaagucuguagugauaccucauuguuguuucaguuugcauuucccuaauggcuaaugauggugaggauuuuuucaugugcuuacuugcugccugucauuuucuucagggaaaugucuuuucauaucuuuuguccauuuucuaauuggauugucuuuuuacuauuguguuuugagaguucuuuauauauucuagauacuagucuuuuguagaauauguauuuugcaaauauuuucucccacucuauccuuucuuucucuucauaggguuuuucacggagcaauuuuuaauuuuggugagagcuguuaaauauuuuuaacagaauaauauaagucauuuacuuuaaaaagggcuuauaggccgggugcaguggcucaggccuauaauuucagcacuuugggaggccaaggcggguggaucacuugagcucaggaguuugagaccagccugggcaguauggugaaaucccgucuuuaccaaaaauacaaaaaaauuagcugggcaugguggcacacaucugugguuccagcuacucaggaggcugaggugggaggaucgcuuaagccugggaagcagagguugcagcgagccgugauugcaccgcugcacucuagccuggguggcagagugagacccugccucaaaaacaaauaaauaaauaauaguaaaaagggcuuauaaugaaaagcagagaguccuuccucacccuugcucccuuuucacaaaggcaacucucuuuaacuguuuaugguuuuacuucuuugggagguuaucuuccuaccucuaauacuauuguaaaacuauaaauguguuuuauauguaaaguaauacaauugaguucugauaaugaaagaugggguaacucagcaacacccucccaauuuuuguuuauuuguuuguuuuauuuugagaccgaguuucgcucuuguugcccaggcagagugcaauggcaugaucuuggcucacggcaaccuccgccuccuggguucaagcgauucuccugccucagccucccaaguagcugggauuacaggcaugugccaccaugcccggcuaauuuuguauuuuuaguggagauaggguuucuccauguucgucaggcuggucuugaacucccgaccucaggugauccaccccccucagccucccaaacugcugggauuacgggcgugaggcaccuccgcggcccucccaauuuuuuuuuuguuuguuuucacccucucaauuuuugaugguaauuauuuuaauucuucuggcuccguuuacacuucuaaauaauauauuuaaaccuuuguuuucucuuuccaucaacuuuagacaguggagaaaaguuuaacuaaaguacuguuuuuugucuguaaucugaauuauuucaugcuuuuucugauuugucuaaucauucuacaaauuuuuuugaguauuuucuuuuuucuuuuuugaaacggagucuugcuuuguugcccaggcuggagcgcaguggcaccaccaucuuggcucacugcaacuuccaccuccugaguucaagcgauccuugucccucagccuccugaguagcugggauuacaggcaagugccaccaugccuggcuaauuuuuguauuuuuaguagagacaggguuucaccuuguuggccaggcuggucuugaacuccugaccucaagugaucugcccaucucggccucccaaaguacuuucuuuuuuuuuuuuugagacggcgucucgcucuguugcccaggcuggagugcaguggcacgaucucggcucacugcaagcuccgccuccuggguucacgucauucuccugccucagccucccaaguagcugggacuacaggcaccugcuaccacgccuggcuaauuuuuuguauuuuuaguggagaugggguuucaccauguuagccaggauggucuugaucuccugaccucgugauccgcccgccucagccucccaaagugcugggauuacaggcaugcgccaccgugcccggccaaaguaccuucuauugaguauuuucugugugccagguguucuuggauuuuggggauacaaagugaucagaagaaauaaaaauccuagaccuuaauguagcuuacauucuuguguaggguauagcaauauaugauaaauaaguaaaauauguaguauguuagaugcugauaagggcugaagagauaaauauagcagggaaggggagaggaagcaacaaagugguugcaaguuuacauagggugucuagggagugcuucauugauaggacauuugauuaaaaaucuaagugaggccgaggcaggaggaucucuugagcccaggaguuugagagcagccuggacaacauagugagacccugucucuacaaaaaauacacaguaagccaggcaugguagugugcgccugugaucccagcuacaugggaggcugaggugggaggaucgcuugagccugggagguugagacugcagugagccaugauugcuucacugcacucuagcuuguguaacagagugagaccauaucuuaaaaaaaaaaaacaaaaaacaaguaaguguguauuugcuguuaucugggauaaguguaauccaugcauggagaauggcaaguucaaagacccugaggcaugagcgucccuggaauauuugagaaauagcagggagguuaguguggcuguaguggagugacuaagagaagugagagaagaggucagagaagucagaagggaaccagauuauguaaggcauugugaggaauuuggcucuuauuuuuagugagauaggaagacauuuaaggguuuugagcaggggaaggacaugaucugauuuagauuuuuaacagagucacucuggcugcuugauuaagaauagacugaaagcaggacaaggcuagaggcaggaagaccaacaaggaaacuauugacauaauuuagcaaaaggugauaguggcuggaccaggauugaagcagaugaagaauggugagauucugaguauuugaaaaggggauucaaagacagaucagauguggagugugagagacaagaaggaaguaauaauuauuccagguuuguuuugcuucaaguagcugggacuacagauguaugccaccgugccuggcagauuccaaguuuuugauuugagcaacuagaguaauggaaugacaguuaagauagagaagacugcaggaggggaaguucaguuuuaaacauaugaaacauugugcuaucuuuucaacaaccagcuggauguguugaggagguaauuggacaaggaggccuggagcucagagggaaaagucuaggccagagauuuaaauugcagacucauaagcagauagguaguauucuaaaccaugagucuggaugaggucauuaagugggugaauguagcuagaaaagagguccaaggacucacggagccuaccagcauuuagagaucagggacaugagguaaaaacaccaaaagaaacuaagaagagcucaaaguguguuguuuugugcugucguccuucauugcuucuuuucuaccauuugcaauauuugcucuugaacuuucuuucccucuguuucccaaagucauuuaucugguccuuccaguuauauagauaauguucuauuuugcuuuuguaaaaaucuuuacuuagucuucuuucacuugcuugggucacgguucccaacuuugcaaauuuauauuuucaccucuuuuguguuuauuacaguuacgcuuaaugcucuuuuuaugaaauauuaguuguguagaaaguugcaaggaagcaaagaugucaucuguaauccugccacccagaggcuaauugcuguaaacauuuuggcaucuuuucucucuuuuuuuguucauuugauuuauaugguugacaucauguggaaaguaaaaguguauguuugcugauguuuugcuuaaaaacaugaaaauuuuucucaugacaauuaaaacuuaacauauuccccaaguuuuuuauuuuaaaaguuuaagcccacagaagaaaugaaagaguauacauuuguucuguguguguguguguguguguguguguguguguguguguucuguacuuuuuuggggaggauuaauuguuuaaguugcagacaucagauuuuuccuuaauauaauguccccuuaaauacuucagcauucauccccuaagaauaaguacauuauucuauauaaucauaguaccguuaucacacuuaaaguaauaauuccauaauauuuaaguauacaguucagauuuucccaguugucucaaagaugucuuuugucuuguuuuauugauugguugguugauagcaucuaagauccaauucagguucacauuuuguauuugauuguuucacacuuuucuuuuuuuggagacagacucuuuuucuguugcccaggcuggagugcaguggggcagucucggcuuacugcaaccuccaccuccuggguucaagcgauucuccugcuucagccucccaaguagcugggacuacaggcacaugacaccacacugguuaaauuuuuuuuuuuuugagacggagucucgccaugucucccaggcuggagugcaguagcgugaucuuggcucacugcaaccuccgauucccagguucaagcaauucuccugccucagccuccccaguagcugggacuacaggugcgugccaccacgcccggcuaauuuuuuguauuuuuaguagagacaggguuucaccuuguucgccgggauggucucgaucuccugaccuugugauccgccuguuucggccucccaaagugcugggauuacaggcaugagccaccgcgcccagccuaauuuuuguauuuuuaguagagacgggguugcaccauguuggccgugcugguuuugaacuaaccuuaaaugauccgcccacuucggccucccgaagugcugggauuacagggauaagccccugcgccuggccuuguuucaaacauuuuuaacggugauauauguuauuaauagauugugaaauuauguaaucauuuccuuaaugcugaauuuauagguuguuucuuguuguuguuguuguuguuguuguuguuuuuugagguggagucucgcucugucgcccaggcuggagugcaguggcgcgaucucggcucacugcaagcucugccucccggguucacgccauucuacugccucagccuccugaguagcugggacuacaggcaccugccaccacgcccagcuaauuuuuuuguauuuuuuaguagagaugggguuucaccauguuagccaggauggucucgaucuccugaucucgugaugcgcccuccuuggccucccaaagugcugggauuacaggcgugagccaccgugccuggucgguguuaacuuauuuuaaaaauauauggaguuugcuugugcccaguaguucaaggcugcaguaagcugugaucgugcuacugcacuuuagccugggagacagacucugucucucucuuuuuuuuuuuuuuuugagacagagucucgcucugucaccaggcugcagugcaguggcgcgaucucggcucacugcaaccuccgccuccuggguucgagcaauuuuccugccucagccuccugaguagaugggacuacaggcgcaugccaccacacccagcuaauuuuuauauuuuuaguagagacgggguuucaccauguuagccaggauggucucgaucucuugaccucgugaccugccugccucugccucccaaagugcugggauuacaggugugagccacugugcccggcccagacucugucucuuaaaaaaaaaauaaguaaaaaauaaaaaguguguguguguguguguguguguguguguguauuuauauacauauauaagcuccuuaccugaauuuuguuuggacucugugguucuauauauguauuuuaagauuuuuuacuaaaauacuucugugaacuuuuaaaaaguuuuuugagcccuuucugugcucauccaaugcauaucuucucuugucacuugucaguaauucuccugaaugcaagauuuuucugccucuucucaaaaauauaaaauucgaguauguuggugccuuauuuuuucuuuacuuaauucuguguaggauguugaauuguuaaucuuuuaggugcuuuuuguagaaagaagcacuauaaaggugagguauuuuacuuuuucaaguuuggcuaagagaugguugguauguguugggggucagagugcucugauuaaagugucccaaacuaucugggaacacaugauuauauccuucugcuguguaguguucugggaaugucaguggaaucugcuccugcuguggaggaagagaagggagaagaguuggaacagaaggagaaagagaaggaagaagauacuucaggcaauacuacacauucccuuggugcugaagguagccuugugcuuuuuucagaauaauagacuguucuaacuucccuuuaacaugauugugcagaugucuaaauuucuccucuuuauuagguugcagauuucucauaauuaaauugagagucauuaagaaauuugcuaguaauuuaaaauguuccaccugauuugguauucaggaauuuguaguucauugguuagccccuuucugcauauugaguuuucuuccucuuguauucauuuguuuuucaaauauuuuuguaauguguacuuugugggguguaaguacagucugaauugcugugacuguggguguaguuuaugauguaccuuuagaaagcagacguagucuccuuauaagauuuuauaguaugaaguauuuuuacuuuauuacacauuuucccccuucaucuuuaaugcacuuauuuuuuuuaaauuuauuuuuuauuuuuuugcgacggagucuugcucuguugcccagguuagagugcaguggcgcaaucuuggcucacugcaagcuccgccuccuggguucaagccauucuugugcuucagccucccgaguagccaggauuacaugugugcgccaccacaccuggcuaauuuuuguauuuuuaguagagaugggguuucaccauguuggccaggcuggucuugaccgccugaccucaagugauucaccuaccuuggccucccaaaugccgggauuauaggugugagccaccgugcucggccacauuuauuuuuuauuuuugaaaaauuuggggggugcacagggcuuugaugugaaggacuuaacgggacccuccuuugcugaggacagcagcuuguacauugcauaauguugugggaugauaccuaauuucuuggcauuuuguuccuagauacugccucaucacaguuggguuuugggguucuggaacucucccagagccaggauguugaggaaaauacugugccauaugaaguggacaaagagcagcuacaaucaguaaccaccaacucugguuauaccaggcugucugauguggaugcuaauacugguaugaaacauguuuucuggcauuuggaguuguuguguuuucucccauauuagagguaguuauuuuuucuuugauaaguuuugcagcuauccaaauuaauauaaucuaaguaauuuaguaagguugaagaguuuucugguaaauacuugucaauuguugguuugugggcugagguuuuaaguuauugguuacuuuccuuuauagacugaugccuguauauauuuuaaauuggacuucuguuaaaaucuuugcuuuuuaaaaaacaucugggacuguaucuaguauuuugaaaacuuaauuaucuccuuccugucauuuuauaaaacucucagcaauuaagcaugaagaacaguccaacgaagauauccccauagcagaacaguccagcaaggacaucccugugacagcacagcccaguaaggauguacauguuguaaaagagcaaaauccaccaccugcaagguaagccgaacuuucuaaaaaggauuuacgaguuuugcuguaggguuauacuaaugucauuuuaccagaugaaaacauuuuuagaaauuguugauuuuuaaauuauuuuccccuuguacugggcauacuugugguccauuggaaacguugauuauuuaugaagucucaagaauuguuuuuugucugucugucugucugucuguuugaaacaaagucucacuauguugcccugggcucaugugauucucugccccagccucccaaguacuggggccacacuugacuacuaaucuuaucuuuaggcauucuacaaagaccuuuuuuuguugauuaaaaaaauuuuuuuguuguagaaauggagucucgcuauguugcucaagcuggucucgaacuccugggcucaaguaauccuccugccucagcuucccaaagugcugggauuauaggcgugagccacucugccuagccugcaaugauguuuuaaggcugcucuaacuauaagcaugacuccguaaucuuugguugccacuccuccuuugugaucuuugucuacagagacacugcuugucugugggaggucuucuuagccucucugguguuaugaagaguaacaugacuauuuuauuugaaagccuacuguuucuauacuugaggagcacccagauugcuuuggguucuuagguauccugcaucugguauuuuaugguaucgauagauguagggauuuucucagguucuuuaggcucuuaacuugguaggaauuggggaaugugccucugcuucaucucucgugauuuuuauaaccaaagcuucauuaccucuggccaguaagugaaguuugaauauggcagaagaaaacugggaugcuuccaguuugggauaggggauaaauaaacaguauuguuuuguuauuuccuucaauggaaagaguggggagagaguguccuaagcaaaguugaauaucaagagaaauugucuuucuaauguaaaacacucagcauaacagugacuuuuuaggcuuuucuuuuagaugcugccuuccaucuaguuaugcuauucuguuuacccuggggagugguagaacaggugaaccucauaagucucuggaaaggggccagggaugaaugucuuauacauguuaguauugaucugaaggagaauugguuugggguuuggguacaucaaauggaaaaggucagcagaagauguguguggcacuaguaaggaggauaauugacaucaaaugcuuuccauggaaugucaugguuuggacuguucuccuuacuggcaucauuggggucuggaucagaauucuuuauacaggucuagauaacauuauauguaacaaaaauuccccaaguuacucaucagaaaucuuagaaagcaugaagcacaguauugagcagaguugaagacagguauuggcugugagagagagugagacagguuuuaaaaugggcugaggacuuuuaucacuauaaagaguaguuuauuuccuuuuuaauauauaauuauguaaauuagagccacuggaauuuuugaaauuauuaaagaaaaacacacaaaacaggaaaagcuuuuuauuuaaaaacauuugaacuuaggaacuuuuucuccuggugauaugaauuuccuaggucagaggacaugccuuuuagccccaaagcaucuguugcugcuauggaagcaaaagaacaguugucugcacaagaacuuauggaaaguggacugcagauucagaagucaccagagccugagguuuugucaacucaggaagacuuguuugaccagagcaauaaaacagguaccaagagugauuugucguuacagcucuucuccaaagaucuaaacuuuuacuuuaguucugaggcuacugguuaaguuacaaagcauuuuauagguuugcagacuuguuugugauauggaaggaaaacguguuucuaguaauuagugagaagggcuuuuugggaauaauuuccauuuaauauuuugacauaauuuucucucuuuuggaaaugagauggugaagaauagcuaauacaguaaauuuaguauuauggauacuagccauuuucuuuuuuucuuuuuuuuuuuuuugagauggagucucacucugucacccaggcuggagugcaguggcgcaaucucggcucacugcaagcuccgccucccgggaucaugccauucuccugccucagccucccuaguagcugggacuacaggcacccgccaccaugcuuggcuaauuuuuuguauuuuuaguagagaugggguuucacuguguuagccaugauggucuugaucuccugaccuugugauccgccugccuuggccucccacagugcugggcuuacaggcaugagucaccacaccuggcugccauuuucuguuacauggcuacuaugucuucaaaucuucaauaugauauuaagccuagguuuuucauauucaucuggguaacaguuuacuaacuuaaucuguuuauuaguuaaucugacacagauaggaauuuaaaaucuagcggaaaggacauaaaacuuaaaaggauauaauuuguuucacaccucuuuaaccuccaccaaucuuucauuccacagccucagagagcuagaaagcuugaguuaauuaccagcaaaacauauuauguugguuguaaggcgggaagggaagaaggcuaucuuccuuugcuaugcugugauacagguugcugugcaagacauucagagggucaccgaggaaccuuuguuggucucuuacuaaaguuguaagguuuuauuuaagaaauucuuuuacacugggauuaauauaguugauacuccaucuauugcuaaggggaagggaccaacaagagacucuucauaguauaaaacaguaauggcugcucauaaauccuuuuacuccuuugagcaggcccaaaucuugaaaacugcugcauuuauaacaucaagugucaugugcauuuuuuugacuucucccaucuguaucauggcaugagcuugacuucaccuaagguagacguuggaauaaaaggcucauuugcuguuuuuuaauagaagcaucacaagaaagaagagcagcuaagcagaaguauaaggauucuggcuuuuauuuuauuuauuuauuuauuuuuuugagacggagucucccucuguugcccaggcuggagugcaguggugcaaucucagcucacugcaaccucugccuagcagguucaagugaugcuccugccuuagccuuccaaguagcugggauuacaggcgcauaccaccacgcccagcuaauuuuuguauuuuuaguagagaugagguuucaccauguuggucuggcuagucuugaacuccugaccucagaugauccacccgccucagccucccaaagugcuaggauuacaggugugagccacugcgcccauccaggauucuggcuuuuaaucuccaagcuuagaucaugacagaaaggacuaaggaacucuucaucaguucuuuauucaagaagcccauugcgggggugguuaauguucacucaagauuugugcuauuguaguaguccauucguuguacuauaauuagaaaacaauuucugcccuuuuggaaauauggaaauauguuggaaauauggauauuacucuuugcaguacugaaugguuuuuggcagcucaguagugucaaucugagaagugcaacuggaauuucuuuuuuucaguaucuucugaugguugcucuacuccuucaagggaggaagguggguguucuuuggcuuccacuccugccaccacucugcaucuccugcagcucucuggucagaggucccuuguucaggacagucuuuccacguaaguaagccuaaaauagcuuaugccaaggcaguaugugccugagagucuuaggcuaaggcugaaagaggcuaaacuuaucugcuagucuagaauucuuuuugaaaccaaaugguagaaccuaugcauuagagcuuuggggaugaagaacuguugaaggcagauaaaucuguugucccauuugaaaauuuuauaauaguagcccaaacguuucacuaagaaagaaaaggcgcaguuauuuagaaaauguuacacauccaaaacaagcauucugcuccucuguuuuacuugcaauucuucucauuuaauagcagaggguggagaauagguuguuaaguugacaguaguuggauuucuuuauguuagggcaaagagguucgcuuguugguuuuuuuuguuuaguuuuaguuuucugaugaaaauguucauggucugacuauuauuaggcaaaaaaauggaauaauuuuuuuuaugucucaaaucugcaaaugaauuuauuuccuagcacugcucauuuugcuuuuaaaucaugauguccuugugucugaucauucacuuugcccuuacucucuuuuugaaaaaguucuuauuuuacaacagaaaugucuggugugggaaauaguuauugaaguauuuuugguucuuccaccagccucagguugcuguuggggaaaagugcugauaaguauuuaucugaaugccuuagauauuuuuuccuguuaaaaaguaaaagcaaauacagaaaugcaaaacuguggcuaugguaaaauaaccugugauucucucuuuauauaaaggaauucuucagaucuuguugcuccuucuccugaugcuuuccgaucuacuccuuuuaucguuccuagcagucccacagagcaagaagggagacaaggugagcucucuugaucugucuguugaucucagauuagaagaggagcaacacuuuuucugccuugcaaaauguacuacuucuuuguacuuuagaaugcuugugaccuacacaauucgguaggacucauguuugucuaaccuuuagggaugugaccuacuguaaagugcuguccucaguucuuugcuuuuccuuccuuccuuuuuuuuuuuuuuuuuuugucuaaccccauugagaggugacagcgugcuggcaguccucacagcccucgcucgcucucggcgccuccucugccugggcucccacuuuggcggcacuugaggagcccuucagcccaccgcugcacugugggauccccuuucugggcuggccaaggcuggagcccgcucccucagcuugcagggaggcgugcagggagaggugcgagcagcaaccggggcugugcgcggcgcuugcgggccagcuggaguuccuggugggugugggcuuggcggguccugcacucggagcagccggccggcccugccggccccccgggcaaugaggggcuuagcacccgggccagcggcuauggaggguguacugggucccccagcagugcuagcccaccggcgcugcgcuugauuucucgccgggccuuacuuagcugccuuccaguggggcaggacucgggaccugcagcccgccaugccugagccuuccacccccuccgugggcuccuguguggcugagccucccugaugagcacugcccccugcuccacggcaccuagucccaucgaccacccaaagggcugaggagugcaggagcacggcacaggacugguaggcagcuccaccugcagcccccgugcgagauccacugggugaagccagcugggcugcugagucuggugaggacguggagaaccuuuaugucuagcucagggauuguaaauacaccaaucggcacucuguaucuagcucaggguuuguaaacacaccagucagcacccugugucuagcucugaguuugugaaugcaccaauccacacucuguaucuggcugcucuggugggacguggagaaccuuuaugucuagcucagggauuguaaauacaccaaucggcacucuguuucuagcucaagguuuguaaacacaccaaucagcacccugugucuagcucaggguuugugaauguaccaauggacacucuguaucuagcuacucugguggggccuuggagaaccuuuguguggacacucuguaucuagcuaaucugguggggacguggagaaccuuugugucuagcucagggauuguaaaugcaccaaucagcccccugucagcacagaccacuggcucuaccaaucagcaggauguggguggggcuagauaagagaauaaaagcaggcugcccgagccagcaguggcaacccgcucggguccccuuccacaguguggaagcuuuguucuuucacucuuugcaauaaaucuugcuacugcucacucuuuggguccacgcugcuuuuaugagcuguaacacucacugcgaggucuguagcuucacuccuaaagccagcgagaccacgagcccacugggaggaacgaacaacucuagacgcgcugccuuaagagcuguaauacucaccgcgaaggucugcagcuucacuccugaaccagcgagaccacgaacccaccagaaggaagaaacuccgaacacaucugaacaucagaagggacagacucgagacgcgccaccuuaagagcuguaacucucaccgugaggguccgcggcuucauucuugacgucagugagaccaagaacccaccaauucuggacacaccaucccccauucuuugcuuuucuagcacuaauucuauugagauuucuguauuggcucaauuuuuaaaaaggcucugaaggaaaaauuuuuguuuuuaaaguugaacugaaaugaauuaguauggggaagaacuggacuuauuaauaauggccuacuuguuucuagcaacacgugaacacauuucuggugagaaggaaccagcaauuguuucuugugguccuuauagguuauuuuugcuauuaaaauaguuuuagcauaagaaugguuaagaguaggugguaaaaauuuuaacuucauucauuuacuccuuugacgacuuagagauuuuauauuacuuuauucacaagaaagcuuuccuuuucacuuaccuaauuuaucucauuauuuaagcuucuuuugcucugaccuagucuccuauccagucauucaagauguuucuaaguucuuacgauuucuacaaagcuuuuucuaauaaauucuaugauuuucaucuuuucacucuuucauauacaaguaaugguauaauaguuuuauuuauugagcacuuaguauaggcaaggcauuguucuaagggcauuucugugguuuuucucauugaauccucacaaacauccuaagaaggagguguuauuuuuauccccauuuuacagaugaggaaauggaggcauagagagauuuuucaacuaaugagauguagaagcagaauuugaacucaggcagcugccuccagagccugugccuucaucugucauguauaugccuccuauuauauccuuucucugcucuugaguaacauaaaacauagacauuuaacaguuuuucaaauguaauuuaucagugauagaauuugaucuuaggcuuucuucugcuacaaaguuugucucuggcuguuucucuuaaaaucaguuguagguauccaaauugacuaauaucaaucuaagcauaacaugauuagugacugauaucaaucuaaguauaacaugauuaggugaauuaauucuacaaaaacccagguaauacaagugaaguuugguuaauucuuaaaacaguuucuuuuaucuuuuaucuguagugugaacauugaaaaaauauaaaaauaauuauauuaaauauacuuucucaggcugggcacggugucucacaccuguaaucccaauacuuugggaggccaaggugggcagaucaccugaggucaggaguuugagaccagccuggccaccauggugaaaccccaucucuacuaaaaauauaaaaaauuaacugggugugguggcgggugccuguaaucccagcuacucaggaggcugaggcaggagaaucacuugaaccugggaggcggagguugcagugagccaagguggcaccacugcgucgcagccuggacaacagagcgagacccugucucaaaaaaaaaaaagcuuucucccugauuguaaacagucaauauuuauuguagaaaguuuguuaaguauauaggaaauuaaugaaaauaaaaaucaccugugauacuacacuccagauauagcuacaacuaguauauuuggauauauuucaguuuucaaugcauaaaguaguuuuacauaauuggcauguuguguauaugacucaguuuuuuuuuuuuauguaacaguguauuuucccuugucaguuauauuuuagauuuaaugcauuugcuuaauauguauguacaucaguguuugugaaacuauaugugcuuuuuguauuuauuuguuuuuuugcuuuucucuuaaccuaaagccuuuuuuguauguagugccuauaacagcagguuuuuaaugugcuuugucauggcaagaaaguucaaaaggugcaacaaaaauacuuagcacagcuaugguaguauauuaaaggccuguagcacuggaucccaaauuagguguagacugguaagguugagacuaagcuaagcagcaaagcuggguauugagguugcaguuuggguagcugguagcaugaaugugaauuauggggaaaagguaaauguuguuaguaguuugugaguggucuagaggaagccugguuggggucaaguuguaagauaggggauacaaaugaugaaucaaauacuuagcuagcugggcugacuccaagcaaguuccugauagccuacagguggguaguauacuaugggaaagcaguguuuuguguuuuguguguguguguucccuccuaaugugugucaggauuagugucuucucuuucuuaguucuuugauaaaucagugcugauuggcauugauagauuuuuuuucuucaucuguauuuguacaggcauccaucucucugcaguuagcaauuguuaaugcaaauauaaucaguucguaaauaugaauuauagauacuguauuuaccuaaaguggugacaaauucacugucuuucaaggccugugguagaauauaugaugguuaaauuagguaccaguaguuugggcuuuucuacaggaaaugugaaaaacugagcuauaaaaucaggaaaggagccaaguuaauuuaacauuuuuuaugaauggguggguagccccagaugcauccaguuuugaucuauaccuaaaaauaggagcuuggacugcuccgccaaccaaaggaaguauugguagauugcuaggacccagucuacuauuauucugucagcuuuucugaaaaauuacgucacuauuuuuuuagagugaaaaugucuguaguguaauuguucuuagugguuuuggaacaugaguaauauugaugagugauauuucucaauuuguuucuccuguuuuaaaccagauaagccaauggacacgucaguguuaucugaagaaggaggagagccuuuucagaagaaacuucaaaguggugaaccaguggaguuagaaaaccccccucuccugccugaguccacuguaucaccacaagccucaacaccaauaucucagagcacaccagucuucccuccugggucacuuccuaucccaucccagccucaguuuucucaugugaguauuguaaaaagaguuguuucuccuaacauauuuuuuuaaagcagcauuauugggguauaauuuacauaccauaaaauucacacguuuuaaauguauaauuuugugauauuuuaguaaauuuacagaguugugaagcugucgucacaaagcaguuuuagaacaguuccaaagucaccuaacaucuugauuuuuuuuuauguuuaaacuuuuuacaaugucuuuaaacuuuuugaaaauguuacugcaaaauugcgaagugacauaaaucauuauucuacuuuaacacaacuguuacuguaauuuuugucuuucuacaugcuuaugguuuuuuuuaauaaauuuuuuugccuaugacacagccucaggagguccugacgauaugugcccccacaugcuuauguuuuuuaaaaaagguguuuauauagcacaacuuuaauuuucuuuuuccaguuaauguugugucguaauaauucucaguguuauauugucuucacuuauccuuucaaaagucauguauuauuucucuaaguagaugugaucucaguacaggaucauccuauacuuaggguaucaagaugguuuuuaguuuuccaauguguauuuucuucuaaaagcgagggaaaacuauuaauuuguauaauuuuaaauuuaaauauuuaaagaaaugaaauucagguuucauacugaguugaaaauccuuaaaucuaaaugacuauuauauauucaaucuaaauaccuauucuuauaagaccuuaagugggggaauuauuguaguuuuauugggacaacuuauuuuaccccuuucaguuugcagguguuauaacaagaguuuguauuuaaaaguaaaauuugaaaaugaauaguaaugaacuguaaauuuagugaggaggggacaguaggaagaaauugauuuguuuucuggaguuuuaaaacuuguuuuguuaaaggauuucauuuuaugcaguucauuagaauuugguagcguuauuaaaaaugaggacucuagagucagaacuuccuggacucgcuccuggcucugucauuacuaccuuugugaccaauugaaauugaaucuuaguuugcucaucagucaaaugauggggauauugauacugucuaccucguaggauguuuaugaaagguugaguuaauauauauaaaaugcuuagacuagugccuugcacuugguacugcauauaaggguagcuguuguuggcagugaaaggguuaaaaacaagguuaccuagaggugaaauggauguucgaaccauacaucauuuucuuuagcuuuuuuuuuuuuuuuuugagacaggaucuuggucuguugcccaggcuggagugcaguggugcgaccauggcucacugcagccuugacuucccagucucaagugauccucccaccucagcaucccaaguagcuggaacuacaggcacauggcaccaugcccaacuaauuucuuaauuuuucuuauagagacgggguaucacuauguugccagggcuguucuuaaacucuugggcucaagcaauccuccucucucagccucccaguguguugagauuacaggugugggccaccguaccuggccuucuuuagcuuuuauuuuucuaaguuauaugugaacauagcugggcaugguggggcaugccuguaaucucagcugcucaggagauugaggugggaggagcauuugaaccuaggaguuugagaacagcuugggcaaaauagcaagacccugucucaaaaaaaaaaaaaguuauaaaucugaccaggugugguggcucaugccuguaaucccagcacuuugggaggccgaggcaggcggaucacuugagaccaggaguucaagaccagcauggccagcacagugaaacccagucucuaccaaaaaauacaaaaauuagccaggcaugcuggcacgcaccuguagucccagcuauuuggaaggcugaggcaggagaaucgcuugaaccuaggaggcagagguuacagugagcugagaucgcgccacugcacugcagccugggcaacagugaggcccugucuuaaaaaaaaaaaaaaagaguuuaagaaugagcuauaaacacugacacagagcacugagaagauucuuccaacacugauuuaaagaaaaugguuacagauguuuaucagugaccaaacgagacuuuuauggucuuuggaaagguauuccugcugguuggggggguggagaugaugccuggccacaaagggagaauggacguuuugaaaaacaaggcacuguugaaggaauugcucuauuuucaacauuuaccaaagaccuucagaauuagcuaaaaaaucagcaaugaaaauuugagacaaaugagugauucugaacauaguucagagauucuuggaaccuaagaugacucuaaucagguuucuuugaacucauauuuuauaagaugccuuagccagugcaguccaugccuccugaaaagucucucaagaauaccuuuaguaggccgggcgcaguagcccacaccuauaauugcagcacuuugggaggccgaggugggaggaucacgugagcccaggaguuugagaacagccugggcaacauagcgagaccccauuucuacaaauggucaaaaauagccaggagugguggugugugccuguagucccagcugcucaggaggcugaggcaggagaauugccuggagaauugcuugaaucugggaaguugaggcugcagugagccaugaucaugccacagcacucagcuugagcaacagagugagaccuugucucaaaaaaaaaaaagaauaccuuuacaacauagcuuuuaaguuaaagauuugauuuuacuuaauaagcauguguaaaaccccaaaaauaagucagauaguuaaaacaaggccucuuccucuuccuacccaaagauaaccacuuuucguucuuuaugcuuuuucuuuugguauuuaccuccauaauucuacauagcaugauuauauuuucuuuuucuuaggcacagggucuugaccuguugcucaggcuggaaugcaguggagcaaucauagcucacuguaaccucgaacuucuguacucaggccauccucccaccucggccuccugaguagcuaggacuaguggcacacacuaucacaccuggcuaauuaaaaauuuuuuuguagagaugggaccucacuauguugcccaggcuggucuugaacuacugggcucaagcagaccuccugccuuggccucccaaaaugcugggauuacauacagaugugagcuaccgugcccagccuauuuucauaaaaaaauuuuagccauuuuccaaguauaguuacaucguaauuuuguuuagauuauuacugaguuuacauuauaacuauguaaacaauucacagcagagccuaugacauauuauuaauaguuuuucauguuucuuuucucugaaauuguaauugucuuuuuuuauuuguuuaguuuucuuugacucucauuaaaucaacccuagauucuccaccaauugucagaaacuccuuucaggauguugaggagccuuagacuuucuguuucaucuuuuuggagaaaccucuuuuggacccuccugauuucuaaucuguacuguugcccucuaugccuggugcauaacuguuaaccuccguucacugucauccguggagauucuccuuaccugucuguguuggauaccucuuggguuucauaucuucuugcuugguuuacucccucauuuuggugggggacauuguuuaguagccuuuauucugcuaucacacuugauuuguaguuugcaggaguauagaauucuagauuggaaauaauuuuccuuuaaagauuuugaaggcauugcucuuuugucuuccaacuuccagugcugcuguuaagugugagggucaggucagccaugguggcucaugccuguaaucuuagcacuuugggaggcuaaggugggaggaucacuugaagccaggaguuugagaccagccugggcaacauggccagacccugucuguaccaaaacaaaacaaaacaacaacaacaacaacaacaaaaaacaaaacagugugaaggcagucugaucuugacuuuuaauaggugaucugguuuuucuuuacuggaauccuguaggauuuucucuucguucccaguguucugaaauuuccagaccuuugggauacgucuauuuucauucauuguauuggguacuuggcaggcccucucaauuuagaaacucagguccuucaguucaaagaaauuuauuucuuuaauuucuuccccuuuguuuucucuguucuucuucuuuuuuuaauggacuaucuguuguuuggauguugaaacuccuagaauagucuucuaauuuuauuuugccuccuacuuuugaucaucucugucucuuuuaguucaacuugcugggugauuucuucaaucauuaaaaaaacaguggcuauauugagauguaauucacauaccauucaguuuacccauuuaaagugcacaauccagugguuuuuaguauauucauagaguugugcaaccaucaccaugaucuaauuucagaauaguuucaucaccuccucaaaacccaugcccuuuagcacucacucaacauuucuucuacccucggcccuucgaggguagucuacuuucugucucuauagauuuguagacaccagucuacaaauggaaaguagacaccagucuacuuucugucucuauagauuugccuauucuggacauuucauauaaauggaauuauaaaauauauagccuuugugaauggcuucuuucauuuagcauaauguuuucaggauucaccuguguuguagcauguaucagauuuucauuccuuuuuuuguauugaucuauccuugucuauaaaaaauauaaaggaaaaaagaauuucauuccuuuuuuauuuauuuauuuauuuauuuuucuuuuugagauggaguuucguacuuguugcccaugcuggagugcaauggcaugaucuuggcucacugcaaccuucgccucccagguucaagcgauucuccugccuuagccuccugaguagcugggauuacaggcaugcaccaccaugccuggcaaauuuuguauuuuuuuuuuaguagagacgggguuucuccauguuggucaggcuggucuugaacucccgaccucaggugauccgccugucucggccucccaaagugcugggauuacaggcaugagccaccacgccuggccuucauuccuuuuuauugcugaauaauacaauuguguggauauaccacaguuacucauggauucgucaguugauggacguuuggguuguuuccccuuuuggcuauugugaauaaugcugcuauguacauuuauggacaaguuugugugugaacaugguuuuauuucucuuauguauaccuacaggugccauugcccaguucaaccaucuuuuaauucuucucuuaguuauuaauuucuacucuuggguuuuuaauuucuaaauucuuuuuucagaauauauuuuuaaauaccauuucucuuguuuuauugauauacuaucuuaucucuguaacaguauuaauaacaguuuucuucugucuggaauaguccuauuucuuccagguggacuuuaguuuuguuuguuuugaucucuuucaaauuagaggcuuuccucagaugucugguaaucuuugauuauuugcugauguucaagagugaaauaucagacagaugauuaguaguucugagugggugguugggucuuauuguuuuugggauuugcuguaaugugauccgcugagacauuuuauugggagucccauaaugucaguaucuugauucaucuuggccuggucagaucccuuaggaaaaugucugaucuccuauuugcaggguauuggccuggcuguacuagaggucuauuaauggaagcgggcuuugggugggaagggggguugggaggcaggugcagguuucauucaauauguagauuuucauuuaaucuccguauuuucaguauuguacuuccugauaacugugccucuugucugccaguccugggacacucuguuuuacucucuccagggcagaggaggggcagggugagauuauggguguuggaacugugguguaacucuggugguuuguuggcuuucuccacugcuggcuuaggaauucagcuuucacucuucugcuaaauagauuaccuuuuccagauuuuuuuugcaguucucuuuucuucuguucucuuuuucuugaaguuuugugcuuaagaaaaaucccuuuaccauuacuuaaugggauuucagaaaacucugaauauguguauauuuaguucuccauuucuauuaaguucccuacuuuuuucauuauaugucaaacuuauucuuguuauucuuaauggguaacccuuguucaucuguuauuucuuuuguaccuugguuacuggaguccaagucaaccuaauuuugauguuguaagauuuaaauauguguaaagagauuaguacuauucaagagaaaauugggauaaagguaauuuugucuauuuuuuucuuucuuuccuaauaaacuugucaauugcauagccucuuugacccuuuaccaagauaugagggauggggagaggauuaguagaacacaguuugauaguuaacauuuucucauucuugauauauguauuaauuuuggugaggacaaauuagacaauuaaauguuuucaaacuagaauagugguggugguggcauaacauuguaaaugcaccaaaugccauugaauuauuuuauuuuuguuuuuguguuuuuuuugagauggagucucacucugucgcccaggcuggagugcaguggcaugaucucagcucacugcaaccuccuccuccugaguucaagugauucuccugccucagcaccccaaguaacugggacaaaaagugcacaccaccaugcccagcuaauguuuguauuuuuaguagagaugggguuucaccauguuggccaggcuguucucaaacuucugaccuuaagugaucugccugccuuggccucccaaagugcuggaauuacaggcaugagccaccacgccuggccugaauuguuuaguuuaaaauggguuaauuuuauauugugaguuucauuuaaaaaaagguauuuauagcuuuacguuagugauguuuuaucuaugagacuuuguaaaaugacuuauuuuuugcaacaagggaaaaaauacauaugucuugcagaagauguggucaugcuugguggcuuacaccuguaauaccagugcuuugggaggccaaggugggaggauagcuugagcuaggagugugacagcagccugggcaacauagugaggcccccgucucuacccaccaaaagaaaaaaaaaauuagccggauguggugacgugugccuguagucccagcuccuggugcuggggagcaguaugagcggggaagauugcuugaguucagguguuugaagcugcagugaacuaugauugugccacugcccucuggccugggugacaaagcaagaccccaucuugaagaaaagaaaaaagagaagauaagaucauuaguuauucuaccucagaaauaacaacucuuagcuuuuuuuuuuuuuuuuuuuuuuuuuuuuuuuuuuuuugagaugaagucucgcucuccacgugucuggcaaauuuuuguguuuuuaguagagaugggguuucaccuuguuggucaggcuggucucgaacuccugaccucaggugauccaccugccucagccucccaaugugcugggauuacagguguaagccaucacaccuggcccucuuagcuuuuuuugauauauguuuauuaacuaaaauuacaugaagauuauauauuauaaaauguguaaaaagaguagaauggccagguucuguggcucacgcuuguaaucccagcuuugggaggccgaggcagaccaaucacuugaggucaggaguuugagaccggccuggccaacacggugaaaccccaucucuacuaaaaaguacaaaaauuagccgggugugguggcgggcaccuguaaucccaguuacucuggaggcugaggcaggaaaaucacuugaaccugggagguggagguugcagugagcggagauggugccacugcacuucagccugggugacagaacaagacugugucucaaaaaaaaaaaaauauaauguauauccacauaauuuuuuacuaaaauagaaacuucuuucuauagcccaaauguuuuuugaucuuuuaguauucuucuacuguauacuuuuauguagaccacaaaacauucuaucaugugauagaucacaauuuaaaaauuauuaucuuggccggacgagguagcucaugcccguaaucccagcacucugggaguucgaggugggcagauugcuugaaccuaggaguucaggaucagccugggcaacauggcaaaaucucgucucuacaaaaaauacuaaaaaauuaggugugguggugugugccuguauucccagcuacucgggaggcugagguaagagaaucacuugagccuaggaggucaagacugcagugagccaugaucgcauuacugcacuccagccugggcaacagagcaagaccugucucaaaaaaaaaauaaaauaaaauuccuauuuguaaccauuuaagguauuucauauuguuuccuauucuaaauaauaauauagcagugaaccauuuuguagcuaaguauuagugugcuuucauugauuaauuucccagaaauggaauuauuggauuaugggguauagaauuucagggcuguuguguuuugcuaaauugccauuuagaaauguugaaccuuuuuuuuuuuuuuccuuuugaggcagggucuuacucuguuguacaggcuggagugcaguggcacaaucacacugcucacugcagccuuaaccauccaggcucccaaguagcugugaccacagacgugugccaccacacucagcuaauguuuuuuuuuuuuuugguagagacagggucucacuuuguugcgcaggcuuaucucaaacuccugggcucaaguaauccuucugccucggccuuccaaaguguugggauuauaaguuagagccacugcaucuggcuugaaccaguuuauacucagucaugucugagaguauaugaacagauucaaacuuaggaucauuguuacaaucugauaggauaaacaauaauaccagacauugaaauaucagaaguuauggaauauacagaaugcuuuacuacccauuugauuccucauucccuuaaaaaucauaggaaaaaaagccugagcgugguggcucaugccuguaauccuagcaguuugggaggcuaagcugggcagauugcucaagcccaggauuuugaaacaagccugggcaacaaaaugagacccucucuacaaaaaauacaaaaauuaccuggcucugguggugcgcaccuguaguuccagcuacucgggagacugaggugggaggaucaguugaguccaagacauuaaggcugcaaugagccgugauuaagccacugcacuccagccuggcuggcagagcgagaccuugucucaaaacaaaacaaaacaaaacaaaacauaggaaaugaaugccuaaccaucuauguugggaguuuuacaucauuuacauuaggcaaaauaacacacuaaauguaaaaucucuuauaaaaacagcuaaguuuuguauuaauuucucuuuuuaaaaauauugaaguauugguuacauaaaauaaaauuauuuuacguguauguuuugaugaauuuuggcaaauguauacagcuguguaaccaucaccaccaucaaaguagagagcaguucccucacccuaaaaaguuuccuuauaaccuuuugugguugaucucccugcugcccaguauacucccuucucccgcccuaggcaaucacacaucagcuuucugucaguauaguuuugguauuucaguaguuucaagucugggcaauauagcaggaucccauuucuaaaagacauuuuaaaaauuaccuggguguuguggcgcccaccuguauucccagcuacuugggaggcugaggugagagauugcuugagcccaggaaauugaggcugcagugagcugugaucucaccacugcacuccagagccuaggcaacagagugaagccuugucuuuaaaaaaaaaaaagaaaaaaaagaauuucaugcaauuggaaucaggaaguguguguggucuuuuauuuuugagcucuuuuacuuagcauauuuuugagauuugcuuguauuauacauauucauauuuuauuccauuuauauuguuggauaguguuccauaauauguguauccacaauuuguuuauucauucaccaauugauaggacauuugguucuaguuuuugguuauuuugaauaaucuauucaauuauaauuaauauaugaccauuauaugagugaauauaugaauaauuucccaugaauuuaugaauaauaauccuaugaucauuugcacaucuuuuuuuuggagacagacucucgcucugucgcugaggcuggagugcaguggcgugauuuugccucacugcaaccucugccuccuggguucaagcaauucucgugccucagccucuggguagcugggaucacaggugugcaccaccaugcccagcuaauuuuuguauuuuuaguaggggcgggauuucaccauguuggccaggcugaccucgaacuccuggccucaagagaucugccugucuuggccucccaaagugcugagaauacaaaugugagccacugugccuggccagcaugcacaucuuacgaauaauaauucugugaucauuuggaugcacaucuuucugugggcacauauuuuuauuuuucuuggguaaaugccuacaagcagaaugccuagguuauauaguaaugaauguucaacuuuauaagauacugccauacuguuuuuccaaaguggguguaacauuuugcauucccagcagcaauguacgagaguugcaguuguucaacaucguugcuaauccuggguuuugugaaccuuuuuuuuuuugucuuuuuuugggacagagucuuucucugucacccaggcuaguguacagugagugguacaauaauagcucacugcagccuugaacuccuguggcucaaggauccugcugccucagccucccgaguagcugggacuguagggacacaauaccaugccuggcuaauuuuuaaaguuucuguagacaugggguguagccauguuguccaggcuggucuugaacuccugggcuuaagcaguuuucccaccucagccuccccaaagugcugggauuacaggugugagccaccaucccuggcugagccacgaugccugacuguuuugugaacuauuuuaacauuaguuugcuuuuuuuuuuugagauauagucucacuuguugcccaggcuggaguacaaugucacgaucucagcucacugcaaccucugccuucugccuccuggguucaagugauucuccugccucagccuugugaguagcugggacuacaggugcacgccaccaugcccggcuaauuuuuguauuuuuaguagagaugggguuucaccauguuggccagguuggucucgaacuucugacgucaggugauccgccugccuuggccuacuaaagugcugggauuacaggugugagccaccgugccuggccuauguuaguugcuuuuguugcguguagugguauuucauugugauuuuaauuuguauuucucuguugacuauugauauuuuguaagcuuuggauuuuauuuauuauuauuaguauuauuauuacuauuuuuugagauggagucuugcucuguaauccagacuggagugcaaugacacgaucuuggcucacugcaaccucugccuccgcgguucaagccauucuucugccucaguuucuugaguagcugggauuacagccaugcaccaccccacccggcuaauucuuguauuuuugguagagacaggguuucgccauguuggccaggcuggucuugaacuccugaccucaggugauauaccugccucagccucccaaaaugcugggauaauaggcaugagcuaccacaccuggccacuggauuuuaauaccugcuuuaugaaugcuagcuuuuuuuuuuuuuuuuuuuuuuuuuuuuuuugagauggagucucacuccgucacccaggcuggagugcaguggugcaaucucggcuuacugcaaccuccgccuccaagguucaagugauucuccugccucagccucccaaguagcugggauuacaggugcccaccaccacgccuggcugauuuuuuuguauuuuuaguagagacaggguuucaccguguugaaugcuagcacauuuugaaaucgugaaguaaaaugaguacguauccccacuuugugagaacugaaaugggcuggagcaugugccacugcuccuggcuauacuagaguucuuuaauucuuaaauuugauuuagaaauuuuauaugaauuuaaaaauuugauuuagaaauuugauuuuagaaauuuuauaugaauccaaggauucgauauaaaagauauaugaucauguacaaauuacaauuugucucuuucuguucuuccuuaggacauuuuuauuccuuccccaagucuggaagaacaaucaaaugaugggaagaaagauggagauaugcauaguucaucuuugacaguugaguguucuaaaacuucagagauugaaccaaagaauuccccugaggaucuugggcuaucuuugacaggggauucuugcaaguugaugcuuucuacaagugaauauagucaguccccaaagauggagagcuugaguucucacagaauugaugaagauggagaaaacacacagauugaggauacggaacccaugucuccaguucucaauucuaaauuuguuccugcugaaaaugauaguauccugaugaauccagcacaggauggugaaguacaacugagucagaaugaugacaaaacaaagggagaugauacagacaccagggaugacauuaguauuuuagccacugguugcaagggcagagaagaaacgguagcagaagauguuuguauugaucucacuugugauucggggagucaggcaguuccgucaccagcuacucgaucugaggcacuuucuaguguguuagaucaggaggaagcuauggaaauuaaagaacaccauccagaggaggggucuucagggucugagguggaagaaaucccugagacaccuugugaaagucaaggagaggaacucaaagaagaaaauauggagaguguuccguugcaccuuucucugacugaaacucagucccaaggguugugucuucaaaaggaaaugccaaaaaaagaaugcucagaagcuauggaaguugaaaccagugugauuaguauugauuccccucaaaaguuggcaauacuugaccaagaauuggaacauaaggaacaggaagcuugggaagaagcuacuucagaggacuccaguguugucauuguagaugugaaagagccaucucccagaguugauguuucuugugaaccuuuggagggaguggagaagugcucagauucccagucaugggaggauauugcuccagaaauagaaccaugugcugagaauagauuagacaccaaggaagaaaagaguguagaauaugaaggagaucugaaaucagggacugcagaaacagaaccuguagagcaagauucuucacagccuuccuuaccuuuagugagagcagaugauccuuuaagacuugaccaggaguugcagcagccccaaacucaggagaaaacaaguaauucauuaacagaagacucaaaaauggcuaaugcaaagcagcuaagcucagaugcagaggcccagaagcuggggaagcccucugcccaugccucacaaagcuucugugaaaguucuaguggugagugugauuguagauuauucuugucuccaccuaaauuauaaucuggaauggaaaguuggcgagaacugcaugcuuaugucaggagugaacacuaucuuugguuuauguuuaugaacaaccaauaauaauugggaaauuaaauuuuuuggauugccuuuuuuuuuuuuugagacagagucccgcucuguugcccaggcuggaguacaguggugcagucucagcucccugcaaccuccaccucccggguucaagugauuucucgugccucagccucccaaguagcugggacuauaggcucaugccacuaucuggcuaauuuuuguguauuuuuaguagagaugggguuucaccauguuagccaggcuagucucgaacuccugacucaagugaucuaccugccuuggccuuccaaagugcugggauuacagggaugagucaccacgcccaaccuggauuguauuuuuuuaauagcuauaauuauuugugcaauuaaagauauuugagguuuaucagcuuuguaacucgggacuaguugguaaaaaauauuuagaaauuguaccaaucuguuuuuuuuuuacuuagauuguauccuugcucucuguguauagauuuugacaguugccuugaaguagaaggaucuuuuuugauuaacucugugugguaaaaucacauucagaacuguugaugaguauccuauuaauuaguuauuuccuuuuuaugggcauuagguaaaguuucuaaacuuaguucaaaaaauacauaucucuuaaaccugaaacuggaaaauguauuaguucuuguucuuuauuuuaugaaauucagcaugaaaacguagauuacuuucuaaaguauuuguacaggcugggugcaguggcucacgccuguaauccuaacacuuugggaggccaaggugggcggauugccugagcucaggaguuugagaccagccuggcuaacauggugaaacccaucuccacuaaaauacaaaaaauuagccaggugugucguguguaccaguaguuccagcuacucgggaggcugaggcaugagaaucgcuugaaccugagaggcagagguugcagugagccaagaucacgccacugcauugcagccugggcaacagagugagacucuguuucccaaaaauaaaauaaaauaauuuguagaguaugacauuagcugaaaauaauucaaucuuucugaauccuuagaguuaguauaauguaggucaggcgugguggcucacgccuguaaucccagcacuuugggaggcugaggccagcagaucgccugaggucggaaguuugagacuagccugaccaacauggagaaacccugucuuuaccaaaaacacaaaauuagccaggagugcuggcaggcgccuauaaucccagcuacucgggaggcugagacaggagaaucacuugaacccgggagauggagguugcgaugagcugagauugcgccauugcacuacagccugggcaacaagagugaaacucugucucaaaaaaaaaaagaguuauuauaauguaaaaucaagcuccaaaaacaaaauaacaagacacaaacuuaagaaaacaaguuuuuaggaugaaaugaaaaaacaguauuuggcagguuuacauaugauaguaugagugaccauauuuuuugguuugcguagaacagucccuuuuuuuugagauguggagucuugcucuguugcugggcuggagugcaguggcgcaaucucagcucacugcaaccucugccucccggguucaagcaauucuccugccucagccucucgaguagcugggacuacaggugcaugccaccaugcccagcuaauuuuuguauuuuuaguagagacgggguuucaccaugcuggccaggaugguuucaaucuccugaccucgucaucugccuuccucggccuccaaagugcugggauuacaggcgugagccgcugcacccagccuagaacagucccauuuuauacccauugucuaagugugauuauuaauaguacuuuuuuuuuaguuuuuaaauugucccuauuggccgggugcgguggcucacgccuguaaucccagcacuuugagaagccaaggcgggcgggucaccugagaucaggaguucgagaccagccuugccaacaugaugaaaccucaucucuacuaaaaauacaaaaauuagccuggaaugaugacgggugccuguagucccagcuacucuggaggcugaggcacgagaagccgagauuguaucacugcacuccagcuuaggugacagaaugagacuccgccucaaaaaaaaaaaaagucccuauuuauuagcuuuuauauuuagcacuuuuuuuuuaucuuaagaauaagaaauguuagagcuaaaaaggaagugagggguuauuggauuuagucucuucuuaacgucuuuuggcuaguuaaugauagaggugagacuagaaccuaggucuccugaucccagcugugcuuuuucuuccuguaaaacugcuuaauacagauuauuugauucugaagagcuguagugaagaacaaugugaauaaccuaaaauucuguaguagaguauuuuucuaauuguauuauguuuaaauacugcuaaugaccugugccaacaaaauaucaggucucuuugauuguuuuaauauaguuauuuuggaguacuuuuuuuuuuuuuuuuuuuuuuuuugagacggagucucacuuuuucgcccaagcuggacugcaguggcgcuaucccggcucacugcaagcuccgccucuuggguucaugccauucuccugcgucagccucccgaguagcugggauuacaggcgcccaccaccacguccggcuaauuuuuuguauuuuuaguagagacgggguuucaccguguuagccaggauggucucgaucuccugaccucgugauccgcccgccucggccucccaaagugcugggauuacaggcgugagccaccgcgcccggccuggaguacuuuuaaauuaaaugcaaaagaagcuucuaaaacagugagauauucuauuauuuuaauaguauucuucaugaauucuuguuuacauuguuaauuggcagagucagcuuuuuuugccguaguaaaacuuauuauuuuauuaacauuaauauccagauuauugaaaaugcuagugauuucguguuuauuucaugauuuuaguucuugggcaaacaacaaaaaguaaugaagacagugguuggaaaauaguauuuaugaggagaaguuaaauaaaaauaauuuuaacuacaaauuagaacaugaagggagaauaauagcuuuuugucuuuuuuuuuguuuguuuuugagccagggucucacucugucgcccaggcuggagugcaguggcaccaucaauguucacugcagccuugaccucccgggcucaggugauccucccacuucagccccccgccccgagaagccgggacuacaggcguguaccagcaugcuuggcugauuuuuuguagagacaggguuuugccauguugcccaggcugaucucgaacucuuggauucaggcaauccacccaccuuggccucccagagugccaggauuacagguaugagccaccgugcucagccgagaacaauaguuuuuaacuuagaaaauuguauaaaauaaaucauucagaagagcguugcaaaaagaacagaaaaauauuauuuuguacuuaaaaauauaguuguuuaguugcuaaauguugagagacuaauuuuauuuuuauuuuuuuggaacagagucuugcucugucgcccaggcuggagugcagugacaugaucucggcucacugcaaccuccgccucccagguucaagugauucuugugccucagccuccugaguagcuggaauuauaggcacaugucaccaugccuggcuaauuuuuguauuuuuaguagagacaggguuuugccauguuggccaggcuggucucgaaguccuggccucaaguaauccaccugccuuggccucucaaagugccgggauuacagguaugagccacugggccuggccaaauuuaaaugauaguaaucuaaaaaguaaugguucuucacuuuuacacuguuggugggacuguaaacuaguucaaccauuguggaagucacuguggcgauuccucagggaucuagaacuagaaauaccauuugacccagccaucccauuacuggguauauacccaaaggacuauaaaucaugcugcuauaaaaacacaugcagacguauguuuauugcggcacuauucacaauagcaaagacuuggaaccaucccaaauguccaacaaugauagacuggauuaagaaaauguggcacauauacaccauggaauacuaugcagccauaaaaaaugaugaguucguguccuuuguagggacauggaugaaauuggaaaucaucauucucaguaaacuaucgcaaggacaaaaaaccaaacaccgcauguucucacucauagaugggaauagaacaaugagaacacauggacacaggaaggggaacaucacacucuggggacuguugugggguggggggacgggggagggauaacauugagagauauaccuaaugcuaaaugacgaguugaugggugcagcacaccagcauggcacauguauacgugugugacuaaccugcacauugugcacauguacccuaaaacuuaaaguauaauaauuaaaaaaaaaaagaaaaaaaguaaugguucuucagucugaaaagacagaaugaaaggugugaauugggugaguuuugcauuuguucaucuacuauuagaagagcacuuuuuuguuguuaauagauuuauugauuuuaaaaaaagauacaugcuuggccaggcaugguggcgugcacgcguaauuccaguuacuuaggaggcugaggcuugagaaucacuugaacucgggaggcggagguuguaguaagcugagauugcaccacugcacuuuagccugcgcaacagggcgagacccugucucaaauaaauaaguaaauaaauaaugcaugcuuaauuuugaaaaacauucaaacaauacaaaguagagauucugaguggggaggguguggggagagagggaguuggaaggaaaagagagagugaguacagagagggagagagagaauuacuuuaaaugucuccauuuauagauaacuugucacuguuaacaguuuggagaccucuucaaguaucugucuauggagagcuccuguuaaaccuguaaaaaagcaagaugguacuuggaagcccaaucuuguucaacacagaacaaauauuugguggguugaugaugugaaaaacuguaaggaguucaguaagucuuuaaauccauaaguaauagucuguaauaguuaauaaugaucaggggaucuagauguguuuuaggcucuagcuauaaccuuuauuugcuuacuugauagaaugccaucuuaauuggcuauuaauaucagaggcagacuuuugggguagacuucaugcaugauaucgccggauauauaaauucuuacauuuuuaacuagauggcuuuuaauaaauucuuagggguaaccaguucuuuuaagaacaaagaagaaaaauggguuuaaaacuauaacagaaaguuaggagagaccuucuuaacauuuagaguuuuaaauauugcuuuggaguuauucucuaaaguccuuaaaggacacauacucccacucaggugguuucaaaauuaguauugaguuuccuuuuguuuccucauucauauccuucauuauuguuugguaugcugaccuacaacaugauagcccaugauuaucuggaaaaacaagaagggauuugauaauuuaaagaauguaggauugcuaaauguuagagaaauaauggaauauguggaaaauuccguaaguuuaaaaggauaaaauauaccagcaaauguauuuuuaaggauuuggcaauaguuugaguagaugugugguguuuuccagaugagggaacaaaagcauagaaaugggaaaccuuuggaggacauugaauagaagcuuuaugaacgugaauaauuaaagaaaaacuggagauauaggcugcuacuaguuaguugaaugcugacuauagaguugggaauuugucuucuagugaaaaccuugaaguuuuuugaccaggagcuaacaaagccauguuuucuaggaaggcugcagaaagugugcagaaagaauggggguuagggagagugggagacuuuaggcagaggaagugauugauaggcuaugguaauaauccaggaaugaggcauuggagaccugaggagaguaguggcagugcugucccuagggccuguaaaagucugaauuuuccauuagguuauaguaaugcaguuagauaaauggugcuaaaauuacuuuccauaaguuuuauguaauacugugcaaaggaaaccuuguuacagggauauauuuucagcgauuaaugcuugcauauugcauuugcguaauauaguaugucacauagaaaggucugcuuaaagauuucaugcacauuuucagaagucuggaauauaugaggcuuugcaagguguuuuuuaaguuucuguaucucuucuaaguucuuuauuagaacaacuugcuuuauaaggggcuaccacagaaugaaugcuuaucuaccugacccauuucucuuuucuguaacuaugguggaugucugucaguuagauguaauguugagauucuucauccauacuguuuacagguuuguuuuuguuuuguuuuguuuuguuuuuuugaggcacggucucgcucugucauccaggcuguagugcgguggcaccaucuuggcuuacugcaaccucugccucccagguucaagcaguucuccugccucagccuccugaguagcugggauuacaggcaccugccacuacacccagcuaauuuuuguauuuuuaguggagacaggguuucauuauuuuggccaggcuggucucgaacuucugaccucaagugauccauccgccuucgucucccaaaguguugggauuacaggcaugagccaugguaccuggccccucuuuacaguuucuuuagcugagcauauguacuuuaauccuuuauuucuaaagaccauuucuuuuucucucuuuaucuccucagauuacuaauucauuuucucuugaaaccccaucucuacuaaaaauacaaaaaauuagcugggcgugauggagggcgccuguagucccagcuacuugggaggcugaggcaggagaauggcaugaacccgggaggcggagcuggcagugagccgagaucgagcuacugcacuccagccugggcgacagagccagacuccgucucaaaaaaaaaaaaaaauuuuuuuguuuuguuuuguuuuaaaggaaaaaauuaucacggugcuugcuauuaaagauaggaguggaaaaagaugaaagaagcaaacuacuuucauaaguaguaguguccaaguaugccagauuauaguuauuuugagccaucccaggaaaguaagaagaaauuuucauauauuaguuuuaagagggcagucuggcgcaauucuuauuuucucccaaauguaucauuuuauaaaaagagauaaauuaggaaauuagaaaaugugauuuuuugacgguuuucuaguucugauuagcaaaaauuuggaacugagaccuagguagaaaguagcuuuaugucuugacaaauauuuucuauuuauaauaauuuaauaacuaaaauguguacacuggugaugcuuauauaugagggauuuacuguugugcagagauuuagguaugaacauuacacuuaggccuagagugaaugcugguccguacugcugaaccaugaaacccuuggauuucuaugcuagaaccagucaguaucuugaaguccuuuaacccgugagauccucugucaucucuuugauuagauuguacauuauaaguauuaacuucaaacuuugcuuuggagaauccuacagacuauuaaggcuuauaaacaaacuccuuagguuagcauugcacaaaauuauguuguucugauuugaaacuguccaaauuuguauugcuaaauauccccugauguacugucuuggagaucaaauguuuguguuccauuugacuccagguuccucaggucuugcagacuucgggcuuucucaauuugccuguccucugguugucuacuuugugucaguacuauaguuguuggcugugaagagagcagagacgauagaagggaguuagucaggaggccuggugagggugguggcaaugagacagaauuugggagcaaaggaaaagagugauugaaauauuucuugcaguucuuauuauuuuugcuuauuuuauacuucuguuuuuuuuaaaucauuuuuucuuucuuucuuuuuucuuuuuuuuuuuuuuuucagaaaccccauuucauuucacuuugccuaaagaaggugauaucaucccaccauugacuggugcaaccccaccucuuauugggcaccuaaaauuggagcccaagagacacaguacuccuauuggugagugaauaaaaaguaaugauauuuaaggcagaauuucugagauaucauucucuacacaagugauauuuuagaucugaggaguugggucuggcugguaagguugauuuuuguuuuagggaaaauaggguuaugaagucugguucugugauuuuacuacuaggagaugagggguaaagagaggaaggaaagaaaggguggagggaaguaagaaagaaagagaauacuuaaaagaauuuuaucuuauuacuugcaaggcaguagaaucugagugcuaaguagugauguagagauguuuuauaaggauggaacaggaaguaagguagaaguacuauuuauucaguaccuuggcuaauuagucagucugcugcuugacagggcaagaaaacuuagauccuccuucccugaagcagccaguagucuucuacauuaaccuauuuguuuucucuagucagugcugggagguaacaaucaugccgucuggagucuccugcuaccuaugccugaugcuggcagauguggguuggcugagggcucaugcagcauccuuuguccagaugcagaaguggaacugaauccuguugcuccucuuaagaccaggugucaauacuaguucguaguuguugauacuuaugacagggaucuauccuaggaaccuccuucaauccugcagagcuguggagccaaacaggcaaauugaugaccuugaauugcuguuuuuuguguuuguauuuuaguguucuuuuuuucuuccucccugccucacuucuuucagguauuagcaacuauccagaaagcaccauagcaaccagugaugucaugucugaaagcaugguggagacccaugaucccauacuugggaguggaaaaggggauucuggggcugccccagacguggaugauaaauuaugucuaagaaugaaacugguuaguccugagacugaggcgagugaagagucuuugcaguucaaccuggaaaguaaguuuuauguuaaucuuggguaauuaguagcugcagauuaucuggggaguauugauuauaaucuaguuauaauaauugauacuucuauauuuauaaauguauuuguaaagucuuacacucauagauuuaauucuuugcuuuuggccagccugucauguuacuaaagauacucuguuuuauaaucuccauauuauagcuuguuucuguuaagucuguuccuauguaauugguuucccuauucagaaagacuucagaauaggguagaaaacuuuaggacuguggauucacauugcagauuaauguugauucuuucccacaugaauuagaaguuguuugguagggcuagaauaaagagaagauacaagggagggaugcaaaguagggaccagaugcugaaaggcuuuuuacaucaugcugagaagccgaagaauuuuaggcaagggaguaauaugaucagauuugccuuuaaaaaaaagcaucagcugagucuuucaaaaccuugugcuuuugugcaugaugauuccuuuccuugcauuucccauauucuguucuccugccugguaaauucuacccagucuuuaaccagaaagugaggucauugguaguggggcuggagaugagggaugaauuugaggagcgaguaggcagaacgauggugccaggugaauauggaaguaagggggaggaaaaaaagagagaaugacucuucacauauacuguaugaucucauuuccauaauaguacucccaaguagguaucugcauuuucauuuuauugaugagaaaacagaguaagagagguuuuuaaguuacaugucuaaggucacaauaauuggugcuagguggaguuggaauuugagucagaccuaacucugaagcuuauaauuuuuucauuucagguaauuuguaaaagcuguuuaagggggauuagaagaggaagaaaucucauaaaggagauuauaaaggaacguucagagagaaggagaacuaggaggguauaugaagccauggaagccuauggggaggggaguuacaagaagaucaugucaggcacaggagcaaguuuaguaagaugugucuggaaauauacuuugacuucggcgaggcaauuaggauccauuuggugacucuagcaagagccauuucagugcagcaguuggggugggagcuauacugaaaguaauugaggaaggaugaggaagaggagaugaggcugcaaauguacucucuacuuuugagaaguuuaugugagagaagaagagaaaauauggugaguuagagggaaaugcaggguugagagaggauuuguuauuuuaggcugggagaggccugagcaaguuuacagauuuuaacccauuuaugccuaguguuccacuauuggaacacuaagcuugcgggaguuauuuauauccugcugcucaaggucaucaccaaggucugauuuuucacaaaaaaaaauuugcaaccuccagcauaaauggguuaaggaaggauccaaaagagggaggcauagauuaaagacgagggaauugggggaaacaguugaugaauuaaggcccugaagaaguugggaggggaagcuauugaagacuacacagaauagguuggauaagcaggacuucuucuucccugagaccagagaaaaguaauuuuagcuaauacauuuuuagcucuuacuguauaccagguacuucacauguauagcucauuaaaucucauaagaagccgaugaacuagauccuauuauuauccuccuuuuacagaugaggaaacugaggcacaggaagguugagcgccuucccuaaacauagcuaguaaauggaguagccgggauacaaauccaggaagucugguuccaaaucuuugaugcugugguacuuacugauuugaaucuuagcaacucaguagacugaguuaaaguauuacaugguuccauccuuacuaucaucuuuuccggaauaaauaagggcuuauugccaggcauggugguuggugcgcuucuauaaucccagcaaugccagaggcugaggugggaggugugcuuaaacccagaaguacaagaccagccugggcaacauagugacaucucaucucaaaaauaaaaauuuuaaaaaggguuugucaagagagagaguaugugauagccuuaaaucuuacuuuaccuuuggaucugaaauuacaacuagcgaaguguuaaggaugguuauaucaguaaauuuuacuaccuuuccuaauaccaggagcauaguaucaaggacuguauucaguguuacuuacaucauuucauccuuacaacaaacuuuuuagguuuguuguguuuuuaucuuauagaggaggacacugagacucaaaaugacaaaguaguuuacuccuagguuggacuauuaagugcaauagccagggugugagccagguuucuauuucagagccagggcuccaacugaauuucagcugccucccugauggacuguuuagauuauguugggucaugaauauuuuagaaauaauuaaaaaccauuuaaggguuguuuucucuaaggcugguauaaauuguaaaugaacaaauuuuaaucccuugaaauuagugacauuguugugagaauaugggauuuuuuucaguacgaccuuuaaucuguugcugcauguucuugaaaauguccuuuuuguuucuuuuuguuguuauuguuguugagacagggcuucucccugucacccaggcuggagugcaauggggugaucucagcucacugcagccuccaucucccaggcucaagcgauccucccaucuuagcccccugaguaggugggacuacaggcacgcccaccacccaugccugguuaauuuuuguauuuauuauagagauggggcuucgccauguuagccaggcugguguugaacuccugggcucaagcgauccuccugccuuggccucucaaaguauugggauuacaugagugagccaccgugccuggccacccuuuguuuuugaagugucuguccuaaagcacuuugggaagaacuuggguaccuucuauuugugggugcucuaaaaacuauuuaaaauuaguucaucaaccuaaaauauuuucuacuuauuuuauuaaguucuuuuauuuuuaauuuguuuuuaauaugauauaaauuuuaaaaaguuuuugguuuuuaauuuuguauuauuacauacuuuuuuaacuucuuauaugggcagagaugaauuuggauucagaaguuuaauuuucauuuaagaauguuacugcuggccgggugugguggcucaugccuguaaucccagcacuuugggaggcugagguggguggaucaccugaggucaggaguucgagaccagccuggccaagauggugaaaccccaucucuacuaaaaauauaaaaauuagccggacaugguggcagguaccuguaaucccagcuacucgggaggcuaaggcagcagaaucucuugaacccgagaggcggagguugcagugagcugagaucaugccacugcacuccagccugagcaacagagugagauucugucuccaaaaaaaaaaaaaaaaaaaaaaaaaaagaauauuacugcuaagggcuaggugucguagcucguauguguaaucccagcacacuuugggaaccugaggcgggugaaucaccugaggucggaaguuugagaccagccuggucaacauggugaaaccccaucucuacuaaaaauacaaaaauuagcugggugugguggugcacaccuguaaucccagcuacucaggagggugaggcaugagaaucgcuugaacccaggagacacagguugcagcaagucgagauuacgccgcugcacucuagccugggcaacggaguaagacucugucuccaaaaaaaaaaaaaguuacucauuguauuguauuucuugccaaucuuauuagucuuuuauaggaaguuugaaagaaaauugauugguggaagugagaaaaacuuguaccauuaaauuacaagaaauagccagccgggcacaguggcucuugccuguaaucccagcacuuugggagaccgaggcgggcggaucacgaggucaggagauugagaccauccuggcuaacacggugaaaccccgucucgacuaaaaauacaaaaaaauuagccgggcgugguggcgggcaccuguaguuucagcugcuggggaggcugaggcaggagaauggcgugaacccgggaggcagagcuugcagugagccgagauugcgccacugcacuccagccugggcgacagagugagacucugucucaaaaaaaaaaaaaaaaaaaaauuaaaacaaaucuggccugcacugcagccugggugacagagcgagacuguugucucaaaacaaacaaacaaaaaacaagaaaucuggcagaucacuugauuucaggaguuugagaccagcuugggaaacuuggcaaaacccugucuuuccuaaaaaauacaaaaaauuagcuggacgugguggcgcaugccuguagucccagcuacucgggagguugaggcaggagaucgcuugaacccaggaggcggagguugcagugagcugagaucacgcuacugcccuccagcuugggugauagagugagacugucucaaaauaaagaaauaaauaaauaaaauuacaagaaauguuuguauguuuauacuuacuaguuuuacuuauuuuuauuucuuuuuguuauuuuuugcaaauacuaguagagcagagugaagguuuaggugugauacuaacuaaauucuguuucucuuuccuuucucuccuugguuuuguuuuuauucagagccugcaacuggugaaagaaaaaauggaucuacugcuguugcugagucuguugccagguaaccaaagcuggaugcuauuuagaguuuaauacacagcuacuggugaugaggguagaugguuuaucaacaaaggaaaaaaguuaaaaugagaaaguuaaaaugagacucuuucauaaaggauuuagcaauguuuugaauggaucauagacuuuuuaguuaauacuuuuuuaaguucagugaagcuuuuuucuacaccuagaacuaagauaauugaaaugucuuuacuuuuguucaugugagaguuccuuuccccccuuuuuucuguugcugauacaagagucuccacaaucucaggauuguugauccaauugaugagaaaaagaaggauuaacaagagauagcuacagaccuuguuccuucugcaaucgcauacucagcugcagccucaggucauuuucucuucugccugccaaauuaacuacuauguugagcuguuauuuuugcuuugucauggauguuguaaugcuuugaggacgaguaugaccccauacugagguuuugguugguaagcuuugccaucugguggcugugagaauacaauuguuucaggcaugagucauccagccugaaaacgcuaauagcaguuggugaaacauaggcaagaauucuucuuuuauuuucuuuuuuauuuuuugagacagaaucuugcucuguugcccaggcuggagugcgguggugagaucauggcucacugugaccucaacauccugaccuccagcuauccuccugccucagccaccugaguagcuggggcuacaggcauguaccaccucaucuggcuaauuuuuguauuuuuuguagagaugaggauuuuacuauguugcccaggcuggccuugaacuccugggcucaagugauccaccugccuugacuucccaaagugcuaggauuacagaugugagcuaccaugccccaccaagaauucuuaaauuagaggcuaggcggguacuguuaauaacuaaaguggcuagguacaagacagaguguuuuuuuuuuguuuuuuuuuuugagacggagucucacucugucauccaggcuggagugcaguggcacgaucuccgcucacugcaagcuccgccucccggguccacaccauucuccugccucagccucccaaguagcugggacuacaggugccagccaccacgccuggcuaauuuuuuuuuuguauuuuuaguggagacgggguuucaccguguuagccaggauggucucgaucuccugaccucgugauccgcccgcaagacagaguguugaggacaauggcaaacugaauguaugguccaugugaaagggugugccccacucaacuccagccaguaguugucaugugaaacugcaaacuucuuguugccacaucuuuguuuuuagaaagaaaucuggauuuuuaaaaauaaaauaucaaauaaaagaggccuguggacuaaaugugaccucacuugugaguuucugaccuuuuucaaagucuuuugaucuguucuuagcuaugucuuagagagauuaguuccucauugggcuauuaguauauuuaaucugaaacauaaguaccguagaguccuuuuucauuugaagaucccuuaaugauauauagucuuagaagcugaagaaaguggaguguguaucugguccauuuggcuuuaacagaauuuuuggccaggaauaaguuguuauuagucuguacuugugcauauucagagggaacagaguauguugcugaagcuucuagaacucuuaggguagaaaguagagaggagaaaauaaggaaaaacuuugagcagaggguuggaaugguggauccuagaaugagaugaaauuuuugauauuguugugaauaaauuuuucuauauaagaaucuaaauuuaaaaaaauucgacuuguuugcuauuguguucacucuaacaaaucaucuaaaguaagcucugucacaauauuggaagugguccuugguucaucugcauuuagguggagauuuuuuguuuguuuguuugagacagggucucacuuugucaaccaggcugcagugcaguggugcaaucacaguucacugcagccuugaccucccaggcucaagcgauccuccugccucaaccccacagggugcugggacuacaggcaccugccaccaggggcuaauuuuuguguuuuuaguagagaugggguuucgucauguugcccaggcuagucucuaacuccugaagcucaagugauccaccuggcuuggccucccaaagugguaggauuacagguauaagccaccgugcccagcguacaugaaacuuuuaaguguuguuuguaacuguacucuguucaaauuacuugcugucaccuuauuucucaaucauuuuacuacagaagguuucaagcauauacgaaaguagagagaguaguauaauggacugccauguauucaucacccaguuccaaaaauuucuuauggccagucuugauucauuuauauuuccagcaccccccucccuacugaauuauuuugaagauaauuucagcauuauauaauuuuaucugaaauacuucagugcugucuccaaaagauaaggauucuuauuuuaaacuuaaccguauuacuauuaucauacuuuaaaaaauugacaaugguuccuuaauaucaugaaauauucaauguucagauuucucugauugucucauaaaugguguuuuacaguuugacucaagaucuaaauaaggucugcauauugcauuugauuauaucucuuuaagucuuuuaaaauacagaguaccccuccagucuuuuuuuuuuuuuuuuuuuuuuuuuuuugccucuugcuugcaaauuauuuguugaagguacagauuguuguaugguuuucuacauucuggauuuugcugaucgcaucuuuaugguauuuaauacaguccucuguccaccuuauuuccagugaaucuuccuugagaauuuuaaauuaugcuaauucaaaacaaguauggagaauuugcauuuugguguaaggugguuuggaguuugauaugcagagaaagcauuuuauuuccucugugcauaaaaggauaaucuccaaaaguacuuuucuuuucaaaguuaacaauauauugcuuuaauauauugucuuaguccccagaagaccaugucuguguugagcuguaucugugaagccaggcaagagaaugaggcucgaagugaggauccccccaccacacccaucagguaagcauuauuuuuauagaaucuuuugggcuccauugguucacaaaaugguuagugcccaaauccuaauauguacugugcugugguuugaauguggcauguguuggaaacuuaacccccagugcaacaguguugagagguaauuagugguauugguauaaagcuacagaaguugaccacacauacacaaaaaagagguaauuaggucgugggggcacugcccauauguaugcauuaaggcuguugccgugagcauggguuaauuauaaaaggcugaaggggcaguuuggcccccuuuccaccuucuugaaugcacccucaccaugugaugucuuuccaccguguuacgaugcagcuagaaggcccuuaccagcuggccgucuagaugcuagugccauguccuuggacauuucagcauucagaaccaugagccaaauccuguaaaucuuuuucuuuaucaauuucccagucuggugggaauucuguuauagcagcagaaaacagacuaagauguacugcuacuguuuugugagcuugagcuuaccuuauuuuuuuauaccuugagggacuauaguguauucuggauagauugaugagcugucaugagaaauuuuguuaaauauuuuauagauacacauuuuugucuuuaucugccaguuguaucaauuugaaaugacugacuucauaaauguauuuauuaauuuauuuugagauagggucucacucugucacccaggcuggagugaaguggcgugaacauggcucacugaagccuuuaccucuugggcuucagccucccaaguagcuaggaccacaagcaugcgccaccauaccggcuaauuuuucuauucuuuguagagauggcuucucacuguguuguccagucugguuucaaacucuugggaucaagcaguccucccaccuuggcguccagaaguguuaggaauacaagugugagccaccgugcccuacggugaaaauaauuuauauaauuccucauuucuuagauuaguuuuucuuauuuugggaaucauguuuacuuuuaacagacuuuuuauuucuccuuaguuucccacagagcaaaauaugagauguuuaacaucccaaauuuaaaguuuuucagacuuaauggaauuaauuuuuccauaauuucuuuuucuuuuuagagacagggucucacucugucacccaggcugaggugcaguggugcaguaauagcucacggcagccccaaauuccuaggcucaagcaauccuccugccugaacccccugaguggcuaggacuacaggcaugugcugccgugucuggcuaauuuuuuuuuuuuucaacuuuuuuuucaacuguguugcccaggcuggucucagacgccugggcucaagugauccuccugccucaucuucccaacgugcuagaauuacagauaugagcaacugugcuuagccccauaauuucuuuacuccauaaucucuuagaacagucgugaggcaggaaaaaaguuuugaguuacaggccuuuaucucuauuuaaauaauuaaggaagcggcuggccacgguggcucacgccuguaaucccagcacuuggaggccaaagcaugaggauuacuugaggccaggaguuugagaugagccugggugacauagugagacccuauuucuaccaagaaaaaaaagaaaaaaaaaaaagccggaugugguggcaugcgcuuguggucccagcuacuuggaagacugaagugggaugauugguugaaccuggguggucgaggcugcagggagcuguggucucgccacugcacuuuagccuggggaacagagugagaccaugucuuaaaaaauaauaauaaauaaauaaauaaauaguaucuuauauggaauauaugauacuuauauuuaguguagagaaauaaguaauggcaguggaaaaggaccuguauuuucauuaugaagugaguaucuuucaccucuaaaauucagugauuucguaauuagacaaugugauaauguuuugucaguagguauaucaguaacagugauauaaguagcaugauuuagccaggcgcgguggcacuuugguagaccgagguggguggauggccugagcucuggaguuggagaccagccugggcaucauggugaaacuucgucucuacaaaaaguacaaaauuagccaggugugguggugcaucccuguagucccagcuacuugggaugcugaggugggagaauggcucgagcccaggagguggagguuauagugagccgagauugugccacuguacuccagccugggcgacaaagccagacucugucuaaagaaaaaaaaaaagacuggaugggguggcucacaccuguaaucccagcacuuugagaggcugaggaggggugaccacuugaggccaggaguuagugaccagccuggccaacaugguaaaacgcugucucuacuaaaaauacaaaaauuagccaggcagggucguccacgcuuguagucucagcuacucuggaggcuaaggcaugagaaucacuugaacccuggaggaggagguugcagugagccaagauggugccacugcacuacagccuggcgagagagugagaguuaugucuuauccauuaaaaaaaaaaaaauuaauagguagcauaauuucuaaauuucuaugcucauuauugaaagaaauauuuaaaauaaauaugucagugcauuaaaugggcauucugaauaagugugagcuuguugauauucuugggaaucagaugauccugaaaucaugugauuuuaacagugguguaguaaugacccagcuauuacuaaauuuauugaugucauuguauugccuugcuuuuuuauuaaagcguuuuaaaauagaggugccaagauguugguuauauuguuuaaccuugguggagcaaagaucugggaaucuagcuggauuugauucuagaugccucauaaacagagcuacacucagaauagaauaguuagacauuuguuaaauauggagauguauucuucccuauuucaauuuggauuuuuuuuuuuuuuuuuuuuuuuuugagauggggucuuggucugugugucacccaggcuggaagugcaguagggcgaucuuggcucacugcaaccuccaccucccagguucgagggauucuccugccucagccucccaaguagcugggacuacagguguaugccaccacacauggcuauuuuuuuuguauuuuuaguagagacgggguuuugccguguuggccaggcaggucucgaacuccucaccucaggugauccacccgucuuggcuucccaaagugcugggauuacuggugugagccacugugcccagccuaaaauuuacuuucuuagcaucaguuucuaagucuggcauauagugaccagaguagaauugcauagcuggaacuaauggagagggagagagguauggcacuucuuacaauuuauuggauugcuguagaaguaaaauucaauucagguauucuaaccugaauaaacagcuucugaggugucuuagucucuuugggcugcugcaacaaacugccauaggcuagauagcuuauaaacaaaagaauuuauuucucucauuucuggaggcugagaaguucuagaucaaagcacuggcagauuuggugucuggugagggccugcuuccugguuuguagacagcuguucucacauggcaguugggggcaagagagcucucugaggucucuuuuauaagggcacuaacccuauucaugagggcucugccucuuaauaccaucaccuuggugguuaggauuuaauguaagucuugggguggaggggacauagacauuuagucuguagcaugagauaaaauuuauaagcuuguuuaggauaggaaacaacaauaauugaauuccuaaaaucgaguccuggcucuucuggcuuuugaauccuuuccuucuugcucagccauugguauguuagaugucuuaaagauuuaaauaugaauauuuaguugauauugaaggugaacugagucuguuuaauugcauugucuuaugcaucuaauauugauugagcaucugcuaugcucaauauuuuacauauaugaacauuuauaaaccucauaagagguaagugcuacucaugguaggugucuccugguggucuuguucuuacuucuucuucauuggaccauauauucucauucaguugagguuccugagagauaggacacacacuauaacaaccaaauuuauacuaagcucuucuuggcuagaacucuauuugaaaucccucuuugagcuccuguucugguaggcugagcuaaacaauauagaaaccucagaaacuucuuuuuuccuuuuccuucaagaucuagagcagagcaaucccugaagagcacuuccugcuuccuuuacccugucuacguaggaaagcugagauccuaaggauaagagcuucugucaaauaggagacagcccuaacucuuuuucuggccacauacuuaaaucaacauaugacauaguuucuaggccccuuaucguccuucauguuaccuucugaguuuaucuacaguuuaugccuuguaaacugucaugccgagaacugaaacagauauuccagauguggucuuagcauggucaguucagaauggauuccuuuuauuuuuauucuggcuauugugcguguaauggagccuaaaacugcauuauguugauuuaaucugaguagauuuugcaauuaauugauucagagaacauucagucuucuguucaaaguacauguauuaagcaucuauuuuauauuaagcugugaguuagguguuuuaaauauaaagauagauaagacaugaaugucaaauuucuguugacuuggaguuagccuggacguuuuuauucuggagaauuguuagggauauuuaagaaagcuccuagucacuucggaaaucgugguaugugguuuguaggagacauucagcaaaugcuuguggaauaaaggaacgaaucacugauacccaaaugggaugacuuaugaaaaaaaaugggcuguaucuuaagaacugucuuugagaaaccaauucauucugaaauguuuaguuguagauauaucaguauagcugacaaaacuagaaucuaccuacagcuuuauccuuuguaagucagauuuucuuuccuaaaaauauugcucagguggggauaaacaguaucuagaaugcuaggaaucaguuaaggaauguuagaaccaucauaaggccagauaagacaucuugacuuaauugaucuuuuuucaaaauagaucccuaaguugcccuucauugucuaugacuucaguaauggguuuacaucuuuuuguuuacuucauuuuccugcaucaaguuucagaguucauagcuagugaugggaagaaauuuuaugacucuuuuaucaucaugguggaauuguucuaucuaccauuauuuuuuuuacaggagugaaauuauaaugagaggccucccaaggugauaaugcuugacuaccugacuuucucccuuccuuacauuucucaaauugucaaaauauggcuccccccuugccacuacacacacacaugcacacgcacacacacacguucacacauacacuugcuuaauugacauggcuucuuuauauguugcauuuucagggggaacuugcuccacuuuccaaguucucaaggagaagaggagaaagaaaaauuggagggugaccauacaaucaggcagagucaacagccuaugaagcccauuaguccugucaaggacccuguuucuccugcuucccagaagauggucauacaagggccauccaguccucaaggagaggcaauggugacagaugugcuagaagaccagaaagaaggacggaguacuaauaaggaaaauccuaguaaggccuugauugaaaggcccagccaaaauaacauaggaauccaaaccauggaguguuccuugagggucccagaaacuguuucagcagcaacccagacuauaaagaaugugugugagcaggggaccaguacaguggaccagaacuuuggaaagcaagaugccacaguucagacugagagggggaguggugagaaaccagucagugcuccuggggaugauacagagucgcuccauagccaggugagagaacauacuagggugcaucagaggccuuguuuuuaacuuucaggauucucagagaauuuaaguuguggcaugucugccuaaugacaauucuugacaguuuuguacagaacagugguuaaaagacaaaaacaacuuuucuaagauacagauaugguagugaaauuguggguagcuauagccauuagauagucuuuuagggaaaauguaguauugcuacaguuuuuuagguaggucuuuacuggagaagaaagccagagauucugccuggguccuguaauacucuucuacauucacucuuuuccuucuccauacuuuuuaucuugccuucuaaccaucagaucuaauuuucucucccuuaagucuauuucaucaugguucucaggaauucagagaguagaagguaagggggaaagaagcagcacgaagaauaguguauuucaguauaugaaacagaaagaaugguaacaggaauagagagagagauggggaaaaguccccaggugaccaagaacugcagaagagaggcuagacuagaagcuaaugugaagaaaaggauuggggcugaugaaaacgaggcuggaggaguaucagguuccagggaauagaguagggaagugucgguacuaguaaaaauuaaguagguggcugugccugguggcacaugccugaaaucccagcgcuuuuggaggcucaggugggaggauuacuugagcccaggaguuugagacuagacugggcaacauagugagaccuugucucuuaaaaaaaaaauugaguagaugaaaagaagucguagaaauguauguguuaacaaauacguagaaguucacaacauuucauugaguggcagagugggaucuauggcagagaaaauuuggaaguuacuaguaaacaguagucucugcuuaucagugguuucuuuuucuuggugguuuuaguugcccauggucagcugcaguccagaaauacuaaauggaaaauucuagaaauacuaagguuuaaauacugugcuguucugaguaaugugauaaagugcugucccucuuaguccuggcuaggauaugaauccucccuuuuucuagcauauccauaugcuauauaugcucccugccuguuaaugacuuaguagcugucuugguuaucagaucaacucucaugguauugcauugcuugcauucaaguaacccuuguuuuacucucaccccaaaguuugagaguagugaugccggcaaucugaauaugccagagaaguaagucauaaagugcuuccucuaagugaaaagguaaaaggucuuaauaaggaaagaaaaaaaaucauaugcugaaguuacuaaaaucugugguaagaacaaaucuauccaugaaauugugaacaguauauuguuauaguuuaucuuauuauuaguuauuaaucuuucugugccugauuuauaaacauuauaggucuguauguauaggaagaaacauaguguauaggguuugauauuaucugcaguuucaggcauccacugggggucuuggcacauaucucccucagauaaaggagauauuguaguggucaaauugcuuuuucaguugcugugguagauuaucuucauuugggaucuacuuaggaaaucuucauuauugauauaccucucauuuugauuguccaaguuguuuguuuuguaaaaauaaaauacaguucuuauuuauugaacaccuguggcacauaugggauaugagcauuguguucaagacaaugauauauuuuauguuaugcagauuuuaccauaguaaaaauauauagaugguguauagaauaacagaaauugaaauuggugugccaucuuuugaagagagguuagcaaaugagaaaggcuguaugcaaguuuuccaggugucggugcuuuuuaaaaauccccuucaguguagauaggacauaggcuagugcuaguggaaaagcauaggcagccuacuuugacacuccugaaauuuucauuuauaugucaaaaaggacguggaaccagguggaagggaaagugugguuuuauuuucauuuuguuuccuucccuuaauggugguaagaucaucaauuuauuuauuuuacagacaccucuuuucagaagaguauuugaagugaguaaacauaguuuucugucugcccucuuuaccuuuucuccuuauucucucagacacgcuuaagugucugucuugaagugaucauucauauggcuguuguaacuggaagaauacagggaagcuucuuggcugcauuucaggaauauguaaagcacugaaaccuuuuagacugacuuucucuuuagugcggaauagucugauugugugugcaggcaggaaguacaggcugucauaguucucaugcauggguacccugaugauugagguaggacagaccugugcuuuaaccauucauuagacagaguugugucuguguagaaguauguagaaguauuuuaaauaauuggaugaguagcguuucaugccuuugauauuauuuauaacuagucacauaauuuacauaucuccauuuuaguaaauauuucaccucugccaguuuccaaguuggaauuggaguggggauuauucggagaaauuacugaaagcuuuugguaaauuacuaccacaugucaggaaaaaaaugcagaauuaccauuauugcauuuguauauguaauucuuuuuaaagacuuggcuacuuugauacugaaugcugaaaguaaaaucagccuaccauaggggagauaaggugagagacaaaagugugcauuuucucuucagaauuacggaguuagugggguguaggagggaggauaaagaugugaaaaaaugugauauaguuguuauuagaaaacauguauuuuuucagaaaugcaggacugaaauucuagcacuuuuuuuuagccacaggcagguccuagguaauaaaggccgaaagucucaaacuaacuaaugauucgaggugguaaauagggcuuuaagaccuaauuugcuaagaaguuaucuuuuaaaaauuauucagaucugacuaaaauaugaacucgggcugucuguaaauagaaaauuaugaacaagaaauaaugaagcuggaugcuauguuaguuaacucaguuauucuuuugaauagcaguaguuguuauuaguuuguuguauuuuuguaaauaagaaauagugcauuugaauuuuuucaguguugaaugaguuuuaccuguccugaauuuuccagcaguuauuugucuaguauaguaccuggcacccuuaaguuauucgauaaauauuugcuuaauguuuuuugaaugaaagaagcucaauccuccuaaguaauauuauuuaauaguuaucauaaaaaguagggucuuauuuagcccuacauuauucuuguaguagaacuagauauaaaaucuuaauuugcuaauuuuuccauuucuggacacuagcucaacucuuuagucauaaucuguucuuuggaauagaugaaauauuuuauauuuaauucuaggagagaucaguguauauuguuuuagguaauaaacugugguuuucacuuuaauacaggaaaaacagauaaacugagauuaacagauacaucauucugguuuuauauaaaggacuaaagagugccuuccuuuuaucuaaagagcuauugcaaauguaaacucguuuacuaauuugcaagauagcaucagaauuagaagaaauacgguuuaaaaauaaugaacuuuuaggggucaaagguucaccuaaauguccguaaauacaaguacuagauguaaugauuuugauuuagacaagaauaggucauuuuauuaggucaugcucauauaaacuucucuuagccucuggcuauauaacucauccaucccuggucuuaccuauagguggauaaaacaaaacaguaggaagauucugucacacuagauucauggagccucuaaacaguucucaucaugaagcauaagauuugugauuuugacagcuugcagugagaccugugcuuauguucuguauuuucugucacagggagaagaagaguuugauaugccucagccuccacauggccaugucuuacaucgucacaugagaacaauccgggaaguacgcacacuugucacucgugucauuacagauguguauuauguggauggaacagaaguagaaagaaaaguaacugagguaauacauacucugagucuguguggcaaauuucuuucuuucuuuuuuuuuuuuuuuuggagacagggucuuacuuuguuaccuaggcuggaaugcaguugcgugauuuuguuucacugcagccucugccucccaggcucaagugauccuucugccucagccucccuugcaguugguucuacaggcaugaaccaccaagccuggcuaauuuuguuuauuuuuuggauggacaaggucccacuguguugcccaggcugaucuugaacuccuaggcuuaagugauccuucugcuuuggccucccaaagugcugggauuacaggcaugagcuauugucccugaccccacauuucuuucuauagaaaaauucucuugacuuucuaccccaucccgcuuuccugugcaacacuuuguuuuucuucaucuuuuuauuaccagagauagaagaacaggguuagaaguuagacuuccugcuuucuaaagcuuuccccagccauagguuugcuguuugaccauugguuaguuauuuaaugcaucccaucaugcuuuccuuuucuguaaagaacagacugauaaaucucucucauguauaaagauuguauguauuauuuuaaauccuuagaaacucaaauggaguuuagaacacuccguuucaaacuaccuguguuuucucacauauuuucaugucuacucauucuguucuuuauuugucacuaucuguguguggucauagaccuguugguaagaaaugcaccuuuauuuuuuagugggauucauuauagacucauuacaaaugucagcucaguauuggcauuuagugacuguuuguuaucuugaauggcauacuaugcugacuuuguuuacaucuaauaaugagagagauuagacagauuuucuagaauuaaagaucugggaccuuuguugguauauguuaagaucugggaaccauuuuauugguugguaagaggcacagcuauuuucuuuuuuuuuuuuuuuuuuugaggcagagucuugcucuguugcccaggcuagagugcaguggugcaaucucagcucacugcaaccuccgccuuccugguucaagugauuuuccuggcucggccucccaagucgcugggauugcaggcacccgccaccgugccuggcuaauuuuuuuuuuuuuuuguauuucuaguagagacgggguuucaccaucuuggccaggcuggucuugaacuccugaccuugugcucaggccucggccucccaaagugcugggauuggaggugugagccaccgcgcccggcaaggcacaacuguuuucuuccuuuacccagauacuuuccuuuaauucuaucugcuggccguguaggagguuguacucagggagaguuaaacucuaguguauaguuuuauuaaauagaacauauuauuacuauuuuucagugggcuauuguggcccucaugucagauaacauuugauguuaguuugaggaauuguuguuuguuuuacuauccacagauuauucagauuucauugguuuuacagacacucauugaguaauuguuuuuuauuccuuuuuuuuuuuuuuuuuuuuugacacagagucucacucuguugcccagguuggagugcaguggccugaucuuggccuucuggagccucugucuccuggguucaagcgauucuccugccucagccuccugaguagcugggauuauaggugugugccaccaugcccagcuaauuuuuguguuuguaguagagaugggauuucaccauguuggccaggcuggucucaaacuccugaucucaagugaucugccuuggccucccaaagugcugggauuacaggcgugagccacugcgcccggccuguuuuuuauucuuuguguauaccaaauaccagaaauaauucuuuuaaaauacugcuuuaucuucauuuuaaaaauauuuuuuguuuuuuuuuuuuugagacggagucucgcucuuuggcccaggcuggggugcaguggcgcuaccucggcucacugcaagcuccgccuccuggguucacgccauucuccugccucagccucccaaguagcugggacuacaggugcccgccaccgcgcccggcuaauuuuuuguauuuuuaguagagacaggguuucaccguguuagccaggauggucucgaucuccugaccucgugauccgccugccucagccucccgauuaaaaauguuuuaaaaagauuuuuguucguggaacuuuuuucauguuauuacuauuuuggagaaauuaugaaaagcaguuugccuucaugaaaauuuuuguaacuguuguaguccacauuaaacucugugccuaguacacuacauuaaguguuaaacacauuacuucauuucuuaaaauauauuuuuuauuuuuauguuuggagacagggucucgcucuuuugcccaggcuggagugcagugguaugaucacagcucacugcagccuugaccuccuggcucaagggagccucccaccucagccuucugaguagcugggaccauaggcacacgcuaccacaucugcuaauuuuuguaucuuuuguagagaugggguuucacuguguugcccagacuggucuugaacucuguucucaagugaucuuccugccuuggccucccaaggcaaugggauuacaggcaugagcuacugugcugcuaggcccauuuaguauuuuauauggugcuuucuaaaguauauuucuggaaacagcaggccucuuagacaguuugauggagggaaaagguuccaugguccugagaaacaugaaacgcucucuuagucuguuuucuguugcuauauuuaaacaccugagacuggauaauuuauaaauaaaagaaauuuauuucuuagucuaggaggcugggaaguccaaggucaaggggcuacaucuggugagggccuucuugcuggaggggacucugaagagucccgaggcaacacaggguaucacauugccaggggccuuacaaaagagaaccaaauuaguuuuuauaacagacccacucuggugauaacuaacccacuccugugauaacucauuaaucuguuagcucguaauuccguuaauccaugaaugaacuaauccauucaugagggcagagcccuuaugacucaaucaccucuuaaaggucuuacuucuugguacuguuacauuggguauuaaauuucaacauguguuuuggaggggcagacguucaaaccauagcacgccauuaaucccuguccccacuaacaugaaaauucacauauuaccauauuaaaaguucuaagaaguccucuaguaaggauaccuauuuuauucuguuuaacccagcacuucccaaacuuacaugaccauuagcauuuuuuaaaguaauaccuguuuuuucccuauggaagauaguuugggaagcacuacuaaacuuaaauaaugauagugacuagcguuuauugagcacauacuaugugccaggcauuauucuaagcacuuuagugaauuauuuaauucuuaacaacuauucugugauagauccaguuauuauucucauuuugcagaugugaaaacacaaguguaucuaguuaaaauaggccacugagaaugaugacagaaguaggaauggggaagguagagagguuaugaagcuaaggucuucaugcaugagagagggugauuuggagaauguuaguggauaacaacuagggaaggggugaagauaguuuuaagaaaguggcaaauagugguuuugaaggagaggagguggggaaauagaaauggucuguaaauggcaguggggagcaaggagguaucucaucucaaaauucuugaauggagguucggcugaaagaaaccagucucugcuagaaagagcuguaggagaugugagaugcacuggggauaucuaggauuuauucauugaaggcagagaaauggagggaagaucacagauuguuuuggaucuguugaauuucagguguuugugguaaauccaaggggaagacuaguagaaauuuguauaagcugagucaucauuguauucuugguagcgagguaaggaugaguguggugagacugaccagggaaagcaugugagagugagaaaaggaauaaaaacagaguccugggaaauaccgauuuuaaaggaacacacagagaaagaggaacccaaagaagcauaaauagaaguagccaaaaagguagacugaaagaaagagaaaaguacuuuuauggauuuuaaaggaggagagauuuucaagaagggagggaucagagauaauuauuucaucauuuuauaguauuaucuaaauguauauguaugugugucauuauauacagucuccccauggggauuuuuuuuuuuuuuugagguggagucucacucuguuguccaggcuggagugcaguggcacaaucuuagcucacugcagcuccaucucccagguucacaugugauucuucugccucagcuuuucgaguaccugggaguacaggagugcaccaccaugcccggcuauuuuuuuuguguuaguagagacgggguuucaccaugauggccagacuggucuugaacuccugaccucaagugauccaccugccucugccucccaaagugcugggauuacaggcgugagccaccaugccuggccucccaaaaggaauucuaaacucuuugagggaaggaucuaucuuauacaucuccauauccucucuggcaauuaacauaauauugcgugaacauucuagacuaggaaggcagaugugucauacucaugcuauaauuucucuaugcugugcccauagcgaacauugcugauuggucuuagaaucuuuucccacuaagucugggauuuagccuccagaaggcuucuuaaaacugagcaccaggcagcuacuaccaauuuaucaaaguaggcauccgagauaaagccaguuugacuuucuuguagucuauagauacuuauaaccuuuuuguccuucauuuuuccaaaugguaauacuauuuuagccuuuuuuguuguuguuguuguugagacagggucucaugcuauuaccuaggcuggaguacaguggcaugaucccggcucacugcagccuugacuuccaagcucaagugauccucccaccucagccucccaaguagcugggacuacaggugugcacucccacgccuggcuaauaguuuuauuuucauauggagaccuguucucacuauguugccuaagguggucucaagcuccuggacucaagcaguccuucugccuuggccucccaaagugcugggauuacaggcgugagccaccacaccugaccccuuuuagccuauuuuugcauauacuuuucuauugccuugaucaguuauugaaagguaauguaaaauaaccaaugucaaaacauguaaugcuguccacuguuaaugaaguaccuagaagggcuccugaccacucauuuucuccucucaccugccuaccuccuucccugucuucucucagauaagaauuuacuucugucgucuagguuagaaucuuugcugguagccagagguugugaacuuauccaauaaaaagauaaacucuuucuuaccaauauaguaccauguuuauuuuauauuuuauugagauacaguauagucccauuagaaugaacaauucuucucagaaucaccugggggagaaaaaaaaaagaacagauccuaaauguucaguucaguggcuuuugaaaauuuuaucuaaccacuacucaaaacagauacagaacauucccauuauuccagaaagucuccugauucucaccuuuuugaauuauaauuuugugccaucuguaggauuuuccaaccaucauauuagcauuguguuauuauggcaucuuuuaucuucuguaucuauuuuuuccuugcaggagacugaagagccaauuguagagugucaggagugugaaacugaaguuuccccuucacagacugggggcuccucaggugaccugggggauaucagcuccuucuccuccaaggcauccagcuuacaccgcacaucaagugggacaagucucucagcuaugcacagcaguggaagcucagggaaaggagccggaccacucagagggaaaaccagcgggacagaacccgcagauuuugccuuacccagcucccgaggaggcccaggaaaacugaggugcagacagggucuccagagagagagagccacagcaggggcaggguugcugacauuuuaauaucacaggaaaaggggaguaaugggaaaucccccauccuccauuaaagauaaaucaacuaccccucuucacuauuugcucucuuccuguuuuggguuugugugggaaguaggguggagcccuguggcagguagacuucauuggcaaagcagccccugagaaaauguagguaacaggggaggggacuuucgggaauuuaucaucuggugggcacugcuucuaccacagccuuuauaugauuuaguugggaguacaggaaguuugggauaguagcccaaacuuaaugcaucuccuagcuuuuuguuauucuuugcagguguccagagccuaaaguagaggagaaggcauagcagaaauugggugugcuguuuuugcagcagcaguaggaagcuuugucagagggaauagacuuacaugaaggagaauguccuuuacuuguuaucccacgcuccccacucccugcaugagauuuugguggugggugugugaaccagcuuccugcugccccaaaggcucagcacauguaggccugucauguagucugagggccaaggggagacuuugugaagaaaagauucaguagcaggugcuaucagacuaacuugucuucauucucuaguccuagaaaaggggucagucagacagggacgccagugugugaggaggauggugaugcaggccuuggcaucagacagggagggaaggcuccagucacgccucgugggcgugggcgaaggggccgcccaccuucucggaccacuggaaccagguaccuggguaguguaagauauacuuagucuguuguucagaaaacaagggaauggaggagaggggaguagagaguuuguggggugucaggagggagaagaggggccauacugacuggggagugggcagggaucagagugaggccacagagagaccaggcucaugccugugaugggguuuuuaaagaaugggcugaggagacccauggacaaaggaguggaaaaauugguagauauauacuucuguguucuuguucucaccggcuucuccuauccccuaucucucuuuagagaaacagcugugccuggccccuugggcauagaggacauuucaccuaacuugucaccagaugauaaauccuucagccgugucgugccccgagugccagacuccaccagacgaacagaugugggugcuggugcuuugcgucguagugacucuccagaaauuccuuuccaggcugcugcuggcccuucugauggcuuagaugccuccucuccaggaaauagcuuuguagggcuccguguuguagccaaguggucauccaauggcuacuuuuacucugggaaaaucacacgagaugucggagcugggaaguauaaauugcucuuugaugauggguacgaaugugauguguugggcaaagacauucuguuaugugaccccaucccgcuggacacugaagugacggcccucucggaggaugaguauuucagugcagguaaugaaagaagcagaguuuguagagauuuuuuugugccuuggggcaauaauacucuguuauguuaguaguuaccaagacauuacuugguacuuuuccagugucucuaaagucagaaauuucauuccuacaaaauugguuacucuugccacugacuuuucuguuuguucauuuguuuuugaauaaacuuauuuuggaauauuuuagaugauuuacagaaaauuugcgaaguacaaaguacugcuaguacagagaguuccuguauaccccucauccagcuuucccuauuguugacaucugguguuaguaugggacguuugucaaaacuaaaaauccaaccuugguguauuacuauucacaaaacuuuagacuuuauuuggauuucacuagcuuuuccaucauguccuuuuucucuuccagcauccaacauugcauuuagucaucacauacccuuuggucugcucugauuuguggcaauuucucagucuuuuguuuuucaugaccuugacaguuuuggggaguccuggucagguauuuuguggaaugucccuccauuuggauuugucuaauauuuucucauuagacuggaguuaugggauauuuuaaaaauaaugccacauagaugggugggugugguagcucaugccuguaauuccagcacuuugggaggccaaagcagggggaucacuugaggucaggaguuugagaccaggcugaaacauagugagacccugucucucaaaaaaaaaaaaaaaaaaaaaaaaaaaaggaacauaaauuagcugggcaugggggcacaugcuuguugucguagcuacucaggaggaugaggcaggcggauugcuuaagcucaggaguuugaguccacagugagcuaugaucaugacacugcacuccagccugggaaacagugagacccugucucuuaaaaaaaaauaugccacagaggugaaaugcccuucucauguuaucauauaaggaccugggaagguuugugauguauccacaugacaucacugaugcaggauguuaaucuucaucacugguuaagguuguauuugccagauuucuucacuuuuuuuugaaacagucucacucacucuguuucccaggcuagagugcaguggcgcaaucuaggcucacugcaaccucuagcuuccggguacaagugagucuccugccucagucuccugaguagcuaggauuacaggugugccccaccagacccggcuaauuuuuguauuuuuaguggggauggcauuucgccauauuggccaggcuggucucaaacuccugagcucaggugaucuaccugccuuggccucccaaaaugcuggguuugcaggcgugagccacugcaagagagggacagguggccuucucuaaaguuaguguuuuucccuuuccauacucucuucuuuuuuaaagcuuagcuaccugcuuugauuggaacccaguaggugauauugagauauuuuugcuuagggagaaguuuuuagugcugugucuguaugacugcacaucuaccacuuauucucugguuugaagaacagugccuuuuuauuuuugaaguagguaauauuggugauagugagagguuuaugcuugugguuaugcuuguuguuauuguuucaugugcuaguucuuugaauauauugucuccuuucuauggaaauaauuugaagauaccuauuuguguugaguuugucauuuaaaaacaucuuucugaggacuuuuugaacauggauuggcauauaaugggggaaaauggcuuucuuucuaucuuuuuuuuuuuuuuugagacacaguuucacucugccuccuagacuggagugcagugaguggcgugaucuuggcucacugcaaccucugccuccuggguucaaguguuucucgugccucagccucccgaguagcuggguuuacaggcacgcaccaccacaccuggcuaauuuuuuuuuguguuuuucguagagaugggguuucgccacauuggccaggcuggucucgaacucccaaccucaacuuaucugccugccucagccucccaaagugcugggauuacagacgugagccaccaugcccagccaaaaaauggauuuuuuuuuuuuuuuuuuuuuuuuuaaaaacagagccuugcucugucgcccaggcuggagugcaauggcacgaucuuggcucacugcaaccuccgccucugguguucaagugauucucuugccucagccucccaaguagcugggauuacaggugcaugccacaacaccugguuaaucuuuguauuuuuaguagagacagggcuuugccaucuuggucaggcuggucuugaauuccugaccucaagccauccacccgccccagccucccaaagugcugggauuacaguagugagccacugcucccggcuggaaaaauggcuuucuguuggaguccauccaggcuucucuuguauuuggaauccucugaguaauuguuguuugcccuuuguucauuauuaaaugggccacuucaccuucuaguucuggauaacauuguuagcuauauaugggaucaguugggaguagcacauggauuggggucuuuuauugugacucauaguuuguauguaucaaaugcauucguucuucuuucagguguaaagcuacucuuagggguucauauuuggccuuuuaaagacggaguucuguaacaagagugaacuguggcaucaagguguggggauucugugucccauuucuugaggcuguuugcucaugucaacacuagacuacuucuaguucuaguagcucuucauuagugugaaguauauuguuggccuugggcuucuuuguguuuuugagggagucuuugugacuuaguuuggggauagagauuuaagcuaggagaugaacaaguaagggaaaagggagugauuccacaggauagauagagaaccaaggcuugcuuucucuguguuauuuuccuugggugggguaggcucuggguuucuuuuagcucuucauucaagcauaggcuaaugggugagaagaaauuggacccuucuguuuauaggaaugaaaaaauauucauaguaaugccuuguuuuuguauuguauauguguguggggguggggggguguguaucuauagcuauaguauguguguguguuguaaauuguuuauucauugauaggaagaaguguucuuuuucacaggcuuaguaauggguccugcccaagaucacacagcuugguggcagcagaauuaggccuaggcucaguucuccugaauuauagcuuaguuuccuuuuacaucccacauuuuguuccuuuuaacauaaaggccuuaucagguuuugaaucagagcaggaaaguagauaauagagaggaagauuagguaggagaggcaggaucuguuuuuuccuuucuuugcucucuaauuuugcuacacacacagagagaaaacacacacaugcugucucucuuagaaugaugucauuuuucaccuacagcuuaacucaagacuuacuacucagccucccagggaaccaagaaggaaauguuuagaaguuauaauggaauuguuaggaaaccacaugccauuucacuucacggaaaucauuugaaccaccagcaauccacaauggcugucuuugggaagcuuuauuuuauaacuaaaggcuaccuucugucaagaaacuuuccuuguccuaaucccaguguaguagcuacauauauccuaaguguuacuguuugggauugacaacuggaauuuuguuaaguccuaacuucaguccacuguuggaucucuaaauucccuaacucaggccugcuuuacagagcccuugugagagggugcuaaggagccuaagacaacagcaagcuucuuuuaugcuuuccaccccccaggaguggugaaaggacauaggaaggagucuggggaacuguacuacagcauugaaaaagaaggccaaagaaagugguauaagcgaauggcugucauccuguccuuggagcaaggaaacagacugagagagcaguaugggcuuggccccuaugaagcaguaacaccucuuacaaaggcagcagauaucagcuuagguaagacuuuugcuuccugaacagcugcuuuugggcuccuguucugcuuacagugggaggagauucuggaccugucaguaauguuucccuaacuuuuauuauuccuauguguggcuucucagaugguggaugagcugucauuuucuagagcugcugccuuaccuguuuccuucuuaguaccaaacagaaaguccuuaggguuuuucuggccuccucaguucuauaggggacuaaacacauuucagucauggcaaagacuagauaaaaaauauggccuuaaaaagaagcuucuuggccucaugggaagugggggaaggaacacuguggugucugaaucagggucugcccaguuucuuggaguucagggccucauaccauagaguuugaccaaccuguuuggcuuauccugccauagacaauuugguggaagggaagcggaaacggcgcaguaacgucagcuccccagccaccccuacugccuccaguagcagcagcacaaccccuacccgaaagaucacagaaaguccucgugccuccaugggaguucucucaggcaaaagaaaacuuaucacuucugaagaggaacgguccccugccaagcgaggucgcaagucugccacaguaaaaccugguaagugcuccuuuuugccucauucuuccuucagaccauggcagaaugcagggucagcugcuggaaaaauggagcuuaauauguggcaguggcccuucuguccugcuauaaagucgggguccugcccaagcccacaggugauauucagggacagcucacuguaucccuccucccccauccccuacagacucuagugcggguagauagcaaggccagaauuagcugagugugguggcgggcgccuguaauaccagcuacuggggaggcugaggugggagaaucgcuugaacccaggaaggcggagguugcagugagccgaaauugcaccauugcacuccagccugggcaacaagagugaaacuuggucuccagaaaaaaaaaaaaaaaaaaagaaggccaggacuugaucacaccauucuuugacuacuguguggguucuaggagggaaaggagaaguauugaaauguaagcagauucaaaauagguguaauuucucuuugccugcaccaucuucuuccuggaaauucugcuccccucucucuugugcuuaggcccucuagcuuucucagacuuccuauugaaacauggcugggcaugguggcucacaccuguagucccagcacuuugggaggccgagguugggggaucacuugaggucaggaguucaagaccagccuggccaaccuggcaaaaccccaucucuacuaaaaauacaaaaaaaguagcuaugagugguggcacaugccuguagucccagcuucuccggaggcugaggcaguagaaucauuugaaccugggaggcagagguugcagugagccgagaucacgccacggcacuccauccugggugacagagugagacuccaucaaaaaaaaaaaaagucauauuucaguaugcucuucccucuccccauuauccccgaaacaaccccuuuccagucccuagcauucaauaauuaagaaaggaguucauuccaucuguuguucauugagucccuacugugacccaggcccagcugcuauggguucaggagauuacagagguaaaaucagucuauucccuuuuggaacuuucucaggcuagcaaacugaugaaacuccauugauuguuacauuguccuggcaccagagcuucuuuuguuuccuauguauuugaauugugucaucuccuuaucuacccaacugcugcuguguuucaggguauuuaaaaacaauaguucauugaauauuuacuguaugaggcauagcacucaguacuucacacauaauaccucacauacaauccuuaugaaguauaggugcuagaaggaguuuuccaguugaagacuuugaggcacagaaaaguuggcuaacuuucccaagaugacaaaguaagccaggauucaaacuuugguggucuucacuucuaauuccagccucguucauauaacgucauauugccucugagacuguuuucuugcuccugguuuuauuuuagggaggcaugcaugaccugucugucaucuuagccuccuaaugaaccuacgauucagcuucuccaggucagguaucuguuuuuuuucucaaggacuuauugggggcacucuuggcauggguguucuggcuggcugguucacuuacuuacccagguguugaaaacuaauucaguugaggcaggcuauuuugauguggcaccaucuauguguaaaaacacuuuauuaccaaguauucucugcaccauucuggugacggucagugauggggugggaggaucuaucuacaaggggcauuucuugauaauaaaaaaguguuggguuuuuuuuuuuuuccaaaggcugcuucaaaauaucucauacccugggggaaaucagagcacgggacagagaaagugggcugaagauuuccaaacauuuuucacucucaccuacuauuucuuuguauuagaaccaccucuuucuucagaugaccucagaaguauuugguguggcuauaugaaaacaauacuugguuaauuuucauuuaugaaaacacuguauacauuaucaugacuguguaaaauuuaaauauguaaauuucucuuuguuguaaauuuuauccuaggcugucggccauuuagaaugguuggccauuggaauggucuuugguuucuggcucagauaaguucaucaggacagugccugcccaucaggucaugcuuggugcuggggccuuuugguguuaaggcuuuugcugaggcaaugguguguaucccucuaguaacugugccccuguccuucccaggugcaguaggggcaggagaguuugugagccccugugagaguggagacaacaccggugaacccucugcccuggaagagcagagagggccuuugccucucaacaagaccuuguuucugggcuacgcauuucuccuuaccauggccacaaccagugacaaguuggccagccgcuccaaacugccagaugguccuacaggaagcagugaagaagaggaggguaaggccuuaggaagcccugggagcucugacacauaggcacuucuuucuuuuccagucacuuaugagcugguggucccccuguuguauguagaggaggcaaggcaaguagcaacugggaucuuggucacagaaauuacucuguauccugcuuuuuaacaguuucuagacuguuuucacaaaauuccucucagugagugguuccugaaaacaauccugugaggcagaugggagauagaucuuaucuauuuuauggaugaggaaacaaguuuggagagguuaaagguuaaauaauuguguuuuuuuuguccacaauaaugacaaaccugugacuagagcucugucauuuuagccuacugcaaccauccaagucaaucaggucugaaugcccugccaucuuccccauuugcguucuaugggcaucugcuagagcaaacccauguggaggguaagguucauucuccugaggucuaagacugggacuguggggugccugguuccucagggugauugcaaagaaacagcuucuaggccuuuucaacucuuauaccucucuuuaaccuuaaauuaaaucuguacauugcauuuauuucuguguugucuguuaguuuuugaaggaaggcugcaguggguagaggucugaaaaaugagugaucuaggagagggaaugagcagauauaaauguauacacuguaaaugugacugacagcaguaucugaaugugucuguaaaggcuaaagguccagauggaaugauguuguacaaguuagaguucugacuaauguugucuugcaagagggaauugaauuaggcaacaugguugucauaauuugcaccacuggacaucugugaggguuggcauuucagguguguggaugacucuuuccuaauuaaccaaaacuauaucucaccgacugcagccauguguagauauguacaaggacauggaagggaugaucaggggcaggcuuugguuugggagaguugggcugugggagugaguagaugugguguggugggauuucaagguccaguguuugcaacaccuagcuugucaaacaaucagauaggcacagugggaauaagguauuugaagaguuuccuggacaggaaaauugggagucuuuugaggauucugcauagaggugugucauggcauuaaaacaguggucauggucauggguuuuuuuuucccccuuuuacaauauugcuggacuugaaaccaggacuucacaaggcagcuguauagauguuuuguuuguugcuugguucagcauagucaagaaagcugacugguaugagaugcaggcuguccaguuucauuaaaauccgugugccugcgugagauguaauaaaacuguacucauaaaaauaaaaugaggcauuuggacaguguuuuugaagggaucuucagguuucugauagacagugugguuauggugaaugugucuuuauguuggugccuucauccuugggcgcagcccaacaguaccagaauccuugauauuuucaguguaugagaaugcuuggggguuucucaaucucaagaaggcggaagacaucuaauacuaaaacaauccucuacagaauuauaguuuuuaagaaacuguuugguagauguuacagauaaauaggaauucuuagacaccagcuuacaacaggagcucaguaaaauauuuaaauucaucuuaugagauauauuuauuaauaaguuugguaccuaaucuuguuggguggcacaccaucagagauccuucagacacagggauugacccuggaguuggguuuauuuaguaccuucauacuugauuuagauggcacgauuaacaaccuauucauuuuagcaucuggcugggcagggcacuuauaccucaaaaaugaagaaauuggaacccagacuauuugagaaaaauuagagaaacacacugccuagacaggguaauacuucauuagacaaauuaaggaaauauaauuagggauuaaaaucuaaguagaccaguccuggauuaagcagacauaaaguagaagucuugagaaaaauacaggacuguaagggguguuggcagugacucagcaguagaaucuuggugcugaagauugugacaugcuauauugagauagcaaaagggugcuaugacaaagcugagaaauagcccugcuguauucugaguuucuuauaaccauuuagaguuucuguuuugggauuucaauuugagaagaauguggagaaugcugaaucaagaaaagagcaguaaaagugaauagguuggcuagucagaacuaaguggagauggagaccccugaccuggggccucggcggugccugagcuccuccagcagacaacgagggcacugaagggggagccgucauaagggaucugcucuaaguuuuacuacugggugugaaggggaaggggagugguaccggcauugaaccuuaugcacuggauuggguuggguuuuaaaauuugugauaaaaauuucaguuaauuagaacuuaauuucccaaaacuccuaauuaacuaaaaucucuaaugucuugcuuuucuuuucuuuuuuuuuuuaauguguuauuuauauaugagaggagcagaugacaagaaaacaagcucaaauuagauauuuggucaaaagaagcaauuucuaauugccuagggucauuacagcuucagccucaucucucauaucuucuacuucacucucaagacuauagagcagucauugguguucaguguccugagguacuucaagaucaucaaagguagauaguuuucaauaaaaagguugaaacaggauuuucuaaccuucacuuaaucaguuaaaauuuuaaaaccauauuucauugagcauucugguuuauuaaaguuuuaguuguacaaggggguaaaaaggcugaugcagugguuuauaauaaacccuucauauauaacuuauaaaguguucaucagcuauucaucuccacagaaggcagaacuagaggaaaugggguuuaguuuucaacaggaaagauuuaggauagacacaaagggaacuuccugaugguaaggguuauucaaguuggaauaugucacugugggaaaugauuguguucccaucccuaucaacgguccggugcaggaaccuuugauguuuuuaggucuaggaccuaccuccaguccucaucuucccauucccuccuacucuugucccuucuuuuggcagcauuuuaaaggccucaagaucucuuucugacccauggggaagcccuuggccugucuuuggggacacacuguuguggauagcuggggaguggaaaagggggcaguaagaaggaggcauaagguagcaaauaagaaaaccacucaguaauuauuaucuugguuuuuuuuuuuaauauagaauuuuuggaaauuccuccuuucaacaagcaguauacagaaucccagcuucgagcaggagcuggcuauauccuugaagauuucaaugaagcccaggugaggaguuucuuuguguaaccuaauauaguggcaaugauaagagccaacuugcuguguugagaagaggccugggagggguuggggaaccuggauaaaguagccagagauuucaggaacugagaaacugccaaaauguuuuugcaugaaauagaauuuuuguuguguauagggaagagaagguaggaccuuggguuaguuaauggcuaugguucuguugcugggacaaaagaagauugauguuuauguuuaguaguagaaaccccuauuaggguugcugauuuuuagccugaaaggcugaguucauagguuuugguuguccguugaggauuuagguccucaguaugcugcaggugaggcagagagaacaucuauggaaauuacuugggccuuccagugagaagaguggccuugggcaggauagacuaaaucacauuuuggguaguaguugggagucuucagaucugcucuucauggcucauuauggcugcugcuuaggagcuuuccacagaagucaccaaacccauuggcucugcuucuuuucuugcaguguaacacagcuuaccagugucuucuaauugcggaucagcauugucgaacccggaaguacuuccugugccuugccagugggauuccuugugugucucaugucuggguccaugauaguugccaugccaaccagcuccagaacuaccguaauuaucuguugccagcuggguacagccuugaggagcaaagaauucuggacugguaaguauuugaagcccauccagaauuguauaggcaggaggacagcaagcuuuggagggaagagaaucuaggugagagaguaaagcuuucuagaaauuggaaugucugugggauaaauuugaguggguuugaaaugacuucaggaguuuaucuaguuuauuucccuagguuacauuggcuaggaaccuuuugcaaaugugugaagauuuguauauagguucaauauucucaaccuguaaagucagagaacuaaguuuuaagcaagcauuaaaaauauauaggcucaggagcaugauuuggauuauucucagccccagaacaaacauggaaauuagaaagccaggaaugcaaggaauacagaucauucauagaaagaaggaagagaagggggacccuaauauagggcuuaguuuuuuaagaugaagucuugcucugucaccuaggcuggaguacaguggcgcagugacgacuuacugcagccucaaccucccaggcugaagugaucccccuaccucagccucccaagcugcugggacuacaggcacucgccaccacacccagcuaauuuuuuuguugucuuuuguagagauggggucucaccacauugcccaggcuggucucgaacucccaggcccaagagauccaaccacgacagccucccaaagugcugggauuacaggcuugagacacuaugucugauggggcauuuauuuuugaaagcauucagauguacaugagucccuuugcagaaaggcaguuuguuggauauuacuugucaugcuaagguccuuuccugucuccuucauaggcaaccccgugaaaauccuuuccagaaucugaagguacucuugguaucagaccaacagcagaacuuccuggagcucuggucugagauccucaugacugguggugcagccucugugaagcagcaccauucaagugcccauaacaaagguaccugaaagaguguguguagugucuuuguuccagggaucuccuuagaccuguagguguuaggccuugugguccaaggcucaggccuaauagguugaccguauccauguuucuuagagaagaaaaguaccaccuucaagaggugagucaacauaagugaagcacuggacguauauuuguuaaauauuucuacaaggucagcacauagugauuauaacucugccuuuggucaugaucaguagcaguguguuugacauaauagggcuuugguuugugcagagugggauguauugguuagaaucaaaucucucuuucuaauggagggcuaaguugaguguccuuuccuucuucacuuucccuugcuccuugcagauauugcuuuagggguauuugaugugguggugacggaccccucaugcccagccucggugcugaagugugcugaagcauugcagcugccuguggugucacaagagugggugauccagugccucauuguuggggagagaauuggauucaagcagcauccaaaauauaaacacgauuauguuucucacuaaagauacuuggucuuacugguuuuauucccugcuaucguggagauuguguuuuaaccagguuuuaaaugugucuuguguguaacuggauuccuugcauggaucuuguauauaguuuuauuugcugaacuuuuaugauaaaauaaauguugaaucucuuugguuguaguaa

SEQ ID NO: 191227 - RNA, 26215 nt, Homo sapiens
gccggguuuggggguugggaccuccggcugcagguccgccugggccagacgcgcgagcgcaagcagcggguuaguggucgcgcgcccgaccuccgcagucccagccgagccgcgacccuuccggccguccccaccccaccucgccgccaugcgccuccgccgccuagcgcuguucccggguguggcgcugcuucuugccgcggcccgccucgccgcugccuccgacgugcuagaacucacggacgacaacuucgagagucgcaucuccgacacgggcucugcgggccucaugcucgucgaguucuucgcccccuggugaguccauucugccgaggcgggggaagaaaggcggggcugggccgggggcgagagcgcggggaacuguugggccuacgcagcgccggggcccuucauuccugugggccccugcugcggcgggcacauuucucauucccgggagcuggaggcgccucgccgagagcgggggagucggugcugaucggcccaaggaaaacccgaaggcugcgcucacgcagggccucauccuuaucucggugcucuuguggcacuuccuauuugcagaggguuuugccaccccuucccccaguccaauauguagcuauaucuuuucugcgugagucaguauuaaugcuccuccagucuacagacuaggcaucccaaagccuuguaguggaagcggacguuucaccaaaugcagaaguccuggaucccuaggguauuuccuuucaucuuaccucacgccgcacagccauugguuucuagccaaggucacugaguggcugcagaauggucguaagugcuuucuugaggcagguaauuuguccgucacaugguguacaguuucucccuucagcugaucacuuacaucucaguaccggcagauaccucuguccaaacgaaaggaguacgugaacaagaauaauuccaucagaaucuguccauauugucuguuuuaaauagcauuucuuuaaaaugucaaaaaagacuccaaugagaaaauaaccaauauugauuacauacuccacuuuagggugacuuaagugaucaaggguguaaauuccuuagauagaacuaacucgaaauaaaaaacuguuggggagaaggaagagcaaauaagauuucuggcccagucaacuugaguguuuguuuuuuuuuuuuauuuguguguguguguguuuuuaaaccuccagaucauuaccagaguaaacagugauuccuuuauccuggggauagcucucuauauauaauucaauauauauaauuacaguacuuaauuuuuccccuccuggcacagugacccuugguuuaauacuauccguguucaaaaaugucaguaaaaguuguguauaacuuuuauuugcuucagacucaggucuucccuucuuagccucaaacaacuugcuaaggguuacacgaaaaaaguccuguaguaaagaccaccugaaucagaaugaugugcuagagauggcaaauuuuguuugcagcuuggacagauuuuguguccagggcauuucuggggcuaacuggcaguacagauuacacauauagauaguucuuauacaucucuggaacucauguucucucuuaggaacaacucuucccaauuauauaaucaugcuguuagcuuugagggggugucaauaauuuguaaaaacugggggugucacuaaguuugucagaucugagugaugcuuuuuacuacaggggucaugcaacaauuuaaaguaggaauuguuggagaauagugggccacuagaauauuaguuuaaaaaaggaauuuuggggcugggcaugguggcucccgccuguaaucccagcacuuugggaggccgaggcaggcggaucaccugaggucgggaguucaagaccagucugaccaucauggagaaacccccgucucuacuaaaaauacgaaauuagccgggcauaguggcacaugccuguaaucccagcuacucaggaagcugaggcaggagaauagcuugaacccaggaagcagaggcugcagugagccacgauccugccauugcacuccagccugggcaacaagagcgaaacucugucucaaaaaaaaaaaccagaauuuuuuauuugaauugaaggggguguuuccuacuuuaaauuguuacacgugcuacccuaaaaacuacauaucccaucaggcacugacugucccaagaauuggguggaucucugcuguggugucugcuuuuaauugguuuaaaagaaaaagucauccuccacaauuucagcaagaaagaugaguuuucugaaugagcaauuuggaguuaaagaagucuccuguugaggucuuuauuucuucacauuccacuacauuuuuuuuguguguguguuuguguauuuuuuuuuuuuugagauggagucucgcuuuguugcccaggcuagagugccauggcacuaucuugacucacugcaaccuccgccucuuggguucaagugauuccccugccucagccucccgaguagcugggauuacaggugccugccacaaugcccagcuaauuuuuuuguauuuuuaauagagacaggguuucaccauguuggccaggcuggucucgaacuccugacuucaggugaucugcccaccuuggccucccaaaaugcugggauuacuggcaugagccacugcacccagccuguuuuuuuguuuuuguuuuguuuuguuuuguuuuguuuuugagacagagucuugcucuguuacccaggcuggagugcaguggcauggucugggcucacugcaaccuccgccucccguguucaagugauucuccugccucagccuccugaguagcugggauuacaggcacgcaccaccaagcccggcuaauuuuuguauuuuaguagagacgggguuucaccauguuagccugauggugaacuccugaccucaggagauccacccuccucggccucccaaagugcugggauuacaggcgugcgccaccuagccuggccucuguauuuuuauuuauuaacauuucagcuggaaauguuuucugacugcuauauuccuuuguacaguucaguaguacuaucuuacaagaaacaguuaaaaaauccuuaguaagaguaaaauggggucuggcccuguugugcauuccuguaaucccagcaguuugggaggccaaggcaggcagaucacuugagaucaggaguucagaccagccuggccaacauggggaaaccccaucucuacuaaaaauacaaaaauuagcuggacgugguggcgcacaucuguaaucccagcuauuugggaggcugaguugggaaaaucacuugaacccaggaggcaguggcgagguaagagaccagccugggcagcauggccagaccccaucucuacuaaaaaaugacaaaaauuaaccgggcaugguagcacacgccuguaguccuagcuacucaggaggcugaggugggaggagaagaucacuugagccugggagguggagguugcaggaagcugagauugcaccauugcacuccagccuaaaugacagugugagaccaucucaaaaaagaaaguaaaaugggcuuuuuuuuuuuuaaccuuauucucgucacaaaauagaccuauuuaagcaaauucuuuuuccgcuuucauguuucaagugaaagugaaaggugaaagcuugcuuugcuugcuuuuuuuuuuuuugagacagucucucucuguugccaaggcuggagugcaguggcgcgaucccggcucugcaaccuccgccuccccugucuggcuaauuuuuuuuuuuuuuuuuuuuuuuaaguagagaccagguuucaccauguuggccaggcuggucuugaacuccugacuucaccugaaucaccugcguuggacucccaaagugcugggauuucaggcgugagccaccgugccuggcuuagugaaagcuuucuuugcaguugauuuuguagacuaauauuuccauuauggaguuaaucugcuauauauuuuuaaggauaagaguaucugaauuucucuggggaaauaacacuauuuaaauguuuggaaauguccgaaaauuuauugauuaguguuaauauguaauauuaaguccuuggccgggcacgguggcucacgccuguaaucccagcacuuugggaggucaaggcggguggaucacgaggucaagagaucgagaccauccuggccaacauggugaaaccccgucucuacuaaaaauacaaaaaguuagcugggcgugguagcaggugccuguagucccagcuacucgggaggcugaggcaggagaauggugugaacccaggagguggagcuugcaguaagccaagaucacgccacugcacuccagccugggcgacagcgagacuccuucucaaaaaaaaaaaaaguccucaacaucuauuuaugcuauagauguguaugcuacccucuaagacaguaguaauaaauaauggcugggugcaaaggcucacgccuguaaucccagcacuuugggaggccaaggugggcagaucacgagguucaggaguuugagacuagccuggccaacauggggaaaccuugucucuacuaaaaauacaaaaauuggcuaggcacgguggcaggagccuguaaucccagcuacucaggaggcugaggcaggagaauugcuugaaccugggaggugcagguugcagugagcugagaucaugccacuggacuccagccugagugacagagcaagacuccgucucgaaaaaaaaaaaaaaaauaauauaugugcuaauuucuuuacuuguaauccccaccccgaguugaucuuuucaacaucaacauuuagcucauauuuuuuuuuuccuucccuggacaacuaacugguugauccugccucucuauuggcaucuaauaauacugugucaccccugccagacugguguuccuauaaggaaaggacuauaccaauuuucuuaucaaagacacuugauaaggcacuuaucaaaaaguacuugacgcauggcacacaugaugaagugaugauuaugggugaauauauguuggaauucauuaucaacugccaggugccaucccugaggauagauagaauuaauuguguuuuaauauuuucuaggggugggugaaagaaguagugguuaaucuugaaggauguauguuaaccaacccugauuucccuuaaauaccaccugaguuccauuccugcuggauuugaagaggagagucuccuccagccucauugaaacucuuuuuguggauuugaugaccuuauggauauugccaaaguuuaaggcaguggauuuuagucccagccuugcagcuuacacacacaccugguugcuccccagauuucuggagauucucauucaguaagccaugcauacuuuuguuguuuuaaugcucuguggguauuuuugauaagcaucuagaguugacaccuacuggcuugaccuaguaacuauuguaugugauuuuuuucucuuaaaauguuugaagauaguugaaacaauuaacucauaaaucuguugccucagccuugacaacuacuauauauucaacagaaaucucucaucugucucuucuuuauucucauugcugccauuccgguccaagcuuuuauugucugccaugugaaauauauuaucuucuagauggcuuuacucuugucucuauuuucucccuuucugucagucuuugacauugcugauugacguagucuuaguacacgugcacgcacauuuauuaucucacaaaagcccuuuacaguucucugaaugcaucaugcuuacugguauucuuuuacguuugcucuacuaucucccucaucuuaaauacccugcccucuucucucugaagcguuaaauccuuaaagacccagauccaauuguuacucccuuuaaaauccauuuacuaugcaguauuaaaggaauacagaggauauaaugaauaagacccuauuucacacacauaagauaccacugauugugagaggaacuaucuugugucucacugagaaagaaauacuaccacugaaacuauaacaugacugcaaaauacaucuuaauaucaggaaaaaacaaugaaucugaaauacagcauaaggaauagcauuuguuugcacucagucugaaaaacauagccaguacauuugaaguccccuaugugccccuuuaccaucuuauacacuccuuuaucuugaauuugguauuuaucauuugguucuuuuauacuuuaauaggccgccugaaggccuuggagaauaagcuguuauaauccuuuauuuuaaacaaguuuuagguguacaauauuuccaaguuauccaucacuugauaaaauuacaccauugacuauugaaauauaucugcucaaguuucuucucuauuauauuucuauuuuugcugucuacgggaagguuacagaacucaccuucucaacgugaucccucugcaacccuuuggcuuuugaaaaggugauguacagcuggugcuagcuguauauacacugauuaggauuuucugggcagaggagccggugcuucugguggcccucugggaaagguauucuaguuuacauguuuuguuaucacuucucauggcuaggugaacuauguagcuguaaaaaucaggccugccaucuaaaagacuuaauaucauacuugagacauuacaggguuucagucacaauuuuguguccccacccccaccccgagacagagucuuauucugucacccaggcuggagugcaguggcgcgaugucagcucacugcaaccuccaccucccagguucaagcaauucuccugccucagccucccgauuagcuuugauuacaggugcccaccaccacgccuggcuaauuuuuguauugucaguagagacgggguuucacuauuuuggccaggcuggucuugaacuccugaccucgagugaucuacucgccuuggccucccaaagugcugggauuacaggugugagcuucagucacuauuuuuaacaaccacaaugcugguuucccagggaauuguauuuuccucuggggaauucuaucagaaaugggauuauuucuauuuuguccuucauucagccucauuaauuggucaaaagggcauuaacccauucaacccucuuuaauaauguggcguacaccuuugacuacagcuuucacaacuuaguuauacuuuguauugagaaaauagagcugcccugugcugagccaguacuauggagucaaccucagucuagggguaggaccuuuaccucuugagaguucugguuuacuuuaacaauaaugaauguuguucaugugaugauuuugcuuuuuggaagugucuacuagcucaaagguaguauuauaguuugagauucuuccuagugagacaacauuaacaaauucauaggacuaaacugagaauuuggcuuuuuuaauacguauauagguguggacacugcaagagacuugcaccugaguaugaagcugcagcuaccagauuaaaaggaauagucccauuagcaaagguaaguacagguggauucuucacuaaaggacgugaaguauuuuaaaaaguaguuuguugucucagcuuuguuacauggaaaaaaauaacaguaauaaauaguuuguaagauuaacauucauuuucucuacucuuauucugcuaagaagagcgaauacuaguuucugggcaaauacacaacugacuuguaguuucaaaagauuaaaaguaguggcugggcgcaauggcucaugccuguaaucccagcacuuugggaggccgagguggguggaucacgaagucaagagauugagaccauccuagccaacacggugaaacccugucucaacuaaaaauacaaaaauuagcugggugugauggcacgugccuguagucccagcuacucaggagacugaggcaggagaauugcuugaacccaggagaugaagguuucagugagccgagaucgggccacugcacuccagccuggugacagagcaagacuccgucucaaaaaaaaaaaaaaaaaaaaauuaaaaguagugagaguaaggaaauuacuggcauaagaaguaaaauagaccagguauggugccucacagcuguaauuccagcacuuugggaugauuacuugaggccaggaguuuguugccugggcaacaaagcaagaccucaucucuacaaaaaauuuaaaaagcuggguguguuggcucacaccuguagucccagcuucucaaaaggcugaagcaggaggauugcuugaggcugcagugacuagacacugcacacuacuagacuccagccuaggugacagaguaagacccugucucuuaaaaaaaaaaaaaaaaguguaaucccaguacuuugggaggccaaggcaaguagaucacuugagaccagccugggcaacauggcaaaauuccaucucuacuaaagauacaggcaggcuuccauagucccagcuacucagaggcugagguggaaggauugcuuaagccagagagguugaggcugcacugagcugugauugaaccauugcacucuagccugggcaauagagcgaaacccugucucaaaaaaaaaaaaaguaguaaaguauaugguaaauaagaauuaaagauggaaagcagaaguacagcuauaaagguuaaaauaaucauugaggcugggcacgguggcucacgccuguaaucccagcacuuugacaggcugaggagggcggaucaccugaggucaagaguucgagacccgccuggccaacauggugaaaccccaucucuacuaaaaaauauaaaaauuagccaugugugguggcaggugccuguaaucccagcuacuuggaaggcugagacaggacaaucgcuugaacccaggggggcggagguugcagugagcugagaucauggcacuguacuccagccugggcgacagagcaagacuccaucucaaaaaauaauaauaaucuacaaguaaaugaguucccuaaacugcuaugugauaaucacaaugaugguaauacgaaaaugauaugaggauauugaugaaaauguaaccaaauggucaacuguaaacuugguauuuguuuuuacaauuaaaguaaugcuuccagaauguugccauucuguaguaaacccauaguuguucuagucuaaaagcucuuaccucugccaaauaguucauauauaaggcuauuuuuggaaauuacuuuuaaucuuaucaagcagcuugccauaggaaaaaaauuuaaucauagccaggcgcuguggcucacgccuguaaucccagcacuuugggaggccaaggcggguggaucuccugaggucuggaguucaagaccagccuggccaacauggugaaaccccgucucuacuaaaaauacaaaaauuagccaggugugguggccggugccugcaaucccagcuacucgggaggcugaggcaggagaauggcuugaaccugugugguagagguugcagugagcugaguucgugccauugcacuccagccugggcaacaagagugaaacuccgucucaaaaaaaaaaaaaaaaauucaaucacaauuccuaccugugugacuauagacacauuaauuaauuuucuggaucuuaguuuacccaucuuagagcauaaggaucauacuucauaaucuuauggagauuaaaugagauaauauaugcaaaguacuugugccuggguuggaguaaguggcucguuccgggaaauuauuuuccuucuuccugauaggucucacuagaucgguuauguuaugguauagcccagauucaaacuaguucaggguacguguacagguguugguaccuuugauaauagcucuagaugauuugcaaaaucaaauuacauuacaccuaaaggauauguaccaccaucgauauauccccuuggugauagucguaaucaaaguaagccacuguuaauaauuuaagugauuuaucccucauguguucugaggcagaaaaaagaugaagaccaccgcuuuagcuaauagagacuacaagggcagaauuuaaacaggaacuuugcauuuuaugugaggccuaggaaucucaauuuuaaagaauuccuuaggcaguucugauguaguuaggcaagcuccagucugccuuuaaaaucuaauguucuguggcauauaugccaagaauuccuugauccccuuaggauuugaccaauccuaguauuuugagaauauaggaagaaccugcagcagaaacuuggauaagaaaauaguuuguguauuuugaucuuuagguugauugcacugccaacacuaacaccuguaauaaauauggagucaguggauauccaacccugaagauauuuagagauggugaagaagcaggugcuuaugauggaccuaggacugcugguaaggauccugaauuacauucuggaaacugauguuaaguaccuuauucuuuguaguggaaacauaaaaauguguuuuucuacacaguauacuuucagucuuaaaacuuccucaucuaagaggucaguuuggugguaacaaaagaccucucuaaaugaacagauuauauaaguaauauagaaaauacacaaacuugauuuauaaggucagcucgacauuuuuucauuuuacaaauauuuauugaguaauuacugugugccagauauucuaaauauacuaggucguuggcauuuauugauaaaauagacaaggucccuacucuugugaagcuuacauucugggggaugagggggagaaggcaacaaacaaguuuuaaaaauauagaugagcugggugcaguggcacguaccuauaguuuuagcuacucgggaggcugaggugagagacugucuugagcacagccugggcaauauaaguuuguccccaucuccaauaaaaaguuugggccggggccgggugcgguggcucacgccuguaaucccagcacuuugggaggccgaggcagguggaucacgaggucaggagaucgagaccauccuggcuaacacagugaaaccccaucucuaccaaaaauacaaaaaauuagccgggcgugguggcgggcgccuguaguccuagcugcucgggaggcugaggcaggagaauggggugaaccugggaggcggagcuugcagugagccgagaucgcgccacugcacuccaacaugggcgacagagcgagacuccgucucaaaaaaaaaaaaaaaagugugggccaggcacaguggcucacaccuauaaucccagcacuuugggaggcugaggugggcagaucacgaggucaggaauuugaggccagccuggccagcauggugaaaccccauuucugcuaaaaauagaaaaaauuagcacugggcgugguggcacaugccuguaaucccagcuacucaggaggcugaggcaggagaaucacuugaacccaggaggcggagguugcagugagccaagauugugucacagcacuccagccugggcaacagagcgagacuccaucuccacacacacaaagguauguguguuaucuccauguauauauggauaaccaucucauacccauuaggauggcuacuauuuaaaaaaaaaaaaacaacgaaauaggccgggcgcgguggcucacgccuguaauccuagcacuuugggaggcuggcggaucaccugaggucgggaguucgagaccagccugaccaacauggggaaacccugucacuacuaaaaauacaaaauuagccaggaguggugguacaugccuguaaucccagcuacucgggaggcugaggcaggagaaucgcuugaaccugggaggcgggguugcggugagccaagaucaugccauuguacuccagccugggcaacaagaaggaaacuccgucucaaaacaacaacaacaacaaaauagccaauguugguauggauguagagaaauuggaaacuuugugcacuauuaggaauguaaaaugggacaaccacuauggaaaacacaguauguugguuccuuuaaaaauuaaaaauagggccaggccugguggcucaugccuauaaucccagcacuuugggaggccaaggcaggcagaucauuugagaucaggaguuugaggccagccaggacaauguggugaaaccgucucucuacuaaaaauacaaaaauuagcugggugugaugcgcauaccuguaaucccagcuaccugggaggcugaggcaggaggaucacuugagcccgggaggcagagguuguagugagucgagaucgggccacugcacuccagccuggggaacaacgcaagacuccgucucaaaaaaaaaaaaagauugaaaaaauuaaaaauagaaggccaggcacgguagcucaugacuguaaucccagcucuuugggaggccaagguaggcugaucacuugaggucaggaguucuagaccagccuggccaacauggugaaaccaugucuccaccaaaaaauacaaaaauuagcugggcgugguggugcacacguguaguccuagcuacuugagaggcuaaggcaggagacucgcuugaaccuggaagguggagguugcagcgagcugagaucacaccacugcacuccagccugggugacagugagacccugucucaaaaaaaaaaauaaaaaugaaaauaaaauuacuaggccaggcgugguggcucacgucuguaaucccagcacuuugggaggcugaggcaggcggaucacaaggucaggagagcgagaccauccuggcuaacacauugaaaccccgucucuacuaaaaauacaaaaaauuagccgggugcaguggcgggugccuguaguuccagcuacucgggaggcugaggcaggagaauggcgugaacccuggaggcggagcuugcaguaagcggagauagcaccacugcagucuggccugggcgaaagagugagacucugucucaaaaauaaguaaauaaauaaauaaaauuaccauauauaugauccagcuucuguaugcccacuucugaguauacauuuaguucucacuuaauguugucuauagauucuuggaagcugugacuuuuaagugaaacaaccuauaacaaaacuuguuuuuuuuuuuccucaucaauguuacaggaaacaguguuauucuaggacuugcuaugcauucuuucucuugaaguugcaguuucugagaacauaugaauaauauugaggacuuauuguauacccaaaagaagauaguuguacaccuauauccacagcagcauuauucauaguagccaaaagguagaaguaacccaaguaucuuaucagugaaugaauaguaaacaaaauacgguauaugcauccaguggaagauuauucagccuuaaagaagaaaauucugacuacaugcugcuauaugauuccacuuacaugagguagcacaaauaguauacaaaauuguauguuuaaaaaugguuaacaagggccaggcaugguggcucacgccuguaaucccagcacuuugggaggucgaggugggcagaucacgaggucaggaguucaagaccagccugaccagccaacauagugaaaccccgucuguacuaaaaauacaaaaaauuagccgggcgugguggcaggagccuguaauuccagcuacucgggaggcugaggcaggagaauugcuugaacccaggaggcggauguugcagugagccaauguugcaaucgcgccauugcacuccagccugggugacaagagugaaacuccaucucaaacaaacaaaaaaaugguuuaacaaggcucaugccugaaaucccagcacuuugggaagcugaggcaggugguuugcuugagccuaggaguuggaggccauccugggcaacauagugagaccccgucuuuauaaaaauacaaaaaacuagccaggugggauggugcaugccuguagacccagcuacucaggagacugaggcgagaggucugauugacccugggaggucgaggcugcagugagcaaugaucaugccgcuggaccccagccugggugacagaaggagacccugucucaaaaaaaaaauaaagaaaagaaaaaaaagauuggaaacaaauguccaucaguuuugcaauugugucugcuuaaauaaacuguggcacauuuauagugaaacacuaugcauuguaaacaauguuucuguuaaaaaaaaaacuuuuuuuuuuuuuuuugagacagagucucacucugucacccaggcuggagugcaguggcacgaccucggcucacugcaagcuccgccucccggguucacaccauucuccugccucagccucccgaguagcucgggaccacaggcgcccgccaccaugcccggcuaauuuuuuugguauuuuuaguggagacgggguuucaccguguuagccaggauggucucgaucuccugaccucgugaucugcccgccucggccucccaaagugcugugauuacaggcgugagccacagcacccggccaaaaaaacuuuuuaauaauaauaaaaaacgcuaugccacuguaauaaaagguugagguagcuauguauauauaauugccuguuuaugcagaaaaugucuggaaggauauacaagcaacugaaaucuuggcugggugugguggcucacgccuguaaucccagcacuuugggaggccaagguagguggaucaaaggucaggagaucgagaccauccugucuaacauggugaaaccccgucucuacuaaaaaaauacaaaaaaaaguagccgggcaugguggugggcaccuguagucccagcuacucaggaggcugagguaggagaauggcaugaacacaggaggcagagcuugcagugagcugagauugugccacugcacuccagccugggcgacagagcgagacucugucucaaaaaaaaaaaaaaaaaaaccugaaaucuuacaaggaggaaacugggugacuagggacaaggguggcaagaagauuucaucuuauacccuuuuguaccuucugaauugugaaugaugaauaauugccuucucaaaaauuauaaauaaguuguguugucauaacuuuuauuuugacuucuaagauggaauugucagccacuugaagaagcaggcaggaccagcuucagugccucucaggacugaggaagaauuuaagaaauucauuagugauaaagaugccucuauaguagguaaguagcaaauauuaaaccgugccacagaauugucaguuugguuuccaaaacccuccaugucugggaaaaccacagaauuaaagcaguuaaggaaaccuuggggcaguugagaaggcaacugacagaauugggucagcaauuacuauaauguacuauauaguacauuauauaauuacuauauaauguaauuauaauguggggggcaauugguguuuuauuugaguggguuuguguucucauagauguaaagguuuaauuucaauuaaagggacuggaagggguggguguggggaaaaaaauaaaggacuaggauaggaauaucuucagcguuuucuaaugcuucuuaaacucugagauuugacucacaauaggguaguuaugacugaaaauaagguuuuaagguaggaagauacaaguaaauaauaaaccucugcuauuuucacagaaauuagggaacuuuaaaaucagaucgcuaggauuuaucuuguuuuugcagcauucauugcuuucucauguguugcaguaucucguuuuuaaaugacaugagccaguuaaacacuuucugcaucuuagauguucauuguuuuguuuuuuaaaugugauauaugauaaauuugacuaaaaaauaaauuuaaacauaaaagcuauguuugugcuucucuuagucuccuaauuacuguaauaaaacugacuuucgccuggcucaguggcucacgccuguaaucccagcacuuugggaggcugaagcgggcggaucaccugaggucgggaguuugagaccaaccugaccaacauggagaaacccugucucuacuaaaaauacaaaauuagccgagcaugguggugcaugccuguaaucucagcuacucgggaggcugaggcaggagaaacgcuugaacccgggaggcggagguuggggugagcuaagaucgcgccauuguacuccagccugggcaacaagagcaaaacucugucgcaaaaaaaaaaaaaaaaaagugacuuucuggcagcagaauaugguuuacuguuuaaauuuggcuaaaagccacuuuuuaucaucuagauuuuacugauucuuuauauuuuacaaggaguuagcauguauuuauuaaacauuuauguuuuagucacuuuucuaaaugaguaguucugaagacaaauauagagaaggaaaaaaauugggugaagugguuuacaguuuauuuugacaugucaucuuaauuuaauccuucugauaccugaaauagucccugaaacucuuaagcaauuugcccaaauuuguucaauuaugggaaaguaaaaugaagacuugaacacugacaaauuuucucccuuggcucucucaagaaauguuucuguaaaggguagagggaaaauucucauccuaaauauugugccugucugagguagucauggcaaagcagacccaguccucaaaauagaaugaaauguuuaugguuuauggaauagacguuuaugguuuggaauguccaucugucagcacuuauugcuucuuccuuguguuuaauauuuucuguauagguuuuuucgaugauucauucagugaggcucacuccgaguuccuaaaagcagccagcaacuugagggauaacuaccgauuugcacauacgaauguugagucucuggugaacgaguaugaugauaauggagaguaagugacugaguugaaucuccugaccaaguauuauugugugaacuggugauacugauugacugggacaagguuucacucugucacccaggcuggagugcaguggugcaaucucugcucacugcagccuccaccucccagguucaaacgauucucgcgccucaaccuccugcauagcugggaguacaggcacgcgccaccacacccugcuaauuuuuguauuuuuaguagagacaggguuucaccauguugcccaggcugguuucaaauuccuggccucaaguguuccacccaccucggccucccaaagugcugagauuacaggcaugagccaccgcacccagcugaauuggucauuuuuauaccuaauuuuucccaaggguuuauugaguacuuucaaggcauuaugcuacaugcccagaaacuauugcugccuucaaggaacaucccucuaucuaguagagggagauuguaugcaugaacauauauaaaaaugaaaguguaaguguauguagaacuauauauggagugguuggaaguacaaaagagggaguguuuuuuucuucuuaugggguagggggguaauaucagaaauauucauagagggggugacucuugaaggaucaguuuucucuggaagguuauggccuuugaaauaaaaauuauuccagauagagcaccaggagugaaggccuugagauguaagauagccuaggcauguuggggcccauaguacugcuggaguauuguuugugauugagaucauaaugaaagauaagauuggaguauuaagcagagaccaaauuauaaauuuuaagugccauacaaaagagcuuugauuuuaucuuuuagacauuugagagccauuaaaagacuuugggcuggggaguaaugccuaguguuccauuacuggaauacuaagcuugugggaguuauuuauauccuccugcucaaggucauugccaaggucugaucuuucacaaaaacaauuugcaaccucccacguaaauggguuaaauuugugaagaagucacuggcagccacaugauaaugauuugaagggggaguggugcaaggcauucuaaggauucuaaggagaauucuaaggacuauaaggagaaucuaaacugaggaugacaugugagagucuaaacucggucaacagcauuaguggcaauggauaggaaggggugaguauaaaaaaauguaaacaauagucacuaacuaugagugaaaagaagauucagagcaaguuugaguuuauuuuuuuauuuuuuucagacagagucucgcccuuguugcccaggcuggagugcaguggugcgaucucggcucacuacaaccuccgccuccuggguucaagugauucuccugccucagccuccugaguagcuaggauuacaggugugcaccaccacaccuggguaguuuauguguuuuuaguagagacaggguuucaucauauuagccagucuggucucaaacuccugaccugaggugaucugucugccucgggcucccaaaguguugggauuacaggugugagccaccacacccagcccgcuauuguuucuaaagguuugaaaaucuacucuaacccccuuuugagauaaugaaaaagcugaagcccagaaggauuaaauugagaccugguccaacguguuuggaauuaguuggggaacuaugauuagaaccacguucucuuaauuuucuaacccaaaauuuaguaaacccuauacccaauuauugcacuuaagauuaaggugguuagcaucuuaguguuaaugagaaggucuuguugcugaaucugugguacuagaaaagaguccuuaugugcuuagauguugcuaguuaaaaguggcagcaaaaguacauagucugagcuuuacaugaaacaugggagcuccaccaguaaucccagcauuuuuggaggcugagaugggaggaucgcuugagccugggaguucaagaccacccuugguaacaugaugagacccccaucucuacaaaaauuuaaaaaauaaauuaguugugcaugguggugcacaccuguguucucagcuauuugggcagcuaagguaggaggaucacuugagccuaggaguucaaggcuacagugagcuauaaucacaccauugcacuccagccugagcaacagagcgaaacccuaucucaaaaaaaaaaagaugggagacaguucuucugcuaucugccuacugagacuuuucuuuuuuuuuuuuaagggguaucaucuuauuucguccuucacaucucacuaacaaguuugaggacaagacuguggcauauacagagcaaaaaaugaccaguggcaaaauuaaaaaguuuauccaggaaaacaugugaguacuucuuuguaucuugucugggauuuauuugcuugauuuuaguuuguuuaccucaguuauuaagccgagcuauauuuuggcguaaacagucuauuuggggggauuguaauaguaauaguuugaguuuauauuaaagcaguaauguguggguguuagaacuccuguugucauccuguaagguauauauugcucaguacuuguucuaaauguuuaaaaucucuuuccuucauaaaugcuaucaauuauuuuguggcaacuuuaugauauagcuaaaaacuuggcaagccaguugauaauggauuauuucauuucaguuuugguaucugcccucacaugacagaagacaauaaagauuugauacagggcaaggacuuacuuauugcuuacuaugauguggacuaugaaaagaacgcuaaagguuccaacuacuggagaaacagguaauaagaauuauguuuuucccucaugaacaaguuuacccaauguauagacagucccuucuaacuaucuuguugguuccuuaagaaucuguaaaacaauaaaugguuccuuaagaagagguaaaaaaaaaaaaaaaaaaauuaaaguaacuauccuguuaccaugugugguauaaaagcaggaaagaaugggaacauuuggcuuccaaauugucuacaauugacuucaaauggcuacauuugaagccauaaggacaaauaaacuguuuucacaaucuguugggcauguauuucguagguguuucuuugcuuugugacacagugacuccaaguagaagguggaaauuugauauaaaaugcacuuaaaacauugugcuuacuugcacauugagccucucagugcauuuuacccuuacaaauuuuguuuucagaucaguuauuaugccuauaauagauuucaguuauauauuacagcaagauuuagcaggaaugcaccaguugauuggguaucaccaauuugccagugaaguucaguaaggcauugaaguauaucauaacccugugucagugcccaagagcucagacuguucagacugauuccagaaggcuagaacuauagaacuuagucuuugcuuuccaaucacuugcuucuuaguuucaaaagugcuugaccacccuguauagucuuggcacaaaugucucuuguuucccacaggguaaugaugguggcaaagaaauuccuggaugcugggcacaaacucaacuuugcuguagcuagccgcaaaaccuuuagccaugaacuuucugauuuuggcuuggagagcacugcuggagagauuccuguuguugcuaucagaacugcuaaaggagagaaguuugucaugcaggaggaguucucgugaguugcuaguugggcuuugauucuccaaggcaauuauuaaagccuuuuauacuacaaaggauuucuaaagaacaauaacccuggaaugugaagauaggucuuuuaaucaagaccuaugacugucauuuuucucaauuuaaauauagguacuuuagaccaggcgugguggcucacgccuguaaucccagcacuuugggaggccaaggcagguggaucgccuaaggucgggaguucgagaccagccugaccaacauagagaaaccccgucucuacuaaaaaugcaaaaaaauuagccaggcacgguggugcaugccugcaaucccagcuacucaggaggcugaggcaggagaaucgcuugaaccugggaggcggagguugcggugaaccaggaucgugccauugcacucuggccugggcaacaagagcgaaacucugucucaaaaaaagaaauaaauaaagaaaaauaaauacauauagguacuuuaaggauuaugauccuuaaugaauucugaaaacuaaugaaaggauggcagguuggaauucuuacaugauuccacuuggucauuagaaauagcagauaaagggugagcacaguggcucacaccuguaaucccagcacuuugggaggccgaggcauguggaucacaggaguuaaagaccagccuggcccacauagugaaaccccgucucuacuaaaaauacaaaaauuagccgggugugacggugcgcaccuguaauuccagcuacuggggaggcugaggcaccagaaucacuugaacccgggaggaagagguugcagugagcugagaucaugccacuguucuccagccugggugacagagcaagacucugucucaaaaaaaaaaaaaaaaaaaaagaaagaaauagauaagauuggacagccuccuuugggccagaugugguggcucacaccuauaaucccagcacuuugggaggcugaggcaggaagaucacuugaucacuugagcccaugaguuugaggccagccugggcaacauagcaagaccccgucuccaaaaaauuuaaaaaucuaaaaaaagauugaacagucuccuugauacugacguaauuucaaaccaaaccauuccccccccucaucccuacagaauguauuuucuuuuugaaauagcacaugggucuaaagugaacucagaaucgggaagaucugaagaccccggaaacaauuuuuacccucacuuucugagauuuugggagauugagacaagagaaaaucuuccuugugagccagucaauaaaacaaaauacuguaaauagugugcuccagagcaauaagaccuuguuuucuuacaaagaugaaucuccagaagaccaaugauucuccuuucucugaacuuuguaauccacaaagaacacacuagaaauaaaaggaacgguuuguuucuucagucgguaguucugcauauugagagaugagagucccccuuuuuuagccuugaaaagcuaaaauacauaguaacuauucaaagaaauugcuguaauuuucucagcggugggaauagauuaacaagccuuacccuuguuuuccaauuguaggcgugaugggaaggcucuggagagguuccugcaggauuacuuugauggcaaucugaagagauaccugaagucugaaccuaucccagagagcaaugaugggccugugaaggugaggugcucacagccucaucaagcuaugagcaauugccuguccucauuucuuuguuccaaaacuguggggucuaaaugaagacuucguuggccaucucuuuuuuuuuuuguccuuacucccgagucauaaaauaagcauuggcaggccaagcgguggcucaugccuguaaucccagcacuuugggaggcaaaggcgggcacaucacaaggucaagaguuugagaccagccugcccaacauggugaaaccccguaucuacuaaaaacacaaaaaaaucagccgggcaugguggcgggcgccuguaagcccagcuacucgggaggcugaggcaggagaaucgccugaacccaggaagcagagguugcagugagucaagauuaugccacugcacuccagccugggcgacaagagcgaaacuccaucucaaaaaaaaaaaaagcauuggcagggcucauaaugcuugguaggggcaagcguguaaagccugcguagaauuuucugaugaaauuuauauugggcuaaguuacucuugaggauagagcaaccccuaagaacaguguguugcuuugaauuuuuuauagggauguggucuuacucuguugccucagccuucugaguagcuuggacugcaggcaugugccaccaagcuuggcuugaaauuauuuuaaggaaugguuggguagcacuucuauguccuguaacuuccugaacauaguuugacaggugacagacauaggaacgaguugguaucuagugaaugacaacaucuuuaauacaaucuguaaaugugauuuggguuuccaugacuuauuuucugugguaacacaucaaauuagagagggauugggucuaggaacaaauacaguugugaauuuauuuuuuuauguuaccaacuagagauucuucuguguuuuccagguagugguagcagagaauuuugaugaaauagugaauaaugaaaauaaagaugugcugauugaauuuuaugccccuugguguggucacuguaagaaccuggagcccaaguauaaagaacuuggcgagaagguaagugugaacccuauucugaggauaacauuugagcgggagcaguaaguuuauguauguauucagcauuggcuaauuugguugguuccuaaguacugauagauuuuuuucccaauuacuugcuguuuacucacuuucucgugacugcccccuagugcuccagccugugcagugccugagauacccacuuuuaacauuccauuccucaggcucaaucuagauaaugguuaaaaauaucuaaggacuucugaauuuugguaauggcuuacaugaauccauaugguccuucaucuuaaaacauuuggcuuagccccuguaaugucuuauucagaccagguaaauuugaagguggcaauauguagagucuuaauacaagagaaaaaagggaagcuuguggaaagugagguacuaccaucugcaaaccacucuucccacaugaacagcaguuuaucugcuggaauuacaggugcgcaccaccacacccggcuaauuuuuguauuuuuaguguuugaagaaugagauuguuuuaagucuucaauugacuaagugucccucugucacugaaaacuugaaauguaaacauuuaaccuguuuuauuaacagcucagcaaagacccaaauaucgucauagccaagauggaugccacagccaaugaugugccuucuccauaugaagucagaggguaaguggcuuaaaacuuaacaaaagugucuaggcaauagauaggaauaaagcuuguaaccaccaggaaaucauuacuagacauaguuuucauauucaguugaaggcagaaccacugauuccuucuuggcuuaagaguucugcaguaugggcccacauaacugcuugaaauuaauaaauguuucuuuccccaguuuuccuaccauauacuucucuccagccaacaagaagcuaaauccaaagaaauaugaaguaagugaauugucccauauccccacaaauauauacacagacguaaacacacaaccuuaaacauaguucuuuaauuggguuuauuuauuuauuuaauuauuuuuugagacggaguuucgcucuuguugccugggcuggagugcaauggcgugaucucggcucaccguucaagcgauucuccugccucagccucccgaguagcugggauuacaggcaugcgccaccaccccggcuaauuuuguauuuuuaguagagaugggguuucuccauguugguugggcuggucuugaacuccuaaccucaggugaucagccugccuuggccucccaaagugcugggauuacaggcgugagccaccgugcuaggcuaauuggguuuauuuaacuaaaaucucuuuaaacucucaugggcaguauauguggcugcuaauaugcuuuuacaaacucagaagucuuccuguuuggguggggcagaucaggguucuuuaaaaaguuacacuuuuaagcugaucuuucuguuuucaggguggccgugaauuaagugauuuuauuagcuaucuacaaagagaagcuacaaaccccccuguaauucaagaagaaaaacccaagaagaagaagaaggcacaggaggaucucuaaagcaguagccaaacaccacuuuguaaaaggacucuuccaucagagaugggaaaaccauuggggaggacuaggacccauaugggaauuauuaccucucagggccgagaggacagaauggauauaaucugaauccuguuaaauuuucucuaaacuguuucuuagcugcacuguuuauggaaauaccaggaccaguuuauguuugugguuuugggaaaaauuauuuguguugggggaaauguugugggggugggguugaguuggggguauuuucuaauuuuuuuuguacauuuggaacagugacaauaaaugagaccccuuuaaacugucuuauuuuccaccagauugagaaccagauguucucuacacacuaucacuguucaauagagcuuucuucagugauggaaaugcucuguaaucuacacuguucaguacagguagcuacggagcaucugaaauauggcuagaaacuacauuuuuguuuugauuaauuuaaauagccauacaguugcuaccauacuggucacggcagcuguagacugacuggguccauaguucaucaccucaaaauucuuucaaaauuuauuaucucuuucucuccuuacauguuuauuucccaggccuacccuggugauuagaacagcugaagggccuuucuuguuaggcuguccaugcccuaaggauggguuccuguuuauccuugccacgcagcugagcuuacugcauguuuauaucucccaaggacuguucucugcucagaaaugcccugucaaggguguggcaucacgcaguuucauccaaguuguuucaggaauugcugacacugcugggugcaguucuauccccuaaagccuaggguguggcccuuuaacuuccccuucaguagaacugggaaaggcaguaccauuccuaguuaugagugaagcauccacuuucuuuuguaacaaugaggaacagaaaggauaagacugaagagugaucuuuuguccaacuaaaccauuuaucuccuuuuguagguaaauucaaauccugcccaguuauaguuuucagucacuggagaauuccagguaggagcccuacuuuaggugauccuaggaacuccuauguucagaaaagaauuuucuuccuacuauauaauuacaguauuuagcugucaauuuuaagaugaauuugguagagccuuauaguaaaguauguaucuuggucacacacaaagcuuggaaaaaguaaaagaugucuaaaccauaaucuuguaacucauaacaucugggcuggggcccggggaucuaauuguuuagagagccccaaaaguggcucagauguaaagccaggguuaagaaccaucugccuuggaagauuuaagggaaacauauaaacuuguacaaaggaca

SEQ ID NO: 191228 - RNA, 41506 nt, Homo sapiens
cugcucuggcgcugcggccgcuggggaucugagugggcuccgccccgccucggacccgccccucccggccucccgccgcaaucuuggcgggaaggcgccggccgcuaagaagccgaaagauguccaggucgggcgcggcggcugagaaggcggacuccagacagcgaccccagaugaaggugagaaacggacuggugcuuccaaggugugcuccugccucgguuuuugugaggguuaugcgggacacaggcccaggaggucgagggcaccuggcaccggggguaggcgggggaucccugcccuuaggccuucagcuuugacgaaagguucuuaucaauaacccgagaaauagugggagagucacaucugggauucccuuucuucaaccuucugcguuuucuucugccacaguuaugaucggcuucacacucuuuaaauaauuccagacaauccgcagcugacaguugggguauuugccccagucacaaaugcuagucauuauuauuauuggucuggaaaacuuaugggcaaaugugcccaguaagugaauucuacugagguuaagguuagugaauuacauaucuaggauuuuggaggggaaaauaaguuuucuuacgaagggugucaauuuggauuuauuuauuuuuuugagcuuaagucucacucuguugcccaggcuggagggcaguggugugaucucggcucacugcaaccuccgucucccggguucaagugauucuucugccucagccuccugaguagcugggacuacaggcgugugccacuaugcccagcuaauuuuuguauuuuuaguagagacaggugguuucauuauguuagccaggauggucucgaucuccugaccucgcgaucugcccgauugggccucccaaagugcugggauuacaggcgugagccacugcaccuggccucaauuuggauuuauauugucuuugggaaaugggaauuauuagaucuguuagggauccuguaagaaaaggcacaggacuuggaguucuaauauucuguuuucuuuuauugaucugaauagguaaaugaauauaaagaaaaucaaaacaucgcuuaugugucucugagaccagcacagacuacaguuuuaauaaaaacagcuaaggucuaucuugcccccuuuucacucaguaauuaccagcuagaccagcuuaugugccccaaaucccuaucagaaaagaauucuaacaaugaaguggcguguaagaagacuaaaauaaagaaaacuugcagaaggauuauaccuccaaagaugaaaaacacaucuuccaaggcagaauccacgcugcaaaauucauccucagcuguucauacugaaaguaacaagcuacaacccaagagaacggcagaugcgaugaaucucaguguugauguggaaaguagucaggauggagacagugaugaagauaccacaccaucccugguaagaacuuaauuaguagcuuguucugguuucucuuuuuugaaauuugaaguucugauaaaucgaaguuuuucgaggaucucucugguacaaacaaguuauuucaucaucuaauguaaguauaaauguaauaauacauuuuuauuauuuuuaagguuuaacaaauaacuuccuuggguuauuuuugcucuugcuguugaugugucaaugaaaggauugacuuaaucuuuacucugcuuccuuuuuucuuucucuaaacuaacugcauauauuuuuggguuuagucauacuuuauggugccuuucucaccuuuacauguuuauguacaguauaucagaagucaucaguuugugggacaugguauugacugaccuuugauaucaggguagggaaacauaaauugauucuaugguuguguugaauaauauuuccuuuaaaugcaaaacgagacaaaugacagaguagguaagauacaugagaaacacauuuguucuguguaauuccaaucaauuuaaggaauuugguguguaauuuuuuucuuuuuuuuuuuuuuggagacagagucucgcucugucgcccaggccagagugcagugacgcuaucucggcucacugcaaccucggccucccaguuuuaauagauuguccugcuucagccuccugaguagcugggauuacaggcgcgugccaccacaccugguuaauuuuguguuuuuaguagagacgggguuucaccauguuugucaggcuggucucuaacuccugaccuugugauccacccgccucagccucccaaagugcugggauuacaggggugagccacugcgcccagccuggucuguaauucuuuuggcuucugcugccuaccaggagcgccgugcuccauucaaagugacaaauuuuaacuggacaagauaaaacauacauagcacaugacacaauguugauggaacucagaaaacagaaaaugauccuagggaaagggagauacuauaauugaaggcuuguuguuaugaaauagaaguuugcuuuaugcuuucucgucccagaguuaagaaccaggacucauagugggacagcaugggguaaguauuaaaugaauuggacuugggguugagagccuagcauggccacuuuuuuuuuuuuuuuuuuuuuuuuuugagacgagucuuguucuguugcccaggauggagcgcaguggcaugaucucggcuuacugcaagcuccuccucccggguucacaccauucuccugccucagccuccugaguagcugggauuacaggcgcccgccaccaugcccggcuaauuuuuuauauuuucaguagagacaggguuccaccauguucgccaggauggucucgaucuccugaccucaugauccgcccgccucggccucccaaagugcuggaauuacaggcgugagccaccgcgccuggccuagcacggguacuucuaagaaaccuuguuccuuuaagcaaaugaccuuaggggauuggauaaaaucugugguucucaaacuuuaggcuauaucagaauuacauggagaguuuguuaaaacuccauugcagggccccaccaacaguuucugauucagaaguuggggcauacaauuugcauaucuuuuuucuuuuucuuucuuucuuuucuuuuuuuuuuuuuaauggagauguugggauguuugugggguggagguugggagguguugcccaagcuggucuuaagcuccugagcucaaccaguccuccaaccucagacucccaaagugcuaggauuauaggcuugagccaccacacccagcccaauuugcauauuuaacaguuuccuagagacgcugauguuaguccaggacugcacuuugauaaccacuggauuagguuaucccuuuggccucuuagacuguaagauucugaagaagucaggcucgguggcucacgccuguaaucccagcaccuugggaggcugaagcagguggaucaccugagguggggaguuugagaccagccugaccaacauggagaaaccccgucucuaccaaaaauacaaaauuagcugggcgugguggcacaggccuguaaucccagcuacuagggaggccgaggcaggagaaucucuugaaccuggaagguggagguugcggugagccgagaucgugcuguugcacuccagccugggcaacaagagugaaacuccgucucaaaaaaaaaaaaaaaaaaagauucugaagaauacaagguaaauauaaagcagauuuuaguuugauguaaugaaauagguccauuaauagaguugcuccuaaagaaaaaaaaaaggagguggacagaucaccugagaugaggaguuccagaccagccugcccaaaauggugaaacccuauuucuacuaaaaauacaaaaauuaggccggccauggugguucaugccugcacucccggcacuuugggaggccacgguggguggaucacuugaggucaggaguuggagaccagccuggccaacauggugaaagccugucucuccuaaauauaacaaauauuagccaggcaugguggugggcaccuguagucccagcuacucaggaggcugagucaggauaauugcuugaacugaggagguagagguugcagugagccgagaucauaccacugcacaccagccugggcgacagagcgagacucuguccccacuuccccaccaaaaaaaaagaaaauauaaaaauuagccaggcgugguggcaggugccuguaaucugagcuacucgggaggcugagaugggagaaucgcuugaaccuaggugguggagguugcagugagcugagaucaggccacugcacuccagccugggugacagagcaagacucuuguuuuaaaaaaguaaaaaauaaagccucccaaauagcugggacuacaggcaugugccaccuugccaggcuaauuuugacuuuuuauuuuguagagaugugggugugccauauuuauugcccaggcuggucuaaaacuccugggcucaagcaggcugcccaccucggccucccaaagugcugggauuacagaugugagccacugagcccagccaagauacuuuuuuuuuuugagacagggucucacucuauuacccaggauggagugcagaggcacgaucucagcucacugcaaccuucaccucccagguucaagcgauucucccaucucagcgucccgaguagcugggauuacuggcgugugccaccaugccuagcuaauuuuuuguauuuuuaguggagaagggguuucuccauguuggccaggcugguuuuuaacuccugaccucaagugaucugccugccucagccucucacagugcugggauuacaggcgugagccaccgcgcaugccaugucuuucuuucuugguuuauucuuucauuuuggugaaguacagcuuucugagaaaaaguguauacgaggcaaauacuuugcauaucagagaaauuuuuuuguuuuuuuuuuugagacggagucucaccugucgcccaggcuggaauguaguggugcgaucucagcuuacuguaacuuuuuguuuuuuuaauagagaugggguuuuaccauauuggccaggcuggucucaaacuccugaccucgugaucugccggcuucagucucccaaagugcuaggauuauaggcgugagccacugcaccuggcccagaaaaagucuuuagcuuuauauuugauugaugaccuaauuggauuuagaauuguaaguugaaaauaaucuuuccuuagaauuuuuaaugcauuguuccauugucuuccagcuuccuucaauguugaaaguuugugccauucugauucuggauucuuugugaucuuuuuuuccccucugcaugcuuuuaagaucuuuucuggcugggugugguaaggcaggccuguaguuucagcuucuugggaggcuaaggcuggagcccaggagugcaaggcugcaguaaguuauaaucaagccaaugcacuucagccugggugacagagugagacgcuaucacuuuaaaaaaaaaaauugugauaacaugccgaggccuggguucaucuuuguuuuuuuuuuguuuuuuuguuuuuuuuucuugagguggggucucacccugucgcccaggcuggagagcaguggcacagucuugccucacugcaaccucugccuucuagguucaagcgauucuccugucucagcuuccugaguagcuaggacuacaggcaugcgccaccaugccuggguaauuuuuguauuuuuaguagagauuagguuucaccaugguggcuaggcuggucucgaacuccugaucucaggugaucugcccacccaaagugcuuggauuacaggcaugagccauugcacccggcuugcuuuguuuuuuuuuuuuuuuuuuuuuuuuuuugagacagucucggcucuugcccuggcagcuagaaugcaguggugugaucucggcucacugcaaccacugccucccagguucaagcaacucuugugccucagccucccaaguagcugggauuacaggugugcacuaccacacccagcuaguuuuuuuguauuuuuaguagagacgggguuucgacacguuggccaggcugguuucaaguuccuggccucuagugaucugccugguggccucccaaagugcugggauuacaugcaugagccacugagcuugcuugccuggguccuuuuucauucauuaugcauccaaaggcugcauacucauugggccuuuuuaaucuggaagcucaugucuuuaguuuugagaaacuuuaaaauaauauuuguuuucaaacuauuauuuuuuagagauggggucucacucuguugcccaggcuagaacacaguggugucaucauagcuuacuacaaacuugaacuucugggcuccagugauccuccugcuuuggucucccacuuaacguuauuuuucuuucuuuucuuuucuuuuuuuuuuuuuuuugagauggagucuggcucuguugcccagaguggagugcaguggcgccaucucggcucacugcaagcuccgccucccggguucaugccauucuccugccucagccuccuguguagcugggacuacaggcgcccaccaccaugcccggcuaauuuuuuguauuuuuuaguagagaugggcuuucacuguguuagcuaggauggucucgaucuccugaccuugugaucugccugccucugccucccaaagugcugggauuacaggcgugagccacugcucccagcccuuucuuuuuuuuuuuuguuuguuuguuuuuugagacggagucuugcucuguggcccaggcuggauggagugcaguggcaugaucuggguucacugcaaccuccaucucccggguucaagcaauucuucugucucagccucccgaguagcugggacuacaggcgugugucaccacacccggcuaauuuuuguauuuuuaguagagacuggguuuugccaugcuggccaggaugguccugauuuccugaccuggugaucugccugccucggccucucaaagugcuaggauuacaggcgugagccaccacacccggccugccauuuauauuauuuuuuaauaauugauucucuuccaauuucucagcaguuucucgaacaaugaauuggauauuggaccucuaagacugaguauuuuuuugucuuuucuguucauguguuuaucuuuuuguucuacuuucuaaauuuaagccuuuucauggauuuaaaaacuauugaguucuuauuuuuugaauuuucuuuucuuacaguauuuugcuauuuccugaauauacugccuuauaucucaggguuuuaaaaaauuagcuuacuguuacauuaguggcuuuuuaggagaaaguagagacauguacuuacucacucuacugcguuuaagggaaguuuuuuuguuggaaaaaaauaacuuuuuuuuuuuuuuuuuuugagacggaguuucgcucuuauuguccaggcuagagugcaauggugcgaucucggcuugcugcaacccccaccucccagguucaagcgauuuuccugccccggccuccugaguagcugggauuacaggcuccugccacuauaccuggcuaauuuuuuuuuuuuuuuuguauuuuuaguugagacaggauuucaccauguuggccaggcuggucucgaacuccugacuucaggugaucugcccacuucggccucccaaagugcugggauuacaggugugagccaccacgucugaccaacuuuuauauuuuuaguagagaugagguuucaccauuuuggccagguuggucuugaacuccagaccucagguguuccauccacuucagcuucccaaauugaugggauuacaggcgugagccacugccccuggccaaaaauaacuuuuguguaauaguacaauuaauugccacuaggaaauaauuugcuacuagaucauacuacuugauuucuaauaucagaucacuucuuaacugggaagccauacagauauuuuggggguaucccaaauccagacuuacugaaauauccaauucagcaaacgucuguuuugguaagaugaugaaaugaauagagauaguacaauuugaaguaaaguauucauguagaaaaugaaacauguaguuuugugaagugcuuuuccuguagauuauauaaaguaauggaaucuuuuugguguaauuuuauaggauuuuucgggauugucacccuacgaaaggaagagacugaagaacauaucagaaaacgcagacuuuuuugcuucucuucaguugucugagguuuguguggagucuauuuaaaagcaagaugcagggccgggaacaguggguagcgccuguaauccugucacuuggggaggcugacaugggagaaucgcuugaggccaggaguucgagaucagccuggguaacauacggagacccgccccccgccccccgccccccaccccaaucucuauaaaaaguaaauuaguugagcauagugaugcaugucuggaguccuagcuacugggguggcugagguggaaggauggcuugaguuuggaaagucaaggcugccgugagcuaugaucaugccacugcauuccagcuugggcaacagagccagacccugucucaaaacagcaacaacaagagccguaaaacccaagaugucauaacucccaccaggucaauaacauaucagguuucauagugucauaugagggaggguaaaauuggagcagguuuugugcuuaauaggaagagguuacuguacucuguugauucuaaggcauuauuuuuuuugucuuuuuuuuuuuuuuugagacggaguuuugcucuuguugcccaggcuggagugcaauggcacgaucuuggcucacugcaaccucugccucccggguucaagugauucuccuaccuuagcuucccaaguagcugggauuacaggcgcccgccaccacgccuguaauuuuuguauuuuuaguaggaaugggguuucaccauguugguaaggcuggucucgaacugcugaccucgggugaucuacuugccuugaccucccaaagugcugggauuacaguugugauccaccaugccuggccugucuuuuuuuuuuuugagacagggucucgcugcguugcccaggcuggaguacaguggcgcugaucaugacucauggccuaucuuaaggaucuuuaguuccugaauagaccuuaguuuaguguggguauaguagcagaugcuuaauauuuuaaaagguaagauacguaguuauaacauuuuuacaugauuuuuauacuuuacagucugcugcaagacuccgugaaaugauagagaagagacagccuccuaaauccaaaagguaaaauaucuaguuugcaaugccugaaccaugauacauugcucaacuguuuuauaauuugaaaaaaaugguuuggugugguaagcuuaacagaucauaaagugcuauuuaaucucagucccucuaggaucucugagggaaugcuacccuuuaauaacuuuacaauucucaucuucaucaaaggaauauggagcaaauaaaauggagagcugaauuuuguuuauauuuauuguugcuacuaaugaagggaaaucuuuauuuccacuaaauuacugucacuuagaaaacuauuaaagauucuucuacuuacuuuuaauuuuucuggcuaucuuuuugcgucucaauuuguuuuugcuuucuuaguccuagaauaaaggaaaggaauuaacauuuauugaauaucucugaaacauacugcagugaucuagcaauuuuguccuauauuaucucauuuaacucugacaaccacugcaugugguagguaauauauucauuuugugaguuagaaaucaggcucaaaagauaaaauuguuggcugggugcaguggcucaugccuauaaucccagcacuuugggagguugagucagggggucaccugaggucgagaguucaagacuggccugaccaacauggagaaaccccaucgcuacuaaaaaaaaaaaaaaaauuaaaaauuagccgggugugguggcacaugucugaaucccagcuacucaagaggcuaaagcaggagaaucgcuugaacccgggaggcagaggucauggugagccaagauugcaccauugcacuccagccugggcaauaagagugagacuccaucucacaaaaaaaaaaaaaacaaaaaaaaacaacuauuugcugaaagucaaaacagcuuauaagugguagcuuuaggauuugaacucaaggguguuuaaauuuugaauuaucuccauugcauuuuagcagugcuuacauauaaaugaagaaacuaaaaucuugguaucauuagcucauuuguuuagugccaguuccuaaugaaauguagcuucauuuacuugguuugauucuguuacaggacaauuagcuugagaaaagcuggaccuuuaaucauggccagguauuuucaagugugaaaaguuacuauaagaggaacaucauuaacacuggaaaaacaguagcacugguccuguugcccgcugauuaguagcuuuacauuugcauuuuuuuauuagccaagauuggugauuucuuccuaaaucacaaaauucuagcccuuaauaguuguauaggcaguagcaaguugauaguauggaaguuguguaauguagcgcagaaguguagccuuugagauuuagcaaauuuggguucaaguuuugauucagucacuuacagcuaugacaguaaccuuggauacuuuauauaauuuuucuuucuguaaagcuggcauuaugcuaaucuagaaggauuuaaauuuuuugaaaauuauuaaauauacauauaaaaagguacauauaauguauuuguguaguugaaaaauuauacaggucccauccauguaccugccauccagguuaauagaaauuacgaauaccccugaaggcccauauauaccccucccucccgauacaaccacuaugcugaauuuugugguaauauuuccuugcauuuauuuauugcuuuuuuuuuuuuuuuugagauggagucucgcucuguugcccagucuggagugcaguggcgcgaucucggcucacugcaaccuccaccucccagguucaugccauucuccugccucagccucccgaguaacugggacuauaggcgcccgccaccacgcccggcuaauuuuuuggauuuuuaguagacgggguuucaccguguuagccaggauggucucaaucuccugaccucgugauccgccugccucggccucccaaagugcugggauuacaggcgugagccacugugcccagccuauaguuucauuuuuauuuauuuauuuuuuugagacagagucuugcucuguugcccaggcuggaguacagugguguaaucuuggcucacugcagccucugccucccagguucaagcaauucucaugccucagccuucugaguagcugggauuacaggugcucaugaccaugcucugcuaaauuuuguauuuuuaguagauacgggguuucgccauguuggcaaggcuggucuggaacucuggaccucaagugauccacccaccucagccucccaaagugcugggauuacaggugugagccacugugccuggcuauugauuuauaguuuuacuaccagugaguguauccuuaaacacuauauuguuuagcuuugucuuuuuuugguguucacauacaauaugccuuuuuuauauucugagauuuucuuauuuugcucaucuuuacauauuuaugcuuuuaaauuuacccauguugaugcgcacagcuuuauuucguucuuuuuuucugcuauaugauauuccacuguaugaauguacuacauuuuauucuacuguugaugaacaauugaguuguuauuuuuauuaugaaaagugcugcuccaaacauucuuaagucucuuagugcuuauguaugggaguuucucuaggaguagauuucuaggauuguaugacagcccauauuauuccauauacucaggugucuuuuuugaggauuaaauaugagauggaauguugacuacaguuuuuaguauauaguauacuuucaaucaguagguuuuacuaauucucgaaguaauguggacuauaacugauaauuuuuuaugugaauuuuuggaaauaauuucagaggcuucucuuuccccaacauuuuaaaaugaauuacuuuuuuaaaaaugaaaaaauagugcauaaaaaaauagagaauguauauuauuuaaaaaguaaacuacaguguauggaagggaaugcagugaaacguuuuaaguuuccuuccuauuuuagaccuuaguuuuccaggccuuuucccuagaaguaguaguuuuauguguauuccuccaaagguaaccucagcauguacaaauguauguguauauguaaccuuuuuguauacauguacuggacuuuguuuuugcuuuuuauaaccaaggguuccuuucagcagugcauaaagaucuauaucauucuuuuuauggcugcguauuauucuauuagauauguauaccauaauuuaacagaccucaccucuuuuugaugaacauuuagguuuguuuuuuccauacuucuuauuaagauaauuguggccauguauauauauaucuaugcaguuuauaaauauaucugugguauauauuccuagaaguuaucucuuuaguauuaguaaauacauuuuauuguuuugugaguauaacaugaguuuuuccccacuccuuuagaaagaagccuaagagagaaaaugggauuggauguagaaggucaaugcgauuacuaaaaguugauccuucgggaguuucauuaccagcagcuccaacaccgccgacauuaguagcagaugaaacuguaaggaaaugugcaaauauaauauuuuaauguaauaaaauacugaaaaauuugaaguguugaaacuagacuaaaaguucauuaaauuauguuuaauuuuauauuucauuaauacuugaauguuguaugguuuuguuuuguuuuuuugagauggagucucacucugucgcccagacuggagugcaguggcaugaucuugccucacugcaacccccuccucccguguucaagcgauucuccugccucagccucccgaauagcugggauuacaggcacaugccaccauaccuggcugauuuuuuuuauuuuugguagagacgggguuucaccaugcuggccaggcuggucuugaacuccugaccugaaguggucugccugccucggccucccaaagugcugggauuacaggugugagccacugugcccggcccauuuguacgcuuuaaugaguaagauuucgaagucguaaagacuguauuggauucuguauuucugcaggacuuaccugcuuaggauugugggugaguuaauuaaccuuucugauuguuucuccauuaaaaaaaagucagcaauaauagaacccucaguaaauauguacaauuuuaugucaguuuaaaaaaaaaaccucaaagagcuacuguaaagauaaaugaaaucauaucuauaaaguuucucacauauuaggggcuuaguaaucaauagaauauaguuauuaauguuaauaaauacgugauaauguguaguuuuagugaguagaguuuuauuuagcaaacauuuucuaaauauuuuuuauucaagaacaccuauuuuuaauacuuuauauguaaguguuuaauuguaaauaggaagauagcacuaauuaggcugguguuuugggagcaaauugcaaaucuagguguuaugggaagcagcauagaagaguagcuucaaauuuuuuugaagccucagcccacaagaaauauauuuguggccagguguagugguucaugccuguaaucccagcacuuugggaggcugaggcaggaggaucgcuugaacccagaaguuugagaccagccuaggcaacaucaagagacccuguucuuacaaaaaaaauacaaaaaucagcugggugugguggcaugugccuguagucccagcuccucaggaggcugaggugggagcaucacuugagacguuaauuuaaaaauauauauauauauuuauuuacauuguaacuaucacacauauaugcaacugaaaccacaguuugucaaacgacacuuaauacauguggugcacuuugguauuucuuuuuuuuuuuucuuucugagacagagucucccucugucacccaggcuggagugcaguggcacaaucucaguucacugcaaccuccgccucccggguucaagugauucucaugccugagccuccagaguagcugggacuguaggugugugcuaccacgccuggcuaaguuuuguuuuuuuguuuuuuuuuuuuuuuuuuugagacggagucucaaucuguugcccaggcuggagugcggugcugugauuuuggcucacuguaagcucugcaucccagguucaugccauucuccuggcucagccuccgcugggacuauaggcaccugccaccacgcccggcuaauuuuuuuguauuuuuaguagagaugggguuucacugcguuagccaggauggucucaaucugaccucaugaucugcccgccucggccucccaaaaugcuaggauuacagguaugagccaccgcacccggcccacgcauggcuaauuuuuguauuuuuaguagaaaugggguuucgccauguuggccaggcuggucuggaacuucuggccucaagcuauuugccugccucagccucccaaagugcagggaucacaggugugagccauguaccuggccugguauuucuauucuauucucauucacuacaacaaauugcuaguugugacauacuaacaugauuucucacccacuaauugguuacaaacuguuuaaaaaaauacugauguagguauaauacugaguaaugaguuaagauaaucugagucaauucucagcuucuccaguuauuggcugugugacuuugggcaaguuaacuccucuuaaguuucugggguuuuuuuguuuuuguuuuuuguuuuuuuuugagauggagucuugcccugucacccaggcuggagugcaauagugcagucuuggcucacugcaaccuccaacaccuggguucacacgauucuccugccucagccuccugagcugcugggauuacaggugccugccaccacgcccagcaaauuuuuguauuuuuaguagagaugggauuucaccauauuggccaggcuggucucgaacuccugaccuugugauccgccugccucggccugccaaagugcugggauuacagucucuaaguuucaauccacugucuuuaaaaugugauaccucauuugcuagguuguugagaggauuaaaugagauaauacauguuauuauuacuuuauaggguaccuggcauucauuuauugaacaauuauuuugaauguccaugauaugccaccauuacuguugauguugaaagugaaguuguggggaaaacagacaaauacccuugcccuccuuguguuuauauucuagggcagggagcccaacaaauaacuuuuuauuuuuuauaacagccuuuguuaccuccugggccuuuagaaaugacuucugaaaaucaagaagacaacaaugaacgauuuaaaggauuucugcacacaugggcaggaaugagcaagguaucacuugggaaggccaauagccuuuagaaucaucuguuaaggaaauauauauauauguaaaaauauauacauacuaacuuaguucuuucaucucucccaauguuucagccaaguaguaagaacacugagaagggauuaucuagcauuaaaagguaaguugaaauuccuuguguuucuuuuauauuuuuugagauguuugaguuauaaagacuauacgccauuuuagggaauuuugaaagugagaugaaauguuuccacccuaacaacuguuguuuuuguguauuuccucacaaguguugccauauacaauaccacuaggauauaagcuucauauacaauaccacuaggauauaagcaagaauucuauuucaauaaccagaacagugccuggcacauaauauauguucaguguugaauaaaugagugaauccacauacauuuuuacuauauguuguaauguauauacaauuuugcauuacacuuuuuucuuuuucuuuuuuuuuuuuuuuuuuuuuguuuuuugagacaaggucucccucuaucgcuuaggcugcagugcaguggcacuaucuuggcucauugcaaccuucgcuuccugggcucaaaugauccucccaccucagccucccaaguagcuuggacuacaggcgugcaccaucacaucucacuaauuuuuguauuuguagagaugagauuuugcuguguugcccagguuggucuugaauaccugggcucaagugagcugucugccuuggacucccaaagugcugggauuacaggugugagccagugugccuggccugcguuauguuuuuuuucauuugcgguugcauguuacuagagucuuuaaaauuauugaauaauuauaaaauauuccauugaguagaaggaguucacuucuccuccuaccugcuugguauuugcgguuguuuuccauuuagcuuuguguguuuguguauguguuuguugaaguauauggauaugauaguggauuauuucuuuagguuagauuuccagaagugagauuaaugcaucaaauauugugaacauuuuuauggcuuuuaguacacauugccgaauuguugcucaaaggucuuuuuuuuucuucugaacauuuuauaugaacuuacucuuccacuagcaauaugugugaguauguguauuuaacugcagccuaccagcuuuugguguuauuaaaauuaucaaggguaauuuaaaaagugaaagaauauugcuuaauuugauuuccuugguuaccaggagauugaauaguucccauauuuauuugcuaauugugauuuuucuuuuugaauaaucuuuuacuuauuuugacuauugagauugguuuuacuuacaaaauuuaacuuuguaauuuucuuagcuacaaagccaauuuaaauggcauggucauuagugaagauaccguuuacaaaguuaccacaggcccaauauucucuauggcucuccauccaucagaaacuagaacuuugguagcaguuggggccaaauuugggcaaguuggacuuugugauuugguaaguuauuaaauuucuugaauauauuauaguuugacuaaagcaaauaggcuggaagagaauaggcuagagccauguguuuauaaauguugcgugagacuuacaauuuugggcuuuaugaugcuuuaugauuccaaauuuuagaaaucuggaagaauuuaaauuugcuuuauagaacuuuaauauuuuuagcuugaauaucauuaaccaucuggucauaaauuaacugccagaaaacuuuguuacacuuugugugaucuuuucacauauacauuuaaaguggccgggugcggugggucacgccuguaaugccagcacuuugagaggcugaggcggucggaucaccugaggucaggaguucgagaccagccuggccaacauggugaaaccccgucuguaguaaaaaaauacaaaaauuagcugggcguggugguaggugccuguaaucccagcuacucaggaggcugaggcaggagaauugcuugaacccaggagacggagguuggagugagucgacacugugccauccagccugggugauagaguaagacuccgucucaaaaaaaaaaaaagggcugggagcgguggcucacgccuguaaucccagcacuuugggaggccgaggcggguggaucacgaagucaggagaucgagaccguccuggcuaacacagugaaaccgcgucucuacuaaaaaaccccaucgcuacuaaaaauggaacaaauuagcuaggcgugguggcaggugccuguagucccagcuacucgggaggcugaagcaggagaauggcgugaaccugggagggggagcuugcagugagccgagaucgcaccacugcacuccagccugggcgacagagcgagacucuguguaaaaaaaaaaaaaaaaaaaaaaaaaaagaucaaaguuuaguuuucuuuuuuuggagagggagucuugcucugucgcccaggcuggagugcaguggugugaucucggcucacugcaagcuccgccucucagguucacgccauucucuugccucaaccucccgaguagcugggacuacaggcgccugccaccaugccuggcuaauuuuuucuauuuuuaguagaggugggguuuccccauggucuugaucuccugaccucgugaucugccugccuuggccucccaaagugcugggauuacaggcaugagccacggcgcccagcccgaaguuuaguuuucuaguuguguuuaaaauauggucugcuauggucugaauguuuuugucuuccccaaaauucauauguugaaauacuaaucccuaugguauuaggagguaggaccuuugggaggugauuaggucaugaauaagauuagugcccuuauaaaagaaacccaggagagaccacugucccuucuaccauaugaggacacagcuagaaggcaccaacuaugaaccagaaaguaggcccuuaccagacacugaaugaacuggaagcuugaucuuggucuuccuagucaccaggacugugagaaauaaaaugcugcuguugauaagccacucaguuuaugguauguuguuuuagcaucccaaauggacuaagaaacaguuucuaagcuguaucaaaauaucuucccagggaccugcuuuggaaugauuuuaguuaucuuugaugagucagaaauagauacugaauuccauucauugugcauauaauucugcaugaaauacugucuguuauuacaaaauugagaaaagucaaguuaauguucucugaauuuauuuucuuauuggggaagaagaccaaagacaugaaaaaugccauaaggacaauuaaugaaggugaagaaauaguggugacuugaaguugguugggguuuauaaacaaaauuugcaaguuugaagacagaaaccaaguucuuauuuugggaucauagauucucccuuauuuugauaagaugugaguggggauaggaggugauaggauuuagcaaagaaaacugaagcaaaaaagugggaagaagaucagaauaguauguuuuggaagccaagagaugaguuucaaggaugggagguugacagagccuuuugcagagaaguuaaaagaauggagaaaaggccauugauuuugaaaauaggguaccauguagugaguugagagaauagcuuugacaaugagguaaguaaggaacaaaggcuuuaggagauuaaggaaguauggggguaaugaaagaacuggagaagcauuggauagagacuuuuuuuuuuuuuucccgccccugagauacggucccacucuguugcccaggcuggagugcaguggcaugaucauagcucacugcagccucaacuucccacggucaagcaauucuccaccucagcuuccugcguagcugggacuacggucaugugccaccacaccuggcuaauuuuuuaacuuuuuguagagaugggucucacuauguugccuaggcucaucucaaacuccugagcucaagcacuccaccugcuucagccucccaaagugcugggauuacaggugugagccaccacacccaucugagacuacuuuuugaagaauuuugcaaaggaaaaauugaaaauuagcaugauuaaaugaagguuuuuuuuuggaugaguugaucuguauagauuuaagacauacauaaaaauccuuuuuucauaucuuucaugaugacuccaaaaaucuguauuacagccggacgcgguggcucacaccugugaucccagcacuuugggaugccaagguuuggcggaucaccugaggucuggaguucaagaccagccugaacaacaugaugaaaucccaucucuacuaaagauacaaaauuagccgggcaugguggcacaugccuguaaucccagcuacuugggaggcugaggcaggagauuugcuugaacacaggagacggagguugcagugagccgagauggcgccauugcacuccagccugggaaacaagagcaaaacaccaccucaaaaaaaaaaaaaaaaaaaaaaaaucuguauuacuaggucucuguaguccaguaucuccaucaaccuaauuuuccaggacauuuggcaaucucauuaacagauuuaacaagucuaaaagcaauauuaccuugucuauccugugcucacaauuuccccaguuuuuuuaaaaaauggcuucauugagguaauaauuuaccuaucauaaaauccuauuuaaaaaauguaaaauucaaugcuuuuuuuucuuuuuuuuugagaugggaaucuugcucugucacccaggcuggagugcuguggugugauccuggcucacugcaaucucugccuccuggguucaggugauucucgugccucagccuccugaguagcugggauuauaggcgcucgcugccacaccuggcuaauuuuuuuuuuuuugagacgagucuugcucuguugcccaggcuggcaugcaguggcgugaucucugcucacugcagccuccgccuccuggguucaagcaguucucugccucagccucccaaguggcugggauuacaggcguccgcuaccacaccuggcuaauuuuuuuguuuuuuuaguagagaugggguuucaccaucuuggccaggcuggucuugaacuccugaccuuguaauccacccgccucggccucccaaagugcuggguuuacacgaaugagucaccgugcccagccuaauuuuuguauuuuuuguagagaugaggcuucuccauguuggccaggcugaucuggaacuccugaccucaagugauuuucaccugcuucggccucccagagcugcgauuacaggcgugagccacugcaccuggccucagugguuuuuaauaaguuuacuuaguuguuuaauuaucauagucugguuuuagaacauuuucaucaucccuauaagaucccucaugcuggcugggugcaguggcucaugcuuguaauuccagggcuuugggaagucaaggcaggaggauggcuuaagcccacuaauuugagaccugccuaggugacauagugagaugccugucucuuaaaaaaaacaaacaaacaaaaaaaaaacuggauguaguggugugugccauuagucccagcuacucaggaaguugagcugggaauaucaccugagcucaaggcgguugaggcugcagugagccaugauugugucacuguacuccaggcuggauugacagagugagacccuaucucaaaaaaagaaaaaaaauucacuuacugcaauaagaaagaagcagaaccuaauguaguauacuucaaaaacuagcuaccaaggagagaaacaaaucuguagcagagcuaggagacagcauaauuuagcuucugcccugccccgugugcagaaucuauacugguaaauugaccaaauccugagaauuuucuauauuaucaaaaguagagagaagcacauuggguauuccgauuuuuccucuuuucaaugaggaauggggaaauaguugcuggggugaaaucaggaaaaauagaagaaguagggacagugaguaguagaacugauugucuucaaaggaaguuuucuuggcccacgggagugguaacacccuccaccgccauacaaguaggugguaugaauccugguauaaaauaaugaacaaggccgggcgcaguggcucaugccuguaaucccaacacuuugggaggcugaggcaggugaaucaccugaggucgaguucaagaucagccugacuaacauggugaaacccugucucuacuaaaaauacaaaauuagcuggguauggugaugugcaccuguaaucccagccacuugggaaacuaaggcaggagaauugcuugaacccgggaggcagagguugcagugagccggcauugcaccacugcacuccagccugggcgacagaguugagacuuuuuuuuuuuuuuuuuugaggccaaaaaaacugcauuucagauuaccugcugucucaacauggugaaaccccgucuccacuaaaaauacaaaaauuagccaagcaugguggugggugccuguaaucccagcgacucaggaggcugagacaggagaaucgcuugaaccugggagguggagguugcagugagcugagaucgugccacugcacucaagccugggugacagagugagacuucaucucaaaaaaaaaaaaaaaaagacuguuggaggaagggugagaauaauauucucaaaucaauauaaauuaucuaaaauuaacaguuuaaaaaauaaaaagcauaaugacuacaauugcuuuuuguuuuauacuuuugccauuguagaagauaaugucucuguaaauacuugaaauucaaaaauuccuuuagcuucauuuucuuauauuauuuugacagauuuauguguaccuauacagauagaaugauagcgaagaaauuuuaaaaaaggaccaugcuguauaugccguuuuaaaucacauuaaauuuaacuauaaagaugucuauaaucucaguguuucaaugauaauuuugguuaauuuuagauuuggaaugauuuuuuuuuuugagacggagucucgcuuugucgcccaggcuggaguucaguggugcaaucuuggcucacugcaaccucugccuccccgguucaagcaauucucugccucagccuccugaguagcuggaauuacaggugucugccaccacgcccggcuaauuuuuguauuuuuaguagagacgggguuucaccaucuuggccaggcuggucuugaauuccugaccucgugauccacccaccucagccucccaaagugcugggauuacaggugagccaccgcgccuggccuggagugauuuuuuuaaaacuuccaucuuuguacauuucugcauuguuugaguucuuuauaccaagagaaaauuuuauuuuucuagaaaacaaaugcuauaaacaaauaugucaguaguuucuaacucugguaacaggaagaguaugugugauuauaauaauuuuuucucuuauuuuuucuuuuaaagaauacuucucuccauuuuaaaauuuaaaauaaaaaagaaaacaaaaaugcuugaccauuucagaguagaguaagccagauuuagaggugauucuuugguucauaauaugccauauggcauagaaacauaacuuguucugaaaagcgacuucucaggagcuggcaauccaguuguggaaaggauaguccuuaggaguagguauauuaauauggaaauucaaauacaugcauuuuuaugguguuauuuuuuuauuuuauuuuauuuuauuuuauuuuauuuuauuuuauuuuuugagacggagucuugcucugucacccaggcuggagugcaguggugagaugucggcucacugcaagcuccaccucccggauucaugccauucuccugccucagccucccgaguagaugggacuacaggugccggccaccacgcccggcuaguuuuuuguauuuuuaguagagaugggguuucaccauguuagccaggauggucucgaucuccugaccucgugauccgcccgccuuggccucccaaagugcuaggauuacaggcgugagccaccgcgcccggccauuuuuauggugcauuuagaggacaaaguauguuuaaaaccauuaucuuugucccaggaccaaauaccuuacgaaaauuacacugagaaugaguaaguuaauauuauacagaagaagccugcugcagaagcaaagugguaagguacugauacuguuuuaguuagcaauuauaccaugugugaaauagaguagauuuaucauuuccugaggauuuuauaaacugacaguaauauauaaacuauuuuguuaguuacagaaagcuggucacuguuaaugugacuugguauuguuggauugaaaacuagaaaaaaguuaaugacaagauaaaguuucucauucugacuuugugaaggggagagugguuacaauuauagacuaagaaaagacugaauauaauccaguguaaauucuuuaaugacauaauagcauagcaaaaaucacuauuuuucacuaguuuuuuucucucuccccuuucccgcaacucucuuccagacccagcaaccuaaagaagauggaguuuauguuuuucauccccauagucagccaguuagcugucuuuacuucucacccgccaauccggcccacauacugucacugagcuaugauggcacguuacgcuguggggauuuuuccagggcuauuuuugaagagguaaauguuaauguguuuacaugcugacuucagaugauauucuagauucuucgaaaugccacaugaauaauuauuauaccaauugggagaagugguauagcagaaggacuuugagaacuacgcugccuaaguucaaaucccagaucaucuguuacuaguuguaugaccuugacaaguugcuuaaccuuguugugccucacuuuccuuagcugugaaaugggauuuaacaggacugaccuuacaggguugucaugagaauuuaaugagcuuaugcagauaaaguacuuagaagagagccuggcacauaguauguguuugcgcuuguuaaauuucuuuuuuuuuucucucccaaagcuuuuaacuaaaauaacuuacucuucuguuuuuaggcauaagacuuguauuuagcugggugugguggcucaugcuuguaaucucagcacuuugggaagccaaggugggagacucacuucaggccaggaguuccagaccagccugggcaacauggcgagaccuugucucuacagaaaauaaaaaauauuagcugagcuugguggugugugccuguagucucagcuacucaggaggcugaggugggagaaucacuugagcccaggaguucaagaucagccugggcaacauaguaagaccuugucucuaaaaaaaauuagcuuggugugguggcaugugccuguagucacagcuacucaggaggcugaggugugaggauugcuugagcccaggagauugaggcuguaguaaagccgugaucacauacaucauugcacuucagccugggugacagagugagacccucucucaaaauaagacaucuucuacuuaauguuuaaaacaaacauaucauuugaaaugaacuuucagauuugcuuaacuguaucagauugccucaauaagauaagucuuauaaguugaacuuuuuuauuuuauuuuuuuugagacggaguuuuacucucgucaccuaggcuggagugcaguggcgagaucucggcucacugcaacuucugccucccagguucaagcaauucuucugccucagccuccugaguagcagggauuacaggcacccaucaucacgcccggguaauuuguuguuguuguuguugucgucguuguuguuguuguagagauggagucucacucugucgcccaggcuggagugcaguggugcgaucuuggcucacugcaagcuccgccucccagguucaagugauucuccugucucagccuccugaguagcugggacuacaggcgcaugccaccaugccaagcuaauuuuuguauuuuuaguagggacgggguuucaccauguugaccaggcuggucucgaacuccugaccuuguaauccaccugccucagccucccaaagugcugggauuacagcgugagccacuguguguggucagauuugccucuucuggacauuucauauaaaugaaaucauacaauuuguggucuuuugugacugguuucuuuaacaaaauguauucaaaguucauccauguuguagccguguaucaguacuucauuccuuuuuauggcugcauaauaugccauuguauggguauuccacauuuuauucaucuguucaucaguugaugaacauuuguguuucuauucuuucuuuauauauuuauuuuugaaacagagucucgcucuuguugcccaggcugcagugcagcagugcaaucuuggcucacugcaacuuccaccucccggguucaagcaauucuccugccucauccuccugaguagcugggauuacaggcacgugccaccacaccuggcuaauuuuuguauuuuuaguagagacaggguuuccccauguuggccaggcuggucuugaacuccugaccucaggugauccacccaccuuggccucccaaagucuugggauuacaggugugagccaccacgccuggccuuacuuauuuuuauuuuuugagaugggggucucacucugucacuccagcuggagugaaguggcuugaucucggcucaccgcagccucugccucccaggcucacgugauccucccaccuaagccuccugaguagcuggaacuauagucaugugucaccaugcuuggcuaauuuuuguauuuuuaguagagacgguguuuugccauguugcccaggcuggucucaaacuccugagcucaagugaucugcccaccuuggccuuccaaagugcugguauuacaggcaugagccaccgcgccuggcuguaacuuacauuucaauaagcuugacuuuaaaacaauagguggagaacuccuauagcuuaauuaaaaaagcuaacccaauuaaaaaaugggcaaaggaucugaauaaacauuucuuuaaagaaacacaaauggcaccgggugcgguggcucaccccuguaaucccagaacuuugggaggcugaggcggguggaucaccugaggucaggaauuugagaccagccuggccaacauggugaaaccccaucucuacuaaaaauacaaaaauuagccaggcgcgguggcaggcaccuguagucccagcuacuggggacgcugaggcaggagaaucgcuugaacccgggagguggaguuugcagugaggugagauugcaccacugcacuccagccugggcgacagagcgagacugucucaaaaaaaaaaaacaaaaaaaaacaaaaaaaccccacaaauggcaaauaagcacaugaaaagauucuaagcaucauuauucauuagggaaaugcaaaucacaaugagauaccccuuuacacucacuaggauaacgauacuugccaguaauaaguguugacaaugauguggaaaaauugaaacccucauauuuugagaauugguaugugaaaugguaaaguugguuggggaaaguuugacaguuccuuaaauguuaaacagaguuaccauaugaccuagcaauaucccuccuagguauacacccaagagaaaugaaagcacauguccacacaaaaacuuguacgggaauguucauacaagcauuauuugcaauaauacaaagaauagguugggcaugguagcucacaccuguaaucucagcacugacagaggccgaggaggguggaucacuagagcucaggaguucaagaccagccuggccaacauagugaaaccgcaccucuaaaagaauacaaaaauuagcugggcgugguagcaugcgccuguggucccagcuacuugggaggccugaggcaugagaaucacuugaaccuggaagggugaggcuccaguaagccgagauugcaucacugcgcuccagucugggugacagagggagacucucaaaaaaaguuacauaugguacaauuuaccacuuuagguauauaauucucugaguuuuggugaauuguguacacauguguaacuaucguaaucaagauauagagcugggcgcaguggcucacgccuguaaucccagcgcuuugggaggccgaggcagguggaucacuugaggugaggaguucgagaccagccuggccaacauggugaaaccccaucucuacuaaaaacacaaaaaauuagaugggcaugguggcucacgccuguagucccagcuacucagaaggcuaggccacggagaaucgcuugaacccaggaggcagagguugcagugagccaagauugugccauuguacucuagucugugugacagagugagacuccaucucaaaaaaaaaaaaaaaagaaauuuuccauuucccucaagauuacgucaugaccuuuuguagucauucuccucccauugccugcaaucccuggcaacuacugaagugauuacuguccccauaguuuugccuuuuucugaaugucaggcaguuggaauuauaugauuuguagacuuuuguuucuggcuuuuaccuagaguaacaguuuuaagaugcguucaugcuauugcauauauucguaauuuguuucagauaccacugacuaaacaguuaccuuauacuaggcacuaucuugagugugcuuuauauacaucauuaagccuuauaacacccuagaaaaugaguaauguuauugcauuuaacaggugaaaaaacugaggcagagagguuuaugagguugcucaaggacauagauggcagaacaagaauuuacaccaggauuugugugacuccaaagccccugcucuuaaucauuuaaauauauugaguaugccaaguuuucauuuguauauauuggucuuuuuguggggugugaagguugugaugccuuuagcauauuaauuuauucuuaguuuauaacacuuguuuuuaaaacuaaaaaucaguucaugauucaacaauaagaauuguggucauccccucuuaauugacaggaagauuuauuuuuuauucuuuaugugcaugaguccuaaacccaaagugauugcauuguagauuacaugugauuaaaaacuuaauaacgugcucaugauauagucgggcaugguggcacgcaccaguaaucuuagcuacuugggaggcugaggcaggagaaucacuugaagccaggaggcggagauugcauugagccgagaucgugccacuguacuccagccugggcaacagagugagacucugucucaaaaaaaaaaaaaacacgcucaugauaaaauauuuacaguaaaucagauaugaaaguaaaucugccuguuguucauucccauuaucacaaguaaccguuguugcauaucuugaguaugcuuccacaaaguacaccuaugcuuacaagcauauaguuauacauuuuuuucuccucuucuuuauacuaauggcuucauacuaauauacauagccuuuugcaacucuuuucacuuaauaguauaucuuggacaguuaauacuauaaaacuaccuuauucuuuuuagcauugcaugguauuucaaaauagagguggaucaucauuuauuuaaccagaucucucuugguggauauuuauguugcuucuuauugcuauuauaagcaaucuugcagcagacauuuuuauagaucucuuagugaaauuacugggucaaaaaguauaagcauuaaacauuuugauagauguagccugauuaacugucaaaaauguauauauuuacucuucuacugagaguaggugagcauucagcugugugucuuggacuugguuggcaaaguuacuuugcauauuaaaauauaauuucaauuggguagaauucacauucaguucuuuucuguuaaguuucacaggguagaucuggaacugagguuuauuggauugagagauuugggauguagcccugacauggguagaugggccauuuaauuguagacacagcugaucagugccuuuguuucuuuuuuguuuuguuuuguuucuuuuuuuuuuuuuuaauuuucaguuagaaggaauaaguucuaauguucaguagcagaauaggguaacuauaguuaacaacaguguauuguauauuuuaaaauagccagaagagaggacuugaaauguucccaacacauagaaaugauaaauauugaagguaauggaaccccaaauacccugacuguguuuccauuauguccugugcaucugauggggaugaugagaggauaaaugagguuauuuggguaaaguguuuuauaacccuuuuaccaaagaauuuaugcuuuggcuuucuuuacaagaagagugugauauaagcugauuguuacuuauauucuuagguguauagaaaugaaagaaguagcuuuuccuccuucgacuucuuggcagaagaugccuccacuuuaauaguaggacacugggauggaaauaugucacugguggauagacggacaccuggaacuucuuaugagaaacuuaccaguucuucuaugggaaaaauaagaacuguucauguccacccagugcauagacaguauuuuaucacugccggauugagguauggucuuuauaagacuuuaugacuuagaccuuuuaaugucacaauuacaugguuuaguuugguugucaaagauauuguaauacaauauuacaaaagguauuacuuuuguaauacccaaaggccaaguaauuuuccuuucuauacugauugagacuugagugauuuuuuuugaaaaugaaaaauucuuuuagauuugauaaauagugaaaaagcugaaagaaauuuuuguuuuccuuggcauuauaugcauucgccucuuaugagaagaaaauuuaaauuucacagaaaaaaaaguuacaugugaccuauaacuuguuggccuguguuaacuuuuuucuaggaaggauugaaaaaccaacuagaaacuugacagcugggcgugguggcucaugccuguaaucccagcccuuugggaggcugaggcaggcagaucacuugaggucaggaguucgagaccagccuggccaauauggugagacccugucucuacuaaaaauacaaaaacuaaccaggugugguggcaugcaccuguaaucccagguacuugggaggcugaggcacagaaucacuugaacacaggaggcggaaguugcagugagccaagauugcaccauugcauuccagccuggaugacagagcgagacucuugucuccaaaaaaaaaaaaaaaaaaaaaaaagucuuucuguacacacuggauccaaguaucugcuauaguuuugagaugugucuaguauuguacuuguuaucuauaccaguuuuggggaaauuaauaagaguauuagaggguucugucuuuuuuuuuuuuuuuuuuuuugagauggaaucuuacucucagcucacugcaaccuccgccucccagguucaagcgauucuucugcuucagccuccugaguagcugggauuauaggcgugcacuaccauaccuagcuaauguuuguauuuuuaguagagacagggucucacugucuuggccaggcuggucuugaacuccugacccugugauccacccgccuuggccucccaaagugcugggauuacaggcgugagccaccaugccuggccuuagagaguucuguuuuuuuuuuuuguuuguuuguuuguuugaaauggaguuuugcucuuguugcccaggcuggagugcaauggcgcgaucucggcucacugcaaccuccgccucccagguucaagcaauucuccugccucagccucccaaguagcugggauuacaggcaugcaccaccacauuaaucuuguauuuuuaguagagacgggguuucuccauguugaggcugguuucgaacuccugaucucagaugauccaccugccuccaccucccaaagugcugggauuacagacuugagccaccgcaccuggcugagaguucugucuuaaauguucuucaguauagcaaguaugugagugucuaacuuauguuuagcccuguuguagagguucauuacauguacuauggcaacauugaucauuguuucucccauuacagggauacucauauuuaugaugcaaggcgauugaauuccaggagaagucagccuuugauuucuuugacugaacauacaaagagcauugcuuccgccuauuuuucaccucuuacugguaacagaguggugaccacaugugcugauuguaaucugagguaaauugggaaggcagaaauguuuuuagggaaucuaaagagucuauagcuacugugucaguaaaccaaaagcuuuguuuacugcuguucccuauuaaauugcuaguguuauuguuuaguagucauauguagguuccuaaagacuggugaccuguauuuaauggcuuuucagcgguuuuuggguccuggaaauuuccuugagacuggcaaagguccguagguacccugggggguuuauggucuggcuucccuuuaagcacugaagaaucccagaaaccaggcuguguaguauccugaaaaggagauaauuuuagcauacuuuggggucagugggaucuauucugcaagugaagugcugaauggaaauugcagagccccagaccaugggcagacagaaaagagcaaaaacugggauucuauacaaacuauuggauaugguuuuauaguucuaggguuuuagcuuuaguaccuuccuauagcuacuuccuaaaaauggauuuaaaguguaauauaaaccaaucgaacaaaaaacagaaaacagugucaauaaagaugucgggaacauuaguguaaucacaaaggaaaauuauuuuguucucuuuuagaaucccugauuuugcuuaaaauuucaagcauuuucaguuuaugagaguuuuaccuuaagugauuuuggaauucauauauuauucaguugaauguauacuguucaccaggcuccagaauggcacccaguuucuguuuaaacccaccugaugggaagagcguggucugcagugugugacaggugucuaguuaguuucuagcaaagucugugaguauuaaccagguguuguaggaagagagucacccgggaaugguaggccaggaucccguuuccacucauguaguuuccuuugucucaaaagcugcuuauucuguuccuguucguuuacacugcaguuuacucuuguuacauuaacuauuagugguuuggcuuucuacuaaucuauuuaggcaauaaacucuagugccagcaaaccacacuagaaaagcuaggcacaaggagaagagaaggagguggugaugcuguuaguuuccuucugcuguagugcucaguggaggcuucuagacuccucuccaacugcuguauaaaaauuccucucuuuggccaggugcaguggcuuaggccuauaaucccagcauuucgggaggcugaggugggaggaucacuugagcccaggaguucgagaccagccugggcaccaaggagagacccugucucuacagaaaaaauuagccagauaugguaguguguacuuguagucccagcuacuugggaggcugaggcgggaggaucacuugagccuaggagguugaggcuuuagugagcugugacggugccauugcacuucagccugggcaucagaaugagacguugucucuugaaaaccaaaacacaacuccucuccuuuguugcugguuggucuuagucuggaaaugacacuaucaggccuucagcugaugagucucagggaaacugcucuugauacacagauguacuuuuaggugauuuguacauuuucaggccacauccuuuaugucccauauuuuugugaauuuuguauauaguuuuacaguucagaugaucgcuuuagaaugggcauuuuauuucuauucauuuaucauuauugauguuuuuuuagagacaguaucucuuuguugcccaggcuggagugcaguggcaugaucauggcucacuacaacccugacgugcugggcuccagccaacuuacgggcucuagcaaucuuacggccucagcuucccaaguagcugggucuagaggcaugugccaccauaccuagcuauuuuuuuuuaaauuuuuuuuuguagugauagggucucacuauauugcccaggcuggucucaaacuccuggcuucaagugauccucccaccuuggccucaaagugcugagauuacaggcaugagccacaacacucagccaaaugauuucuacgcuaaacuauaagcacugacuuauuuuauaaaacgucuuguaacuuuuguuuaguaucuugaccaagauuuguuagcgccugaucuuacucuuuuuuuuuuuuuuuuuuuuuuuuuuguagacaagguucucgcucuguugcucaggcuggagugcaguagagugaucauagcuuaguguaaucucaaacuccugggcucaagugaucuucucaccucagccuccugaguagcucggacuacaggcaugugccccaugcccagcuaauuuuuaaauuuuuuguacagaugggucucacuguauugcccagguuggucucaaacucuuggccucaggugauccuccuguggauuacaggcaugggccucuaaacccggccugauccuacauauuuuuaagugacaguuauauauuucauaccaugaauuaaugagaagcuuguuaaauacacugauauuuauuucagaaaguuuuuaaguaacaaaagaaugucuuacucucuuuauuuugcagaauuuuugacagcagcuguauaucuucuaagauuccgcuccucaccaccaucagguaggcuucuauaugccaaauaauguagauguggauuacuaugaacuauuuguugcagugcauacauuagacaucugauugucaaagagauguaauaguccugauuuuugaauacaaaaauuauaagugucccaguuugcuaguuccuauccagaaggguucuugcuuccagguucccugugucuguagagguucagucucuuguagucaguagcuguucucugcaggugggagguuauuuuugguuaagguuaaugacuuuauucugaacugaauuacucauguuaucuuauuaaagaagacuguaacuacucacuugcugaugaggcugucugaaggucuguuuauuugugucuguuuauucugggccuugagggcuuccccaucuucccacuucauuucuuugauuauacucuugcaucaacuacuuugaauguauuuguguauuuuuuuuuuuuuuuuuuuuuugagauggagugucacucuguugccuaggcuggagugcaguggcgugaucucugcucacugcaaucuucaccucuuagguucaagcuauucuccugccucagccuccugaguagcugggauuacaggcaugcaccacuaugcccagcuaauuuuuuguaucuuuaguagcgacgggguuucaucauguuggucaggcuggucucgaacuccugaucuugugauccacccgccucggccucccaaagugcugggauuacaggcguaagccacggcgccuggccuuguauguguguauuuuacaucaaacuuuacucaaugccuucuccuugauauuccucuuugucacuauuuaugaaguugcgaauagugugugauauacauugauuguugcuucauacauuuuguuccauuuuaucaguuucuuuuuuuuuuuuuuuuuuuuucagguccacaauuuuuuuuuuuuuuuaauuuuuuuuuaaagauagagucucacuuuguagcccaggcuggagugcaguggcaugaucuuggcucacugcagccuccgccuccugggugcaagcaauucuccugccucagccucccaagaagcugggauuacaggugcacgccacccugccuggcuaauuucuguuuuuuuuuuuguuuuuuguuuuuuuguuuuuuuuugagacagagucucacucuguuguccaggcuggagugcaggcucgcgaucucggcucacuacaagcuccaccucccugguucaugccauucuccugccucagccuccugaguagcugggacuacaggcgccugccaccaugcccggcgaauuuuuuguauuuuuaguagagaugggguuucacuguguuagccaggauggucuccaucuccugaccucgugacccaccugccucggccucccaaagugcugggauuacaggcgugagccaccacacccagccuaauuucuguauuuuuaguagagaugagguuucuccacauugguuaggcuggucucuaacuuuugaccucaagcggccacccaccuuggccucccaaagugcugggauuacaagugugagccacugugcccagccuauuuuauuuagagacagagucucgcucuguuguccaggcuggagugcacuggcacgaucucggcucacugcagccuccgccuccuggguucaggcgauucuccugccucaaccucuugaguagcugggacuacaggcaugcaccacuaugccccacuaauuuuuguauuuuuuuuaguagagacaggguuucccauguuggccaggcugguuuugaacuucuggccucaagugauccgcuugccuuggccuccuaaagugcugagauuacagacaugagccacugcauccagucuuauuuuuuaauugacuaauaaaauuguguguauuuaucauguacaacauguuuugaaauauauacauuguggaauggcuaaaucaagcuaauuaacauauguauuaccucacguacuuaccauuuuuuugugaugagaacacuuaaaaucugucagcaaucuucaagaauauaauauauuguuauugacuauagucauccugauguacaauagaccucuugaauguauuucuccuauuaacugaaauuuaauaguuuuugaccaacaucuccccaaaccuuucccucucugcccagcaguuuguuaacuacucucuuuuuuaaaaaaaaaaaaaaaaaagaaacagggucucgcucccuugcccaguauggagugugguggcaugaucauggcucacuucagccucaaucuccuggacuugagcaguccucuugccucagccucccaaguagaugggacuucagacacacagaaccaugcccugcuaguuaaaaaaauuauuuguagagaugaggacuugcuguugcccaggcuggucuggaaguccuggccucagccgauccucccacgugggccucccgaaguguuggcauuacaggcaugagccaucaugcccggccuuacaacuuuguuauuuuuuauuuauuauuauuuuuuagacuagucaaguguaguagugagaaggugggaaagaguagaacaaagaguuuuaucuguaacugacugugaacaaucaauuaagauaaguuacuaccuuugaaccagccucagcuuuuuaauauuccccauaugagugaggucaugugguauaugucuuucuguaccuggcuuguuuuacuuaacauaaugucuccagguucauccacgacaggauuuucuuguuuuaagugaaauaguauuccguuauguguauauacuacguuuucuuuauucauuuauccauugauuuguugauuccauaucuuagaugugacagugaaugugggaguacagguaucucauagauaguucauuuccuuuggauauauucucaguagugggauugcuggaucauaugguagugccauuguuacuuuuuugaggaaccucauacuguuuuccauuauggcugcaccaauuuacauuuccaccaacaauguacaagggguccuucuucuccauaucuuuaccaauacuugcuaucuuuugcuguuuucauaauggccauucuacuagauguaaggugauaucucauugugguuuuaccuugcauuucacugauuagugauacugaacguauuuucauauaauuggccauuuguauaucgucuuuugagaaguguguauucagaucuuuugcccauuuuuuaauuauuuguuuucuuuuuuuuuuuuaaacggagucuugcucuuguugcccaagcuggagugcaguggcaugaucugggcucacugcaaccuccgccuccuggguucaagcaguucucgugccucagccuccugaguagcuggauuacaggcaugagccacaaugccuggcuaacuuuccuauuuuuaguggagaugggauuucaccauguuggucaggcuggucuugaacuccugaccucagaugauccaccuuccucagccccgcaaagugcugggauuauaggcaugagccacugugcccagccaguauuauguauauuuauuuuauuuuuuaauuuuuaauuuuaauuuuuugaaauggagucucccucugacacgggggcuggagugcaguggcgcgaucucagcucgcugcaaccuccaccucccggguucaagcaauucugccucagccuccccaguagcugggauuacaggcaagcaccaccaugccuggcuaauuuuuguauuuuuauuuuuuuuuuugagacagaaucucacucuguugcccaggcuggaaugcaguggugcaaucucggcucacuguagccuccaucuccuggguucaagcaauucuccugccucagccuccccaguagcugggauuacaggcaagcaccaccaugccuggcuacuuuuuguauuuuuauuuuuauuuuuuuugagacagagucucacucuguugcccaggcuggaaugcaguggugcaaucuuggcucacuguagccuccaucuccuggguucaagugauucuccggccucagccucccuaggagcugggauuacaggcacccgccaccauggccagcuaauuuuccuauuuuuaguagagacgggguuucaccauguuggccaggcugucucgaacuccugaccuugaaugauccacccucuuggccucccaaagugcugggauuacaggugugagccacuguaccuggccaauuuuuguguuuuuaguagacuggguuucgccguguuggacaggcuggucucgaacuccugaccucagguguuccaccugccucggccucccaaagugcugggaugacaggcuugggccacugugccuggccauauuauguauauuuuuaaaaaauuuauguagggugacuauucuaggggguaagaauuuucauuaaugauggggucauuuaaguggcagugggaaauguguaguccauacuuuaaugaaaaaggauuguuagugauauuaaggcaaaaagacuaaaagggcaguacuucuguuuuugcuuuugggaacuauaaagggcuccauauguuuuauuuugggagauuuuuagaugaggaggauaucgucucuguccagagguucaguccuguaaggaugagguaagguuggugguaacucaguaacuuaaugagaagaaacuuggcagagaaaacuagcauuuaggagcaaugccgucuuuacccucugcccaaugcuaccuuauuuaaccuuacuucauuuaaaaaauauauuguuuuccucacuaggcacaacacuuucacugggcgauggcugaccagguuccaagccaugugggauccuaaacaagaagacugugucauaguuggcagcauggcccauccacgacggguagaaaucuuccaugagacaggaaagagggugcauucguuugguggagaauaccuugucucuguguguuccaucaaugccaugcacccaacucgguauauuuuggcuggagguaauuccagcgggaagauacauguuuuuaugaaugaaaaaagcugcugaguuuuugguuuaggaacaucaauuuguucaaauugaccacugucuaaggagccuaguaaucggcgugccuuaguguguuuaugugguaauguguuacauuuagcaauuauaacauuguuuuauuaauaagacuauaagaagaguguacuuuuaguaagggagaagucuuggaggguugcuucugcaggacggggagggaauuugaggggaggcugaggugccgucaggacuuuuuuuuuuuuuuuuuuuuugagauggaguuuugcucuuguugcccaggcuggagugcaauagcgcgaucuuggcucaccgcaaccuccgccucccagguucaagcgauucuccugccucagacuccuaaguagcugggauuacaggcaccugccaccacgccuggcuauuuuuuuguauuuuuaguagagaugggguuucaucauguuggccaggcuggucucgagcuccugaccucaggugaucugcccgccucggccuccaaaagugcuggaauuacaggcgugagccaccaugccuggccaucagaacuuguaaucaagacaguauguugagaaauucuaacauuauaaauuacaaagcuuugacuauuaaaguuuuugugaucuaaugauacaguuuugauucuauaguaauuuguggcuuauuuuauaguuuauaaugaauacuuauuucuagacucauacacuggaaggggacccggaaagguaauguaacucagugauuuuaaaacuugauuuuuuuaacugagaacuuuuuuugcccccugccuguagguuaagucuuacgugaaaugccaagauaauugcugagcagcuuugguuacccagggcggggucugggucugucuguacuuugccuuuacucuagauggcuccugagacacaggcaggacucccaagcaccggguugggaucugcccuggucccggcauuccaguauaagauugccucagaccuguguuuuucagacuggguuuuugcucuucacaugaaaucaaguuagaugacaaugacugguguugaaaaaaaugaaaaggaaagaauuuguaaagaacagaaaauauauuugaguaaguauuguuugguaaaacuuaguuacauaugcauauauauuuguuagguauauauguuuauguguauucugauguaaaauauauauauauauauauuuuauuacuauaguaccauggguaauggauaaagaaguuaaagcuacugcuuagaaugaagaaggccccaggcuuaccugucccgaucuuuaaacuguccgaaggaaauucaauagccuguuaagugaauaccuucauucuuacuuguauuugggggaauauuaugaaauacucaccacuuuugguauuuuaugaaaauguuuucuuuucagaaguuaugguaauuucaauguguuuguuguugggaggggagcugccaaaucaguuacuaauauuacugugugacaucuauccaacuuuuuucauuauucuucauugccaaauacugaaagacuuguaaauggcuuuggcaauauguuugaauucuaagaggaaauauuuucccauaauuguauaucagagaaauauagugauauacaauuuccuugaaaaccaauuucuaaauaauuuucuucucuguaaucuaaguguaaaaagguuuaguuuuuuaauagguuuagguguuuauaagcaauaguucucuauuuucuaguugauauaaguagaagaauugacaagugagauggaaauguuaauuuauaaagggaaagaaaagcuaggugagguugaguuauaauuaaacuguucaggaaacaucguaaaggcuuuaggcucccuuuuucauuucuauaccaauuaaucucauggguucuagagugguuaguucuacgggaauuguuuuuguuuuuguuuuuaaagaugcugaaaacuacucucaaucaaauuaguaccaucauuuaagcuuugaauacuuggcaguaauugccugggcucgucaauaaauguuagcaaauucuugauguuc

SEQ ID NO: 191229 - RNA, 41506 nt, Homo sapiens
gaacaucaagaauuugcuaacauuuauugacgagcccaggcaauuacugccaaguauucaaagcuuaaaugaugguacuaauuugauugagaguaguuuucagcaucuuuaaaaacaaaaacaaaaacaauucccguagaacuaaccacucuagaacccaugagauuaauugguauagaaaugaaaaagggagccuaaagccuuuacgauguuuccugaacaguuuaauuauaacucaaccucaccuagcuuuucuuucccuuuauaaauuaacauuuccaucucacuugucaauucuucuacuuauaucaacuagaaaauagagaacuauugcuuauaaacaccuaaaccuauuaaaaaacuaaaccuuuuuacacuuagauuacagagaagaaaauuauuuagaaauugguuuucaaggaaauuguauaucacuauauuucucugauauacaauuaugggaaaauauuuccucuuagaauucaaacauauugccaaagccauuuacaagucuuucaguauuuggcaaugaagaauaaugaaaaaaguuggauagaugucacacaguaauauuaguaacugauuuggcagcuccccucccaacaacaaacacauugaaauuaccauaacuucugaaaagaaaacauuuucauaaaauaccaaaaguggugaguauuucauaauauucccccaaauacaaguaagaaugaagguauucacuuaacaggcuauugaauuuccuucggacaguuuaaagaucgggacagguaagccuggggccuucuucauucuaagcaguagcuuuaacuucuuuauccauuacccaugguacuauaguaauaaaauauauauauauauauauuuuacaucagaauacacauaaacauauauaccuaacaaauauauaugcauauguaacuaaguuuuaccaaacaauacuuacucaaauauauuuucuguucuuuacaaauucuuuccuuuucauuuuuuucaacaccagucauugucaucuaacuugauuucaugugaagagcaaaaacccagucugaaaaacacaggucugaggcaaucuuauacuggaaugccgggaccagggcagaucccaacccggugcuugggaguccugccugugucucaggagccaucuagaguaaaggcaaaguacagacagacccagaccccgcccuggguaaccaaagcugcucagcaauuaucuuggcauuucacguaagacuuaaccuacaggcagggggcaaaaaaaguucucaguuaaaaaaaucaaguuuuaaaaucacugaguuacauuaccuuuccggguccccuuccaguguaugagucuagaaauaaguauucauuauaaacuauaaaauaagccacaaauuacuauagaaucaaaacuguaucauuagaucacaaaaacuuuaauagucaaagcuuuguaauuuauaauguuagaauuucucaacauacugucuugauuacaaguucugauggccaggcaugguggcucacgccuguaauuccagcacuuuuggaggccgaggcgggcagaucaccugaggucaggagcucgagaccagccuggccaacaugaugaaaccccaucucuacuaaaaauacaaaaaaauagccaggcgugguggcaggugccuguaaucccagcuacuuaggagucugaggcaggagaaucgcuugaaccugggaggcggagguugcggugagccaagaucgcgcuauugcacuccagccugggcaacaagagcaaaacuccaucucaaaaaaaaaaaaaaaaaaaaaguccugacggcaccucagccuccccucaaauucccuccccguccugcagaagcaacccuccaagacuucucccuuacuaaaaguacacucuucuuauagucuuauuaauaaaacaauguuauaauugcuaaauguaacacauuaccacauaaacacacuaaggcacgccgauuacuaggcuccuuagacaguggucaauuugaacaaauugauguuccuaaaccaaaaacucagcagcuuuuuucauucauaaaaacauguaucuucccgcuggaauuaccuccagccaaaauauaccgaguugggugcauggcauugauggaacacacagagacaagguauucuccaccaaacgaaugcacccucuuuccugucucauggaagauuucuacccgucguggaugggccaugcugccaacuaugacacagucuucuuguuuaggaucccacauggcuuggaaccuggucagccaucgcccagugaaaguguugugccuagugaggaaaacaauauauuuuuuaaaugaaguaagguuaaauaagguagcauugggcagaggguaaagacggcauugcuccuaaaugcuaguuuucucugccaaguuucuucucauuaaguuacugaguuaccaccaaccuuaccucauccuuacaggacugaaccucuggacagagacgauauccuccucaucuaaaaaucucccaaaauaaaacauauggagcccuuuauaguucccaaaagcaaaaacagaaguacugcccuuuuagucuuuuugccuuaauaucacuaacaauccuuuuucauuaaaguauggacuacacauuucccacugccacuuaaaugaccccaucauuaaugaaaauucuuacccccuagaauagucacccuacauaaauuuuuuaaaaauauacauaauauggccaggcacaguggcccaagccugucaucccagcacuuugggaggccgaggcagguggaacaccugaggucaggaguucgagaccagccuguccaacacggcgaaacccagucuacuaaaaacacaaaaauuggccagguacaguggcucacaccuguaaucccagcacuuugggaggccaagaggguggaucauucaaggucaggaguucgagacagccuggccaacauggugaaaccccgucucuacuaaaaauaggaaaauuagcuggccaugguggcgggugccuguaaucccagcuccuagggaggcugaggccggagaaucacuugaacccaggagauggaggcuacagugagccaagauugcaccacugcauuccagccugggcaacagagugagacucugucucaaaaaaaauaaaaauaaaaauacaaaaaguagccaggcaugguggugcuugccuguaaucccagcuacuggggaggcugaggcaggagaauugcuugaacccaggagauggaggcuacagugagccgagauugcaccacugcauuccagccugggcaacagagugagauucugucucaaaaaaaaaaauaaaaauacaaaaauuagccaggcaugguggugcuugccuguaaucccagcuacuggggaggcugaggcagaauugcuugaacccgggagguggagguugcagcgagcugagaucgcgccacugcacuccagcccccgugucagagggagacuccauuucaaaaaauuaaaauuaaaaauuaaaaaauaaaauaaauauacauaauacuggcugggcacaguggcucaugccuauaaucccagcacuuugcggggcugaggaagguggaucaucugaggucaggaguucaagaccagccugaccaacauggugaaaucccaucuccacuaaaaauaggaaaguuagccaggcauuguggcucaugccuguaauccagcuacucaggaggcugaggcacgagaacugcuugaacccaggaggcggagguugcagugagcccagaucaugccacugcacuccagcuugggcaacaagagcaagacuccguuuaaaaaaaaaaaagaaaacaaauaauuaaaaaaugggcaaaagaucugaauacacacuucucaaaagacgauauacaaauggccaauuauaugaaaauacguucaguaucacuaaucagugaaaugcaagguaaaaccacaaugagauaucaccuuacaucuaguagaauggccauuaugaaaacagcaaaagauagcaaguauugguaaagauauggagaagaaggaccccuuguacauuguugguggaaauguaaauuggugcagccauaauggaaaacaguaugagguuccucaaaaaaguaacaauggcacuaccauaugauccagcaaucccacuacugagaauauauccaaaggaaaugaacuaucuaugagauaccuguacucccacauucacugucacaucuaagauauggaaucaacaaaucaauggauaaaugaauaaagaaaacguaguauauacacauaacggaauacuauuucacuuaaaacaagaaaauccugucguggaugaaccuggagacauuauguuaaguaaaacaagccagguacagaaagacauauaccacaugaccucacucauauggggaauauuaaaaagcugaggcugguucaaagguaguaacuuaucuuaauugauuguucacagucaguuacagauaaaacucuuuguucuacucuuucccaccuucucacuacuacacuugacuagucuaaaaaauaauaauaaauaaaaaauaacaaaguuguaaggccgggcaugauggcucaugccuguaaugccaacacuucgggaggcccacgugggaggaucggcugaggccaggacuuccagaccagccugggcaacagcaaguccucaucucuacaaauaauuuuuuuaacuagcagggcaugguucugugugucugaagucccaucuacuugggaggcugaggcaagaggacugcucaaguccaggagauugaggcugaagugagccaugaucaugccaccacacuccauacugggcaagggagcgagacccuguuucuuuuuuuuuuuuuuuuuuaaaaaagagaguaguuaacaaacugcugggcagagagggaaagguuuggggagauguuggucaaaaacuauuaaauuucaguuaauaggagaaauacauucaagaggucuauuguacaucaggaugacuauagucaauaacaauauauuauauucuugaagauugcugacagauuuuaaguguucucaucacaaaaaaaugguaaguacgugagguaauacauauguuaauuagcuugauuuagccauuccacaauguauauauuucaaaacauguuguacaugauaaauacacacaauuuuauuagucaauuaaaaaauaagacuggaugcaguggcucaugucuguaaucucagcacuuuaggaggccaaggcaagcggaucacuugaggccagaaguucaaaaccagccuggccaacaugggaaacccugucucuacuaaaaaaaauacaaaaauuaguggggcauaguggugcaugccuguagucccagcuacucaagagguugaggcaggagaaucgccugaacccaggaggcggaggcugcagugagccgagaucgugccagugcacuccagccuggacaacagagcgagacucugucucuaaauaaaauaggcugggcacaguggcucacacuuguaaucccagcacuuugggaggccaagguggguggccgcuugaggucaaaaguuagagaccagccuaaccaauguggagaaaccucaucucuacuaaaaauacagaaauuaggcugggugugguggcucacgccuguaaucccagcacuuugggaggccgaggcaggugggucacgaggucaggagauggagaccauccuggcuaacacagugaaaccccaucucuacuaaaaauacaaaaaauucgccgggcaugguggcaggcgccuguagucccagcuacucaggaggcugaggcaggagaauggcaugaaccagggagguggagcuuguagugagccgagaucgcgagccugcacuccagccuggacaacagagugagacucugucucaaaaaaaaacaaaaaaacaaaaaacaaaaaaaaaaacagaaauuagccaggcaggguggcgugcaccuguaaucccagcuucuugggaggcugaggcaggagaauugcuugcacccaggaggcggaggcugcagugagccaagaucaugccacugcacuccagccugggcuacaaagugagacucuaucuuuaaaaaaaaauuaaaaaaaaaaaaaaauuguggaccugaaaaaaaaaaaaaaaaaaaaagaaacugauaaaauggaacaaaauguaugaagcaacaaucaauguauaucacacacuauucgcaacuucauaaauagugacaaagaggaauaucaaggagaaggcauugaguaaaguuugauguaaaauacacacauacaaggccaggcgccguggcuuacgccuguaaucccagcacuuugggaggccgaggcggguggaucacaagaucaggaguucgagaccagccugaccaacaugaugaaaccccgucgcuacuaaagauacaaaaaauuagcugggcauaguggugcaugccuguaaucccagcuacucaggaggcugaggcaggagaauagcuugaaccuaagaggugaagauugcagugagcagagaucacgccacugcacuccagccuaggcaacagagugacacuccaucucaaaaaaaaaaaaaaaaaaaaaauacacaaauacauucaaaguaguugaugcaagaguauaaucaaagaaaugaagugggaagauggggaagcccucaaggcccagaauaaacagacacaaauaaacagaccuucagacagccucaucagcaagugaguaguuacagucuucuuuaauaagauaacaugaguaauucaguucagaauaaagucauuaaccuuaaccaaaaauaaccucccaccugcagagaacagcuacugacuacaagagacugaaccucuacagacacagggaaccuggaagcaagaacccuucuggauaggaacuagcaaacugggacacuuauaauuuuuguauucaaaaaucaggacuauuacaucucuuugacaaucagaugucuaauguaugcacugcaacaaauaguucauaguaauccacaucuacauuauuuggcauauagaagccuaccugaugguggugaggagcggaaucuuagaagauauacagcugcugucaaaaauucugcaaaauaaagagaguaagacauucuuuuguuacuuaaaaacuuucugaaauaaauaucaguguauuuaacaagcuucucauuaauucaugguaugaaauauauaacugucacuuaaaaauauguaggaucaggccggguuuagaggcccaugccuguaauccacaggaggaucaccugaggccaagaguuugagaccaaccugggcaauacagugagacccaucuguacaaaaaauuuaaaaauuagcugggcauggggcacaugccuguaguccgagcuacucaggaggcugaggugagaagaucacuugagcccaggaguuugagauuacacuaagcuaugaucacucuacugcacuccagccugagcaacagagcgagaaccuugucuacaaaaaaaaaaaaaaaaaaaaaaaaaagaguaagaucaggcgcuaacaaaucuuggucaagauacuaaacaaaaguuacaagacguuuuauaaaauaagucagugcuuauaguuuagcguagaaaucauuuggcugaguguuguggcucaugccuguaaucucagcacuuugaggccaaggugggaggaucacuugaagccaggaguuugagaccagccugggcaauauagugagacccuaucacuacaaaaaaaaauuuaaaaaaaaauagcuagguaugguggcacaugccucuagacccagcuacuugggaagcugaggccguaagauugcuagagcccguaaguuggcuggagcccagcacgucaggguuguagugagccaugaucaugccacugcacuccagccugggcaacaaagagauacugucucuaaaaaaacaucaauaaugauaaaugaauagaaauaaaaugcccauucuaaagcgaucaucugaacuguaaaacuauauacaaaauucacaaaaauaugggacauaaaggauguggccugaaaauguacaaaucaccuaaaaguacaucuguguaucaagagcaguuucccugagacucaucagcugaaggccugauagugucauuuccagacuaagaccaaccagcaacaaaggagaggaguuguguuuugguuuucaagagacaacgucucauucugaugcccaggcugaagugcaauggcaccgucacagcucacuaaagccucaaccuccuaggcucaagugauccucccgccucagccucccaaguagcugggacuacaaguacacacuaccauaucuggcuaauuuuuucuguagagacagggucucuccuuggugcccaggcuggucucgaacuccugggcucaagugauccucccaccucagccucccgaaaugcugggauuauaggccuaagccacugcaccuggccaaagagaggaauuuuuauacagcaguuggagaggagucuagaagccuccacugagcacuacagcagaaggaaacuaacagcaucaccaccuccuucucuucuccuugugccuagcuuuucuagugugguuugcuggcacuagaguuuauugccuaaauagauuaguagaaagccaaaccacuaauaguuaauguaacaagaguaaacugcaguguaaacgaacaggaacagaauaagcagcuuuugagacaaaggaaacuacaugaguggaaacgggauccuggccuaccauucccgggugacucucuuccuacaacaccugguuaauacucacagacuuugcuagaaacuaacuagacaccugucacacacugcagaccacgcucuucccaucagguggguuuaaacagaaacugggugccauucuggagccuggugaacaguauacauucaacugaauaauauaugaauuccaaaaucacuuaagguaaaacucucauaaacugaaaaugcuugaaauuuuaagcaaaaucagggauucuaaaagagaacaaaauaauuuuccuuugugauuacacuaauguucccgacaucuuuauugacacuguuuucuguuuuuuguucgauugguuuauauuacacuuuaaauccauuuuuaggaaguagcuauaggaagguacuaaagcuaaaacccuagaacuauaaaaccauauccaauaguuuguauagaaucccaguuuuugcucuuuucugucugcccauggucuggggcucugcaauuuccauucagcacuucacuugcagaauagaucccacugaccccaaaguaugcuaaaauuaucuccuuuucaggauacuacacagccugguuucugggauucuucagugcuuaaagggaagccagaccauaaaccccccaggguaccuacggaccuuugccagucucaaggaaauuuccaggacccaaaaaccgcugaaaagccauuaaauacaggucaccagucuuuaggaaccuacauaugacuacuaaacaauaacacuagcaauuuaauagggaacagcaguaaacaaagcuuuugguuuacugacacaguagcuauagacucuuuagauucccuaaaaacauuucugccuucccaauuuaccucagauuacaaucagcacauguggucaccacucuguuaccaguaagaggugaaaaauaggcggaagcaaugcucuuuguauguucagucaaagaaaucaaaggcugacuucuccuggaauucaaucgccuugcaucauaaauaugaguaucccuguaaugggagaaacaaugaucaauguugccauaguacauguaaugaaccucuacaacagggcuaaacauaaguuagacacucacauacuugcuauacugaagaacauuuaagacagaacucucagccaggugcgguggcucaagucuguaaucccagcacuuugggagguggaggcagguggaucaucugagaucaggaguucgaaaccagccucaacauggagaaaccccgucucuacuaaaaauacaagauuaaugugguggugcaugccuguaaucccagcuacuugggaggcugaggcaggagaauugcuugaaccugggaggcggagguugcagugagccgagaucgcgccauugcacuccagccugggcaacaagagcaaaacuccauuucaaacaaacaaacaaacaaaaaaaaaaaacagaacucucuaaggccaggcaugguggcucacgccuguaaucccagcacuuugggaggccaaggcggguggaucacagggucaggaguucaagaccagccuggccaagacagugagacccugucucuacuaaaaauacaaacauuagcuagguaugguagugcacgccuauaaucccagcuacucaggaggcugaagcagaagaaucgcuugaaccugggaggcggagguugcagugagcugagaguaagauuccaucucaaaaaaaaaaaaaaaaaaaaagacagaacccucuaauacucuuauuaauuuccccaaaacugguauagauaacaaguacaauacuagacacaucucaaaacuauagcagauacuuggauccaguguguacagaaagacuuuuuuuuuuuuuuuuuuuuuuuuggagacaagagucucgcucugucauccaggcuggaaugcaauggugcaaucuuggcucacugcaacuuccgccuccuguguucaagugauucugugccucagccucccaaguaccugggauuacaggugcaugccaccacaccugguuaguuuuuguauuuuuaguagagacagggucucaccauauuggccaggcuggucucgaacuccugaccucaagugaucugccugccucagccucccaaagggcugggauuacaggcaugagccaccacgcccagcugucaaguuucuaguugguuuuucaauccuuccuagaaaaaaguuaacacaggccaacaaguuauaggucacauguaacuuuuuuuucugugaaauuuaaauuuucuucucauaagaggcgaaugcauauaaugccaaggaaaacaaaaauuucuuucagcuuuuucacuauuuaucaaaucuaaaagaauuuuucauuuucaaaaaaaaucacucaagucucaaucaguauagaaaggaaaauuacuuggccuuuggguauuacaaaaguaauaccuuuuguaauauuguauuacaauaucuuugacaaccaaacuaaaccauguaauugugacauuaaaaggucuaagucauaaagucuuauaaagaccauaccucaauccggcagugauaaaauacugucuaugcacuggguggacaugaacaguucuuauuuuucccauagaagaacugguaaguuucucauaagaaguuccagguguccgucuauccaccagugacauauuuccaucccaguguccuacuauuaaaguggaggcaucuucugccaagaagucgaaggaggaaaagcuacuucuuucauuucuauacaccuaagaauauaaguaacaaucagcuuauaucacacucuucuuguaaagaaagccaaagcauaaauucuuugguaaaaggguuauaaaacacuuuacccaaauaaccucauuuauccucucaucauccccaucagaugcacaggacauaauggaaacacagucaggguauuugggguuccauuaccuucaauauuuaucauuucuauguguugggaacauuucaaguccucucuucuggcuauuuuaaaauauacaauacacuguuguuaacuauaguuacccuauucugcuacugaacauuagaacuuauuccuucuaacugaaaauuaaaaaaaaaaaaaagaaacaaaacaaaacaaaaaagaaacaaaggcacugaucagcugugucuacaauuaaauggcccaucuacccaugucagggcuacaucccaaaucucucaauccaauaaaccucaguuccagaucuacccugugaaacuuaacagaaaagaacugaaugugaauucuacccaauugaaauuauauuuuaauaugcaaaguaacuuugccaaccaaguccaagacacacagcugaaugcucaccuacucucaguagaagaguaaauauauacauuuuugacaguuaaucaggcuacaucuaucaaaauguuuaaugcuuauacuuuuugacccaguaauuucacuaagagaucuauaaaaaugucugcugcaagauugcuuauaauagcaauaagaagcaacauaaauauccaccaagagagaucugguuaaauaaaugaugauccaccucuauuuugaaauaccaugcaaugcuaaaaagaauaagguaguuuuauaguauuaacuguccaagauauacuauuaagugaaaagaguugcaaaaggcuauguauauuaguaugaagccauuaguauaaagaagaggagaaaaaaauguauaacuauaugcuuguaagcauagguguacuuuguggaagcauacucaagauaugcaacaacgguuacuugugauaaugggaaugaacaacaggcagauuuacuuucauaucugauuuacuguaaauauuuuaucaugagcguguuuuuuuuuuuuuugagacagagucucacucuguugcccaggcuggaguacaguggcacgaucucggcucaaugcaaucuccgccuccuggcuucaagugauucuccugccucagccucccaaguagcuaagauuacuggugcgugccaccaugcccgacuauaucaugagcacguuauuaaguuuuuaaucacauguaaucuacaaugcaaucacuuuggguuuaggacucaugcacauaaagaauaaaaaauaaaucuuccugucaauuaagaggggaugaccacaauucuuauuguugaaucaugaacugauuuuuaguuuuaaaaacaaguguuauaaacuaagaauaaauuaauaugcuaaaggcaucacaaccuucacaccccacaaaaagaccaauauauacaaaugaaaacuuggcauacucaauauauuuaaaugauuaagagcaggggcuuuggagucacacaaauccugguguaaauucuuguucugccaucuauguccuugagcaaccucauaaaccucucugccucaguuuuuucaccuguuaaaugcaauaacauuacucauuuucuaggguguuauaaggcuuaaugauguauauaaagcacacucaagauagugccuaguauaagguaacuguuuagucagugguaucugaaacaaauuacgaauauaugcaauagcaugaacgcaucuuaaaacuguuacucuagguaaaagccagaaacaaaagucuacaaaucauauaauuccaacugccugacauucagaaaaaggcaaaacuauggggacaguaaucacuucaguaguugccagggauugcaggcaaugggaggagaaugacuacaaaaggucaugacguaaucuugagggaaauggaaaauuucuuuuuuuuuuuuuuuugagauggagucucacucugucacacagacuagaguacaauggcacaaucuuggcucacugcaaccucugccuccuggguucaagcgauucuccguggccuagccuucugaguagcugggacuacaggcgugagccaccaugcccaucuaauuuuuuguguuuuuaguagagaugggguuucaccauguuggccaggcuggucucgaacuccucaccucaagugauccaccugccucggccucccaaagcgcugggauuacaggcgugagccacugcgcccagcucuauaucuugauuacgauaguuacacauguguacacaauucaccaaaacucagagaauuauauaccuaaagugguaaauuguaccauauguaacuuuuuuugagagucucccucugucacccagacuggagcgcagugaugcaaucucggcuuacuggagccucacccuuccagguucaagugauucucaugccucaggccucccaaguagcugggaccacaggcgcaugcuaccacgcccagcuaauuuuuguauucuuuuagaggugcgguuucacuauguuggccaggcuggucuugaacuccugagcucuagugauccacccuccucggccucugucagugcugagauuacaggugugagcuaccaugcccaaccuauucuuuguauuauugcaaauaaugcuuguaugaacauucccguacaaguuuuuguguggacaugugcuuucauuucucuuggguguauaccuaggagggauauugcuaggucauaugguaacucuguuuaacauuuaaggaacugucaaacuuuccccaaccaacuuuaccauuucacauaccaauucucaaaauaugaggguuucaauuuuuccacaucauugucaacacuuauuacuggcaaguaucguuauccuagugaguguaaagggguaucucauugugauuugcauuucccuaaugaauaaugaugcuuagaaucuuuucaugugcuuauuugccauuugugggguuuuuuuguuuuuuuuuguuuuuuuuuuuugagacagucucgcucugucgcccaggcuggagugcaguggugcaaucucaccucacugcaaacuccaccucccggguucaagcgauucuccugccucagcguccccaguagcugggacuacaggugccugccaccgcgccuggcuaauuuuuguauuuuuaguagagaugggguuucaccauguuggccaggcuggucucaaauuccugaccucaggugauccacccgccucagccucccaaaguucugggauuacaggggugagccaccgcacccggugccauuuguguuucuuuaaagaaauguuuauucagauccuuugcccauuuuuuaauuggguuagcuuuuuuaauuaagcuauaggaguucuccaccuauuguuuuaaagucaagcuuauugaaauguaaguuacagccaggcgcgguggcucaugccuguaauaccagcacuuuggaaggccaaggugggcagaucacuugagcucaggaguuugagaccagccugggcaacauggcaaaacaccgucucuacuaaaaauacaaaaauuagccaagcauggugacacaugacuauaguuccagcuacucaggaggcuuaggugggaggaucacgugagccugggaggcagaggcugcggugagccgagaucaagccacuucacuccagcuggagugacagagugagacccccaucucaaaaaauaaaaauaaguaaggccaggcgugguggcucacaccuguaaucccaagacuuugggaggccaagguggguggaucaccugaggucaggaguucaagaccagccuggccaacauggggaaacccugucucuacuaaaaauacaaaaauuagccaggugugguggcacgugccuguaaucccagcuacucaggaggaugaggcaggagaauugcuugaacccgggagguggaaguugcagugagccaagauugcacugcugcacugcagccugggcaacaagagcgagacucuguuucaaaaauaaauauauaaagaaagaauagaaacacaaauguucaucaacugaugaacagaugaauaaaauguggaauacccauacaauggcauauuaugcagccauaaaaaggaaugaaguacugauacacggcuacaacauggaugaacuuugaauacauuuuguuaaagaaaccagucacaaaagaccacaaauuguaugauuucauuuauaugaaauguccagaagaggcaaaucugaccacacacaguggcucacgcuguaaucccagcacuuugggaggcugaggcagguggauuacaaggucaggaguucgagaccagccuggucaacauggugaaaccccgucccuacuaaaaauacaaaaauuagcuuggcaugguggcaugcgccuguagucccagcuacucaggaggcugagacaggagaaucacuugaaccugggaggcggagcuugcagugagccaagaucgcaccacugcacuccagccugggcgacagagugagacuccaucucuacaacaacaacaacgacgacaacaacaacaacaacaaauuacccgggcgugaugaugggugccuguaaucccugcuacucaggaggcugaggcagaagaauugcuugaaccugggaggcagaaguugcagugagccgagaucucgccacugcacuccagccuaggugacgagaguaaaacuccgucucaaaaaaaauaaaauaaaaaaguucaacuuauaagacuuaucuuauugaggcaaucugauacaguuaagcaaaucugaaaguucauuucaaaugauauguuuguuuuaaacauuaaguagaagaugucuuauuuugagagagggucucacucugucacccaggcugaagugcaaugauguaugugaucacggcuuuacuacagccucaaucuccugggcucaagcaauccucacaccucagccuccugaguagcugugacuacaggcacaugccaccacaccaagcuaauuuuuuuuagagacaaggucuuacuauguugcccaggcugaucuugaacuccugggcucaagugauucucccaccucagccuccugaguagcugagacuacaggcacacaccaccaagcucagcuaauauuuuuuauuuucuguagagacaaggucucgccauguugcccaggcuggucuggaacuccuggccugaagugagucucccaccuuggcuucccaaagugcugagauuacaagcaugagccaccacacccagcuaaauacaagucuuaugccuaaaaacagaagaguaaguuauuuuaguuaaaagcuuugggagagaaaaaaaaaagaaauuuaacaagcgcaaacacauacuaugugccaggcucucuucuaaguacuuuaucugcauaagcucauuaaauucucaugacaacccuguaaggucaguccuguuaaaucccauuucacagcuaaggaaagugaggcacaacaagguuaagcaacuugucaaggucauacaacuaguaacagaugaucugggauuugaacuuaggcagcguaguucucaaaguccuucugcuauaccacuucucccaauugguauaauaauuauucauguggcauuucgaagaaucuagaauaucaucugaagucagcauguaaacacauuaacauuuaccucuucaaaaauagcccuggaaaaauccccacagcguaacgugccaucauagcucagugacaguaugugggccggauuggcgggugagaaguaaagacagcuaacuggcugacuauggggaugaaaaacauaaacuccaucuucuuuagguugcugggucuggaagagaguugcgggaaaggggagagagaaaaaaacuagugaaaaauagugauuuuugcuaugcuauuaugucauuaaagaauuuacacuggauuauauucagucuuuucuuagucuauaauuguaaccacucuccccuucacaaagucagaaugagaaacuuuaucuugucauuaacuuuuuucuaguuuucaauccaacaauaccaagucacauuaacagugaccagcuuucuguaacuaacaaaauaguuuauauauuacugucaguuuauaaaauccucaggaaaugauaaaucuacucuauuucacacaugguauaauugcuaacuaaaacaguaucaguaccuuaccacuuugcuucugcagcaggcuucuucuguauaauauuaacuuacucauucucaguguaauuuucguaagguauuugguccugggacaaagauaaugguuuuaaacauacuuuguccucuaaaugcaccauaaaaauggccgggcgcgguggcucacgccuguaauccuagcacuuugggaggccaaggcgggcggaucacgaggucaggagaucgagaccauccuggcuaacauggugaaaccccaucucuacuaaaaauacaaaaaacuagccgggcgugguggccggcaccuguagucccaucuacucgggaggcugaggcaggagaauggcaugaauccgggagguggagcuugcagugagccgacaucucaccacugcacuccagccugggugacagagcaagacuccgucucaaaaaauaaaauaaaauaaaauaaaauaaaauaaaauaaaauaaaaaaauaacaccauaaaaaugcauguauuugaauuuccauauuaauauaccuacuccuaaggacuauccuuuccacaacuggauugccagcuccugagaagucgcuuuucagaacaaguuauguuucuaugccauauggcauauuaugaaccaaagaaucaccucuaaaucuggcuuacucuacucugaaauggucaagcauuuuuguuuucuuuuuuauuuuaaauuuuaaaauggagagaaguauucuuuaaaagaaaaaauaagagaaaaaauuauuauaaucacacauacucuuccuguuaccagaguuagaaacuacugacauauuuguuuauagcauuuguuuucuagaaaaauaaaauuuucucuugguauaaagaacucaaacaaugcagaaauguacaaagauggaaguuuuaaaaaaaucacuccaggccaggcgcgguggcucaccuguaaucccagcacuuugggaggcugagguggguggaucacgaggucaggaauucaagaccagccuggccaagauggugaaaccccgucucuacuaaaaauacaaaaauuagccgggcgugguggcagacaccuguaauuccagcuacucaggaggcugaggcagagaauugcuugaaccggggaggcagagguugcagugagccaagauugcaccacugaacuccagccugggcgacaaagcgagacuccgucucaaaaaaaaaaaucauuccaaaucuaaaauuaaccaaaauuaucauugaaacacugagauuauagacaucuuuauaguuaaauuuaaugugauuuaaaacggcauauacagcaugguccuuuuuuaaaauuucuucgcuaucauucuaucuguauagguacacauaaaucugucaaaauaauauaagaaaaugaagcuaaaggaauuuuugaauuucaaguauuuacagagacauuaucuucuacaauggcaaaaguauaaaacaaaaagcaauuguagucauuaugcuuuuuauuuuuuaaacuguuaauuuuagauaauuuauauugauuugagaauauuauucucacccuuccuccaacagucuuuuuuuuuuuuuuuuugagaugaagucucacucugucacccaggcuugagugcaguggcacgaucucagcucacugcaaccuccaccucccagguucaagcgauucuccugucucagccuccugagucgcugggauuacaggcacccaccaccaugcuuggcuaauuuuuguauuuuuaguggagacgggguuucaccauguugagacagcagguaaucugaaaugcaguuuuuuuggccucaaaaaaaaaaaaaaaaaagucucaacucugucgcccaggcuggagugcaguggugcaaugccggcucacugcaaccucugccucccggguucaagcaauucuccugccuuaguuucccaaguggcugggauuacaggugcacaucaccauacccagcuaauuuuguauuuuuaguagagacaggguuucaccauguuagucaggcugaucuugaacucgaccucaggugauucaccugccucagccucccaaaguguugggauuacaggcaugagccacugcgcccggccuuguucauuauuuuauaccaggauucauaccaccuacuuguauggcgguggaggguguuaccacucccgugggccaagaaaacuuccuuugaagacaaucaguucuacuacucacugucccuacuucuucuauuuuuccugauuucaccccagcaacuauuuccccauuccucauugaaaagaggaaaaaucggaauacccaaugugcuucucucuacuuuugauaauauagaaaauucucaggauuuggucaauuuaccaguauagauucugcacacggggcagggcagaagcuaaauuaugcugucuccuagcucugcuacagauuuguuucucuccuugguagcuaguuuuugaaguauacuacauuagguucugcuucuuucuuauugcaguaagugaauuuuuuuucuuuuuuugagauagggucucacucugucaauccagccuggaguacagugacacaaucauggcucacugcagccucaaccgccuugagcucaggugauauucccagcucaacuuccugaguagcugggacuaauggcacacaccacuacauccaguuuuuuuuuuguuuguuuguuuuuuuuaagagacaggcaucucacuaugucaccuaggcaggucucaaauuagugggcuuaagccauccuccugccuugacuucccaaagcccuggaauuacaagcaugagccacugcacccagccagcaugagggaucuuauagggaugaugaaaauguucuaaaaccagacuaugauaauuaaacaacuaaguaaacuuauuaaaaaccacugaggccaggugcaguggcucacgccuguaaucgcagcucugggaggccgaagcaggugaaaaucacuugaggucaggaguuccagaucagccuggccaacauggagaagccucaucucuacaaaaaauacaaaaauuaggcugggcacggugacucauucguguaaacccagcacuuugggaggccgaggcggguggauuacaaggucaggaguucaagaccagccuggccaagauggugaaaccccaucucuacuaaaaaaacaaaaaaauuagccaggugugguagcggacgccuguaaucccagccacuugggaggcugaggcagagaacugcuugaacccaggaggcggaggcugcagugagcagagaucacgccacugcaugccagccugggcaacagagcaagacucgucucaaaaaaaaaaaaauuagccagguguggcagcgagcgccuauaaucccagcuacucaggaggcugaggcacgagaaucaccugaacccaggaggcagagauugcagugagccaggaucacaccacagcacuccagccugggugacagagcaagauucccaucucaaaaaaaaagaaaaaaaagcauugaauuuuacauuuuuuaaauaggauuuuaugauagguaaauuauuaccucaaugaagccauuuuuuaaaaaaacuggggaaauugugagcacaggauagacaagguaauauugcuuuuagacuuguuaaaucuguuaaugagauugccaaauguccuggaaaauuagguugauggagauacuggacuacagagaccuaguaauacagauuuuuuuuuuuuuuuuuuuuuuuugaggugguguuuugcucuuguuucccaggcuggagugcaauggcgccaucucggcucacugcaaccuccgucuccuguguucaagcaaaucuccugccucagccucccaaguagcugggauuacaggcaugugccaccaugcccggcuaauuuuguaucuuuaguagagaugggauuucaucauguuguucaggcuggucuugaacuccagaccucaggugauccgccaaaccuuggcaucccaaagugcugggaucacaggugugagccaccgcguccggcuguaauacagauuuuuggagucaucaugaaagauaugaaaaaaggauuuuuauguaugucuuaaaucuauacagaucaacucauccaaaaaaaaaccuucauuuaaucaugcuaauuuucaauuuuuccuuugcaaaauucuucaaaaaguagucucagaugggugugguggcucacaccuguaaucccagcacuuugggaggcugaagcagguggagugcuugagcucaggaguuugagaugagccuaggcaacauagugagacccaucucuacaaaaaguuaaaaaauuagccaggugugguggcacaugaccguagucccagcuacgcaggaagcugagguggagaauugcuugaccgugggaaguugaggcugcagugagcuaugaucaugccacugcacuccagccugggcaacagagugggaccguaucucaggggcgggaaaaaaaaaaaaaagucucuauccaaugcuucuccaguucuuucauuacccccauacuuccuuaaucuccuaaagccuuuguuccuuacuuaccucauugucaaagcuauucucucaacucacuacaugguacccuauuuucaaaaucaauggccuuuucuccauucuuuuaacuucucugcaaaaggcucugucaaccucccauccuugaaacucaucucuuggcuuccaaaacauacuauucugaucuucuucccacuuuuuugcuucaguuuucuuugcuaaauccuaucaccuccuauccccacucacaucuuaucaaaauaagggagaaucuaugaucccaaaauaagaacuugguuucugucuucaaacuugcaaauuuuguuuauaaaccccaaccaacuucaagucaccacuauuucuucaccuucauuaauuguccuuauggcauuuuucaugucuuuggucuucuuccccaauaagaaaauaaauucagagaacauuaacuugacuuuucucaauuuuguaauaacagacaguauuucaugcagaauuauaugcacaaugaauggaauucaguaucuauuucugacucaucaaagauaacuaaaaucauuccaaagcaggucccugggaagauauuuugauacagcuuagaaacuguuucuuaguccauuugggaugcuaaaacaacauaccauaaacugaguggcuuaucaacagcagcauuuuauuucucacaguccuggugacuaggaagaccaagaucaagcuuccaguucauucagugucugguaagggccuacuuucugguucauaguuggugccuucuagcuguguccucauaugguagaagggacaguggucucuccuggguuucuuuuauaagggcacuaaucuuauucaugaccuaaucaccucccaaagguccuaccuccuaauaccauagggauuaguauuucaacauaugaauuuuggggaagacaaaaacauucagaccauagcagaccauauuuuaaacacaacuagaaaacuaaacuucgggcugggcgccguggcucaugccuguaaucccagcacuuugggaggccaaggcaggcagaucacgaggucaggagaucaagaccauggggaaaccccaccucuacuaaaaauagaaaaaauuagccaggcaugguggcaggcgccuguagucccagcuacucgggagguugaggcaagagaauggcgugaaccugagaggcggagcuugcagugagccgagaucacaccacugcacuccagccugggcgacagagcaagacucccucuccaaaaaaagaaaacuaaacuuugaucuuuuuuuuuuuuuuuuuuuuuuuuuuuacacagagucucgcucugucgcccaggcuggagugcaguggugcgaucucggcucacugcaagcucccccucccagguucacgccauucuccugcuucagccucccgaguagcugggacuacaggcaccugccaccacgccuagcuaauuuguuccauuuuuaguagcgaugggguuuuuuaguagagacgcgguuucacuguguuagccaggacggucucgaucuccugacuucgugauccacccgccucggccucccaaagugcugggauuacaggcgugagccaccgcucccagcccuuuuuuuuuuuuugagacggagucuuacucuaucacccaggcuggauggcacagugucgacucacuccaaccuccgucuccuggguucaagcaauucuccugccucagccuccugaguagcugggauuacaggcaccuaccaccacgcccagcuaauuuuuguauuuuuuuacuacagacgggguuucaccauguuggccaggcuggucucgaacuccugaccucaggugauccgaccgccucagccucucaaagugcuggcauuacaggcgugacccaccgcacccggccacuuuaaauguauaugugaaaagaucacacaaaguguaacaaaguuuucuggcaguuaauuuaugaccagaugguuaaugauauucaagcuaaaaauauuaaaguucuauaaagcaaauuuaaauucuuccagauuucuaaaauuuggaaucauaaagcaucauaaagcccaaaauuguaagucucacgcaacauuuauaaacacauggcucuagccuauucucuuccagccuauuugcuuuagucaaacuauaauauauucaagaaauuuaauaacuuaccaaaucacaaaguccaacuugcccaaauuuggccccaacugcuaccaaaguucuaguuucugauggauggagagccauagagaauauugggccugugguaacuuuguaaacgguaucuucacuaaugaccaugccauuuaaauuggcuuuguagcuaagaaaauuacaaaguuaaauuuuguaaguaaaaccaaucucaauagucaaaauaaguaaaagauuauucaaaaagaaaaaucacaauuagcaaauaaauaugggaacuauucaaucuccugguaaccaaggaaaucaaauuaagcaauauucuuucacuuuuuaaauuacccuugauaauuuuaauaacaccaaaagcugguaggcugcaguuaaauacacauacucacacauauugcuaguggaagaguaaguucauauaaaauguucagaagaaaaaaaaagaccuuugagcaacaauucggcaauguguacuaaaagccauaaaaauguucacaauauuugaugcauuaaucucacuucuggaaaucuaaccuaaagaaauaauccacuaucauauccauauacuucaacaaacacauacacaaacacacaaagcuaaauggaaaacaaccgcaaauaccaagcagguaggaggagaagugaacuccuucuacucaauggaauauuuuauaauuauucaauaauuuuaaagacucuaguaacaugcaaccgcaaaugaaaaaaaacauaacgcaggccaggcacacuggcucacaccuguaaucccagcacuuugggaguccaaggcagacagcucacuugagcccagguauucaagaccaaccugggcaacacagcaaaaucucaucucuacaaauacaaaaauuagugagaugugauggugcacgccuguaguccaagcuacuugggaggcugaggugggaggaucauuugagcccaggaagcgaagguugcaaugagccaagauagugccacugcacugcagccuaagcgauagagggagaccuugucucaaaaaacaaaaaaaaaaaaaaaaaaaaagaaaaagaaaaaaguguaaugcaaaauuguauauacauuacaacauauaguaaaaauguauguggauucacucauuuauucaacacugaacauauauuaugugccaggcacuguucugguuauugaaauagaauucuugcuuauauccuagugguauuguauaugaagcuuauauccuagugguauuguauauggcaacacuugugaggaaauacacaaaaacaacaguuguuaggguggaaacauuucaucucacuuucaaaauucccuaaaauggcguauagucuuuauaacucaaacaucucaaaaaauauaaaagaaacacaaggaauuucaacuuaccuuuuaaugcuagauaaucccuucucaguguucuuacuacuuggcugaaacauugggagagaugaaagaacuaaguuaguauguauauauuuuuacauauauauauauuuccuuaacagaugauucuaaaggcuauuggccuucccaagugauaccuugcucauuccugcccaugugugcagaaauccuuuaaaucguucauuguugucuucuugauuuucagaagucauuucuaaaggcccaggagguaacaaaggcuguuauaaaaaauaaaaaguuauuuguugggcucccugcccuagaauauaaacacaaggagggcaaggguauuugucuguuuuccccacaacuucacuuucaacaucaacaguaaugguggcauaucauggacauucaaaauaauuguucaauaaaugaaugccagguacccuauaaaguaauaauaacauguauuaucucauuuaauccucucaacaaccuagcaaaugagguaucacauuuuaaagacaguggauugaaacuuagagacuguaaucccagcacuuuggcaggccgaggcaggcggaucacaaggucaggaguucgagaccagccuggccaauauggugaaaucccaucucuacuaaaaauacaaaaauuugcugggcgugguggcaggcaccuguaaucccagcagcucaggaggcugaggcaggagaaucgugugaacccagguguuggagguugcagugagccaagacugcacuauugcacuccagccugggugacagggcaagacuccaucucaaaaaaaaacaaaaaacaaaaacaaaaaaaccccagaaacuuaagaggaguuaacuugcccaaagucacacagccaauaacuggagaagcugagaauugacucagauuaucuuaacucauuacucaguauuauaccuacaucaguauuuuuuuaaacaguuuguaaccaauuagugggugagaaaucauguuaguaugucacaacuagcaauuuguuguagugaaugagaauagaauagaaauaccaggccagguacauggcucacaccugugaucccugcacuuugggaggcugaggcaggcaaauagcuugaggccagaaguuccagaccagccuggccaacauggcgaaaccccauuucuacuaaaaauacaaaaauuagccaugcgugggccgggugcgguggcucauaccuguaauccuagcauuuugggaggccgaggcgggcagaucaugaggucagauugagaccauccuggcuaacgcagugaaaccccaucucuacuaaaaauacaaaaaaauuagccgggcgugguggcaggugccuauagucccagcggaggcugagccaggagaauggcaugaaccugggaugcagagcuuacagugagccaaaaucacagcaccgcacuccagccugggcaacagauugagacuccgucucaaaaaaaaaaaaaaaaaaacaaaaaaacaaaacuuagccaggcgugguagcacacaccuacagucccagcuacucuggaggcucaggcaugagaaucacuugaacccgggaggcggagguugcagugaacugagauugugccacugcacuccagccugggugacagagggagacucugucucagaaagaaaaaaaaaaaagaaauaccaaagugcaccacauguauuaagugucguuugacaaacugugguuucaguugcauauaugugugauaguuacaauguaaauaaauauauauauauauuuuuaaauuaacgucucaagugaugcucccaccucagccuccugaggagcugggacuacaggcacaugccaccacacccagcugauuuuuguauuuuuuuuguaagaacagggucucuugauguugccuaggcuggucucaaacuucuggguucaagcgauccuccugccucagccucccaaagugcugggauuacaggcaugaaccacuacaccuggccacaaauauauuucuugugggcugaggcuucaaaaaaauuugaagcuacucuucuaugcugcuucccauaacaccuagauuugcaauuugcucccaaaacaccagccuaauuagugcuaucuuccuauuuacaauuaaacacuuacauauaaaguauuaaaaauagguguucuugaauaaaaaauauuuagaaaauguuugcuaaauaaaacucuacucacuaaaacuacacauuaucacguauuuauuaacauuaauaacuauauucuauugauuacuaagccccuaauaugugagaaacuuuauagauaugauuucauuuaucuuuacaguagcucuuugagguuuuuuuuuuaaacugacauaaaauuguacauauuuacugaggguucuauuauugcugacuuuuuuuuaauggagaaacaaucagaaagguuaauuaacucacccacaauccuaagcagguaaguccugcagaaauacagaauccaauacagucuuuacgacuucgaaaucuuacucauuaaagcguacaaaugggccgggcacaguggcucacaccuguaaucccagcacuuugggaggccgaggcaggcagaccacuucaggucaggaguucaagaccagccuggccagcauggugaaaccccgucucuaccaaaaauaaaaaaaaucagccagguaugguggcaugugccuguaaucccagcuauucgggaggcugaggcaggagaaucgcuugaacacgggaggaggggguugcagugaggcaagaucaugccacugcacuccagucugggcgacagagugagacuccaucucaaaaaaacaaaacaaaaccauacaacauucaaguauuaaugaaauauaaaauuaaacauaauuuaaugaacuuuuagucuaguuucaacacuucaaauuuuucaguauuuuauuacauuaaaauauuauauuugcacauuuccuuacaguuucaucugcuacuaaugucggcgguguuggagcugcugguaaugaaacucccgaaggaucaacuuuuaguaaucgcauugaccuucuacauccaaucccauuuucucucuuaggcuucuuucuaaaggaguggggaaaaacucauguuauacucacaaaacaauaaaauguauuuacuaauacuaaagagauaacuucuaggaauauauaccacagauauauuuauaaacugcauagauauauauauacauggccacaauuaucuuaauaagaaguauggaaaaaacaaaccuaaauguucaucaaaaagaggugaggucuguuaaauuaugguauacauaucuaauagaauaauacgcagccauaaaaagaaugauauagaucuuuaugcacugcugaaaggaacccuugguuauaaaaagcaaaaacaaaguccaguacauguauacaaaaagguuacauauacacauacauuuguacaugcugagguuaccuuuggaggaauacacauaaaacuacuacuucuagggaaaaggccuggaaaacuaaggucuaaaauaggaaggaaacuuaaaacguuucacugcauucccuuccauacacuguaguuuacuuuuuaaauaauauacauucucuauuuuuuuaugcacuauuuuuucauuuuuaaaaaaguaauucauuuuaaaauguuggggaaagagaagccucugaaauuauuuccaaaaauucacauaaaaaauuaucaguuauaguccacauuacuucgagaauuaguaaaaccuacugauugaaaguauacuauauacuaaaaacuguagucaacauuccaucucauauuuaauccucaaaaaagacaccugaguauauggaauaauaugggcugucauacaauccuagaaaucuacuccuagagaaacucccauacauaagcacuaagagacuuaagaauguuuggagcagcacuuuucauaauaaaaauaacaacucaauuguucaucaacaguagaauaaaauguaguacauucauacaguggaauaucauauagcagaaaaaaagaacgaaauaaagcugugcgcaucaacauggguaaauuuaaaagcauaaauauguaaagaugagcaaaauaagaaaaucucagaauauaaaaaaggcauauuguaugugaacaccaaaaaaagacaaagcuaaacaauauaguguuuaaggauacacucacugguaguaaaacuauaaaucaauagccaggcacaguggcucacaccuguaaucccagcacuuugggaggcugagguggguggaucacuugagguccagaguuccagaccagccuugccaacauggcgaaaccccguaucuacuaaaaauacaaaauuuagcagagcauggucaugagcaccuguaaucccagcuacucagaaggcugaggcaugagaauugcuugaaccugggaggcagaggcugcagugagccaagauuacaccacuguacuccagccugggcaacagagcaagacucugucucaaaaaaauaaauaaauaaaaaugaaacuauaggcugggcacaguggcucacgccuguaaucccagcacuuugggaggccgaggcaggcggaucacgaggucaggagauugagaccauccuggcuaacacggugaaaccccgucuacuaaaaauccaaaaaauuagccgggcgugguggcgggcgccuauagucccaguuacucgggaggcugaggcaggagaauggcaugaaccugggagguggagguugcagugagccgagaucgcgccacugcacuccagacugggcaacagagcgagacuccaucucaaaaaaaaaaaaaaaagcaauaaauaaaugcaaggaaauauuaccacaaaauucagcauagugguuguaucgggagggagggguauauaugggccuucagggguauucguaauuucuauuaaccuggauggcagguacauggaugggaccuguauaauuuuucaacuacacaaauacauuauauguaccuuuuuauauguauauuuaauaauuuucaaaaaauuuaaauccuucuagauuagcauaaugccagcuuuacagaaagaaaaauuauauaaaguauccaagguuacugucauagcuguaagugacugaaucaaaacuugaacccaaauuugcuaaaucucaaaggcuacacuucugcgcuacauuacacaacuuccauacuaucaacuugcuacugccuauacaacuauuaagggcuagaauuuugugauuuaggaagaaaucaccaaucuuggcuaauaaaaaaaugcaaauguaaagcuacuaaucagcgggcaacaggaccagugcuacuguuuuuccaguguuaaugauguuccucuuauaguaacuuuucacacuugaaaauaccuggccaugauuaaagguccagcuuuucucaagcuaauuguccuguaacagaaucaaaccaaguaaaugaagcuacauuucauuaggaacuggcacuaaacaaaugagcuaaugauaccaagauuuuaguuucuucauuuauauguaagcacugcuaaaaugcaauggagauaauucaaaauuuaaacacccuugaguucaaauccuaaagcuaccacuuauaagcuguuuugacuuucagcaaauaguuguuuuuuuuuguuuuuuuuuuuuuugugagauggagucucacucuuauugcccaggcuggagugcaauggugcaaucuuggcucaccaugaccucugccucccggguucaagcgauucuccugcuuuagccucuugaguagcugggauucagacaugugccaccacacccggcuaauuuuuaauuuuuuuuuuuuuuuuaguagcgaugggguuucuccauguuggucaggccagucuugaacucucgaccucaggugacccccugacucaaccucccaaagugcugggauuauaggcaugagccacugcacccagccaacaauuuuaucuuuugagccugauuucuaacucacaaaaugaauauauuaccuaccacaugcagugguugucagaguuaaaugagauaauauaggacaaaauugcuagaucacugcaguauguuucagagauauucaauaaauguuaauuccuuuccuuuauucuaggacuaagaaagcaaaaacaaauugagacgcaaaaagauagccagaaaaauuaaaaguaaguagaagaaucuuuaauaguuuucuaagugacaguaauuuaguggaaauaaagauuucccuucauuaguagcaacaauaaauauaaacaaaauucagcucuccauuuuauuugcuccauauuccuuugaugaagaugagaauuguaaaguuauuaaaggguagcauucccucagagauccuagagggacugagauuaaauagcacuuuaugaucuguuaagcuuaccacaccaaaccauuuuuuucaaauuauaaaacaguugagcaauguaucaugguucaggcauugcaaacuagauauuuuaccuuuuggauuuaggaggcugucucuucucuaucauuucacggagucuugcagcagacuguaaaguauaaaaaucauguaaaaauguuauaacuacguaucuuaccuuuuaaaauauuaagcaucugcuacuauacccacacuaaacuaaggucuauucaggaacuaaagauccuuaagauaggccaugagucaugaucagcgccacuguacuccagccugggcaacgcagcgagacccugucucaaaaaaaaaaaagacaggccaggcaugguggaucacaacuguaaucccagcacuuugggaggucaaggcaaguagaucacccgaggucagcaguucgagaccagccuuaccaacauggugaaaccccauuccuacuaaaaauacaaaaauuacaggcgugguggcgggcgccuguaaucccagcuacuugggaagcuaagguaggagaaucacuugaacccgggaggcagagguugcagugagccaagaucgugccauugcacuccagccugggcaacaagagcaaaacuccgucucaaaaaaaaaaaaaaagacaaaaaaaauaaugccuuagaaucaacagaguacaguaaccucuuccuauuaagcacaaaaccugcuccaauuuuacccucccucauaugacacuaugaaaccugauauguuauugaccuggugggaguuaugacaucuuggguuuuacggcucuuguuguugcuguuuugagacagggucuggcucuguugcccaagcuggaaugcaguggcaugaucauagcucacggcagccuugacuuuccaaacucaagccauccuuccaccucagccaccccaguagcuaggacuccagacaugcaucacuaugcucaacuaauuuacuuuuuauagagauugggguggggggcggggggcggggggcgggucuccguauguuacccaggcugaucucgaacuccuggccucaagcgauucucccaugucagccuccccaagugacaggauuacaggcgcuacccacuguucccggcccugcaucuugcuuuuaaauagacuccacacaaaccucagacaacugaagagaagcaaaaaagucugcguuuucugauauguucuucagucucuuccuuucguagggugacaaucccgaaaaauccuauaaaauuacaccaaaaagauuccauuacuuuauauaaucuacaggaaaagcacuucacaaaacuacauguuucauuuucuacaugaauacuuuacuucaaauuguacuaucucuauucauuucaucaucuuaccaaaacagacguuugcugaauuggauauuucaguaagucuggauuugggauacccccaaaauaucuguauggcuucccaguuaagaagugaucugauauuagaaaucaaguaguaugaucuaguagcaaauuauuuccuaguggcaauuaauuguacuauuacacaaaaguuauuuuuggccaggggcaguggcucacgccuguaaucccaucaauuugggaagcugaaguggauggaacaccugaggucuggaguucaagaccaaccuggccaaaauggugaaaccucaucucuacuaaaaauauaaaaguuggucagacgugguggcucacaccuguaaucccagcacuuugggaggccgaagugggcagaucaccugaagucaggaguucgagaccagccuggccaacauggugaaauccugucucaacuaaaaauacaaaaaaaaaaaaaaaauuagccagguauaguggcaggagccuguaaucccagcuacucaggaggccggggcaggaaaaucgcuugaaccugggagguggggguugcagcaagccgagaucgcaccauugcacucuagccuggacaauaagagcgaaacuccgucucaaaaaaaaaaaaaaaaaaaguuauuuuuuuccaacaaaaaaacuucccuuaaacgcaguagagugaguaaguacaugucucuacuuucuccuaaaaagccacuaauguaacaguaagcuaauuuuuuaaaacccugagauauaaggcaguauauucaggaaauagcaaaauacuguaagaaaagaaaauucaaaaaauaagaacucaauaguuuuuaaauccaugaaaaggcuuaaauuuagaaaguagaacaaaaagauaaacacaugaacagaaaagacaaaaaaauacucagucuuagagguccaauauccaauucauuguucgagaaacugcugagaaauuggaagagaaucaauuauuaaaaaauaauauaaauggcaggccgggugugguggcucacgccuguaauccuagcacuuugagaggccgaggcaggcagaucaccaggucaggaaaucaggaccauccuggccagcauggcaaaacccagucucuacuaaaaauacaaaaauuagccggguguggugacacacgccuguagucccagcuacucgggaggcugagacagaagaauugcuugaacccgggagauggagguugcagugaacccagaucaugccacugcacuccauccagccugggccacagagcaagacuccgucucaaaaaacaaacaaacaaaaaaaaaaaagaaagggcugggagcaguggcucacgccuguaaucccagcacuuugggaggcagaggcaggcagaucacaaggucaggagaucgagaccauccuagcuaacacagugaaagcccaucucuacuaaaaaauacaaaaaauuagccgggcaugguggugggcgccuguagucccagcuacacaggaggcugaggcaggagaauggcaugaacccgggaggcggagcuugcagugagccgagauggcgccacugcacuccacucugggcaacagagccagacuccaucucaaaaaaaaaaaaaaaagaaaagaaaagaaagaaaaauaacguuaagugggagaccaaagcaggaggaucacuggagcccagaaguucaaguuuguaguaagcuaugaugacaccacuguguucuagccugggcaacagagugagaccccaucucuaaaaaauaauaguuugaaaacaaauauuauuuuaaaguuucucaaaacuaaagacaugagcuuccagauuaaaaaggcccaaugaguaugcagccuuuggaugcauaaugaaugaaaaaggacccaggcaagcaagcucaguggcucaugcauguaaucccagcacuuugggaggccaccaggcagaucacuagaggccaggaacuugaaaccagccuggccaacgugucgaaaccccgucucuacuaaaaauacaaaaaaacuagcugggugugguagugcacaccuguaaucccagcuacuugggaggcugaggcacaagaguugcuugaaccugggaggcagugguugcagugagccgagaucacaccacugcauucuagcugccagggcaagagccgagacugucucaaaaaaaaaaaaaaaaaaaaaaaaaaacaaagcaagccgggugcaauggcucaugccuguaauccaagcacuuugggugggcagaucaccugagaucaggaguucgagaccagccuagccaccauggugaaaccuaaucucuacuaaaaauacaaaaauuacccaggcaugguggcgcaugccuguaguccuagcuacucaggaagcugagacaggagaaucgcuugaaccuagaaggcagagguugcagugaggcaagacugugccacugcucuccagccugggcgacagggugagaccccaccucaagaaaaaaaaacaaaaaaacaaaaaaaaaacaaagaugaacccaggccucggcauguuaucacaauuuuuuuuuuuaaagugauagcgucucacucugucacccaggcugaagugcauuggcuugauuauaacuuacugcagccuugcacuccugggcuccagccuuagccucccaagaagcugaaacuacaggccugccuuaccacacccagccagaaaagaucuuaaaagcaugcagaggggaaaaaaagaucacaaagaauccagaaucagaauggcacaaacuuucaacauugaaggaagcuggaagacaauggaacaaugcauuaaaaauucuaaggaaagauuauuuucaacuuacaauucuaaauccaauuaggucaucaaucaaauauaaagcuaaagacuuuuucugggccaggugcaguggcucacgccuauaauccuagcacuuugggagacugaagccggcagaucacgaggucaggaguuugagaccagccuggccaauaugguaaaaccccaucucuauuaaaaaaacaaaaaguuacaguaagcugagaucgcaccacuacauuccagccugggcgacaggugagacuccgucucaaaaaaaaaaacaaaaaaauuucucugauaugcaaaguauuugccucguauacacuuuuucucagaaagcuguacuucaccaaaaugaaagaauaaaccaagaaagaaagacauggcaugcgcgguggcucacgccuguaaucccagcacugugagaggcugaggcaggcagaucacuugaggucaggaguuaaaaaccagccuggccaacauggagaaaccccuucuccacuaaaaauacaaaaaauuagcuaggcaugguggcacacgccaguaaucccagcuacucgggacgcugagaugggagaaucgcuugaaccugggaggugaagguugcagugagcugagaucgugccucugcacuccauccuggguaauagagugagacccugucucaaaaaaaaaaaguaucuuggcugggcucaguggcucacaucuguaaucccagcacuuugggaggccgaggugggcagccugcuugagcccaggaguuuuagaccagccugggcaauaaauauggcacacccacaucucuacaaaauaaaaagucaaaauuagccuggcaagguggcacaugccuguagucccagcuauuugggaggcuuuauuuuuuacuuuuuuaaaacaagagucuugcucugucacccaggcuggagugcaguggccugaucucagcucacugcaaccuccaccaccuagguucaagcgauucucccaucucagccucccgaguagcucagauuacaggcaccugccaccacgccuggcuaauuuuuauauuuucuuuuuuuuugguggggaaguggggacagagucucgcucugucgcccaggcuggugugcagugguaugaucucggcucacugcaaccucuaccuccucaguucaagcaauuauccugacucagccuccugaguagcugggacuacaggugcccaccaccaugccuggcuaauauuuguuauauuuaggagagacaggcuuucaccauguuggccaggcuggucuccaacuccugaccucaagugauccacccaccguggccucccaaagugccgggagugcaggcaugaaccaccauggccggccuaauuuuuguauuuuuaguagaaauaggguuucaccauuuugggcaggcuggucuggaacuccucaucucaggugaucuguccaccuccuuuuuuuuuucuuuaggagcaacucuauuaauggaccuauuucauuacaucaaacuaaaaucugcuuuauauuuaccuuguauucuucagaaucuuuuuuuuuuuuuuuuuuugagacggaguuucacucuuguugcccaggcuggagugcaacagcacgaucucggcucaccgcaaccuccaccuuccagguucaagagauucuccugccucggccucccuaguagcugggauuacaggccugugccaccacgcccagcuaauuuuguauuuuugguagagacgggguuucuccauguuggucaggcuggucucaaacuccccaccucaggugauccaccugcuucagccucccaaggugcugggauuacaggcgugagccaccgagccugacuucuucagaaucuuacagucuaagaggccaaagggauaaccuaauccagugguuaucaaagugcaguccuggacuaacaucagcgucucuaggaaacuguuaaauaugcaaauugggcugggugugguggcucaagccuauaauccuagcacuuugggagucugagguuggaggacugguugagcucaggagcuuaagaccagcuugggcaacaccucccaaccuccaccccacaaacaucccaacaucuccauuaaaaaaaaaaaaagaaaagaaagaaagaaaaagaaaaaagauaugcaaauuguaugccccaacuucugaaucagaaacuguugguggggcccugcaauggaguuuuaacaaacucuccauguaauucugauauagccuaaaguuugagaaccacagauuuuauccaauccccuaaggucauuugcuuaaaggaacaagguuucuuagaaguacccgugcuaggccaggcgcgguggcucacgccuguaauuccagcacuuugggaggccgaggcgggcggaucaugaggucaggagaucgagaccauccuggcgaacaugguggaacccugucucuacugaaaauauaaaaaauuagccgggcaugguggcgggcgccuguaaucccagcuacucaggaggcugaggcaggagaauggugugaacccgggaggaggagcuugcaguaagccgagaucaugccacugcgcuccauccugggcaacagaacaagacucgucucaaaaaaaaaaaaaaaaaaaaaaaaaaguggccaugcuaggcucucaaccccaaguccaauucauuuaauacuuaccccaugcugucccacuaugaguccugguucuuaacucugggacgagaaagcauaaagcaaacuucuauuucauaacaacaagccuucaauuauaguaucucccuuucccuaggaucauuuucuguuuucugaguuccaucaacauugugucaugugcuauguauguuuuaucuuguccaguuaaaauuugucacuuugaauggagcacggcgcuccugguaggcagcagaagccaaaagaauuacagaccaggcugggcgcaguggcucaccccuguaaucccagcacuuugggaggcugaggcggguggaucacaaggucaggaguuagagaccagccugacaaacauggugaaaccccgucucuacuaaaaacacaaaauuaaccaggugugguggcacgcgccuguaaucccagcuacucaggaggcugaagcaggacaaucuauuaaaacugggaggccgagguugcagugagccgagauagcgucacugcacucuggccugggcgacagagcgagacucugucuccaaaaaaaaaaaaaagaaaaaaauuacacaccaaauuccuuaaauugauuggaauuacacagaacaaauguguuucucauguaucuuaccuacucugucauuugucucguuuugcauuuaaaggaaauauuauucaacacaaccauagaaucaauuuauguuucccuacccugauaucaaaggucagucaauaccaugucccacaaacugaugacuucugauauacuguacauaaacauguaaaggugagaaaggcaccauaaaguaugacuaaacccaaaaauauaugcaguuaguuuagagaaagaaaaaaggaagcagaguaaagauuaagucaauccuuucauugacacaucaacagcaagagcaaaaauaacccaaggaaguuauuuguuaaaccuuaaaaauaauaaaaauguauuauuacauuuauacuuacauuagaugaugaaauaacuuguuuguaccagagagauccucgaaaaacuucgauuuaucagaacuucaaauuucaaaaaagagaaaccagaacaagcuacuaauuaaguucuuaccagggauggugugguaucuucaucacugucuccauccugacuacuuuccacaucaacacugagauucaucgcaucugccguucucuuggguuguagcuuguuacuuucaguaugaacagcugaggaugaauuuugcagcguggauucugccuuggaagauguguuuuucaucuuuggagguauaauccuucugcaaguuuucuuuauuuuagucuucuuacacgccacuucauuguuagaauucuuuucugauagggauuuggggcacauaagcuggucuagcugguaauuacugagugaaaagggggcaagauagaccuuagcuguuuuuauuaaaacuguagucugugcuggucucagagacacauaagcgauguuuugauuuucuuuauauucauuuaccuauucagaucaauaaaagaaaacagaauauuagaacuccaaguccugugccuuuucuuacaggaucccuaacagaucuaauaauucccauuucccaaagacaauauaaauccaaauugaggccaggugcaguggcucacgccuguaaucccagcacuuugggaggcccaaucgggcagaucgcgaggucaggagaucgagaccauccuggcuaacauaaugaaaccaccugucucuacuaaaaauacaaaaauuagcugggcauaguggcacacgccuguagucccagcuacucaggaggcugaggcagaagaaucacuugaacccgggagacggagguugcagugagccgagaucacaccacugcccuccagccugggcaacagagugagacuuaagcucaaaaaaauaaauaaauccaaauugacacccuucguaagaaaacuuauuuuccccuccaaaauccuagauauguaauucacuaaccuuaaccucaguagaauucacuuacugggcacauuugcccauaaguuuuccagaccaauaauaauaaugacuagcauuugugacuggggcaaauaccccaacugucagcugcggauugucuggaauuauuuaaagagugugaagccgaucauaacuguggcagaagaaaacgcagaagguugaagaaagggaaucccagaugugacucucccacuauuucucggguuauugauaagaaccuuucgucaaagcugaaggccuaagggcagggaucccccgccuacccccggugccaggugcccucgaccuccugggccugugucccgcauaacccucacaaaaaccgaggcaggagcacaccuuggaagcaccaguccguuucucaccuucaucuggggucgcugucuggaguccgccuucucagccgccgcgcccgaccuggacaucuuucggcuucuuagcggccggcgccuucccgccaagauugcggcgggaggccgggaggggcggguccgaggcggggcggagcccacucagauccccagcggccgcagcgccagagcag

SEQ ID NO: 191230 - RNA, 127051 nt, Homo sapiens
uuuuuuuccccgccucccaaccgugagguguuggguuugggggacgcuggcagcuggguucucccgguucccuugggcaggugcagggucggguucaaagccuccggaacgcguuuuggccugauuugaggaggggggcggggagggaccugcggcuugcggccccgcccccuucuccggcucgcagccgaccgguaagcccgccuccucccucggccggcccuggggccguguccgccgggcaacuccagccgaggccugggcuucugccugcaggugucugcggcgaggccccuaggguacagcccgauuuggccccaugguggguuucggggccaaccggcgggcuggccgccugcccucucucgugcugguggugcugcugguggugaucgucguccucgccuucaacuacuggagcaucuccucccgccacguccugcuucaggaggagguggccgagcugcagggccagguccagcgcaccgaaguggcccgcgggcggcuggaaaagcgcaauucggaccucuugcuguugguggacacgcacaagaaacagaucgaccagaaggaggccgacuacggccgccucagcagccggcugcaggccagagagggccucgggaagagaugcgaggaugacaagguaaggacgacccuuuucucuucaaaccccaugguuucuuuucuccccggggucuggggcgggauguuaauccgcuagcuguugucuuaugccuuccaguauuucaguccugaaggcuccuuucacccccaacaacccuguuucugucagacuuuucccaguuuaucagugccacguucucuggucccugccagaaaaaaaugacuguaaauucugguucucaagaguggacugugugcagaugcugccuauucucuaagcucagcuggugaguuggcaguaguaaucaucuggccuguguggcccccuuaccuucaaagacacacaaaucuggcgacugccagguuuggugugguuauugucucauuuuuauuccgugcacacugaucaauauuaauuucguuauuuaaagaacgaagccgccucugacuccucuacuuaugguagucaucauauauuuuuuaagcugugugacuuuuaaaaucucuauagggugauguauugaauaacuaaauaaucagcuaugacugccuuuuugugaucaaaauguuaugauagaugggcccucgagcuauaugugagacacacuugugucuuggacauaguugauccaucauuaucuacucaauuugaauuguuaaugaaaucagccaaaagauuagaaucugaaaauaaauuuuaagcaguggaaugucaugucagugucuucauugaaagaaaauagaaugaaauuuuguauagcuaaguugcuauuaggguugguguuuuaugcagauggaaaacuauacaaaguuuuaaauauaaaaaguuuaaaauugaacuguaaucauacuugcuacuaaauaauccuuguuuucauuagcucauugguaacuauauuaauaguuuaugacuuagcaacuucuguagguauaguagaguuaugaaaauuucugggcaggauaguagaugccuuucuauacacuucuuugguaaucuucacauuuuuguguguaaaugcccauuauaauuacaaguuuuacuuugcauaucaaaaucacuuaaggguaagucauuaugaauuaaacugucugugagcuucuaacuuuccuguugacagccucuaccuggcuuucuuauuucaugaagauuaaggcccucagcuaagugcuucccuauaacccccuccucuucaccauaacauagacaugcuaugauagggucaaggaaucaguacauuuauaugugcgcugcaugcuuaacucuaaagacugaaaaacucucgggcagaguagguagaaauccaugaaaguuuggaguauuaaaguaaggucuuccuacuuggcaugguugagcauuacaauucacauucuucucucuggucucaaaggaaagucucuuguuguaauuaauacucuugauuccauucuuucauccauuggacuuuuuguuguugucguuguuguuguuguuguuguuuuuugagacggaguuuuguuuuuguugcccaggcaggagugcaauggcgugaucucagcucacugcaaccuccgcccccccgggguucaagcaauucuccugcuucagccuccugaguagcugggauuacaggcaugcaccaccacgccuggcuaauuuuguauuuuuaguagagaagggguuucucaauguuggucaggcuggucuugaacuaccaaccucaggugauccgcccgccucagccucccaaagugcugggauuacaggugugagccaccaugcccagccucuuuuuuuuuuuuuuuuuuuaaagagacagggucucauuguguugcccaggcuggagugcaguagcuguuacacaggcaugaugcacuauagcauugaaauccugagcucaagugauccuccugcuucagccucugaguagcugggacugcaggugugcaccaccuugcccagcucuacugaacugucucuuucaguuuguuucacuuuuuaccuucaacaguauguggguguccccuguucucaguaaaggaaaaaaaaucuguauauuccuuucucccaaccaacccauuuguuuuuucacuuucauugcuaaagucaaauuauugauggucuacaaauguuccaucuaccuauuuuuucauaaccauccuaaucuuaaaaugucugccaucuuucuuuccuccccuuuuuugaaacuauucucuugaaggucacaaauggcagucuuccuagucaaaaccaaagaauauuuuuauucuuacuguauuugaccucccaguaguuugauccuguugauugucucuagcuauuuggaaacuauuuucuuucuugcuucuguuauacuggacucuccagucuuaucuucuucacuauauucuuugcuggauuuauuuuuucuuuccagucaccuaguaagggacucuguuauugagccuuugcucucccauaagagcaguauuccccaaaguaguguuaaacagaauacccuucuuguaauauuucuuagguggugaggagaaaaaaaugaaaaccuuuuuuggagggaaauguuaguguauccuccucuuggaauucauaaugccugcuggaauauaaaagcucugagaaauccauuaauaaagaaggcuauucaauuuuguuuaacucagucuuguuuaguuuauuugaucacagguuacuauuuucauggccuaccuauuauggcacagaauaauauagcaaagcccacuaguuugggaaauauugcccuggguaucuuaacuacuuuuaaguguuuggcuaauauuuuaugcagcuggcucacaagacuguaucucuuauugaaugucaguucuguguguguauauguguauacauacauauauauauauauauauuuuuuuuuuuuuuuagacagagucucgcucgguuaagcaggcuggaguacaguggugugaucucggcucacugcaagcuccgccuccuggguucacgccauucucugcuucagccuccugaguagcugggacuacaggcgcccaccuccaugcccggcuaauuuuuuguauuuuuaguagagaugggguuucaccauguuagccaagauggucucgaucuccugaccucgugauccaccagccuuggccucccaaagugcugagauuacaggcgugagccaccgcacccggcuaguucuguauauuuuuaaaaguuuuuucuuuuuuuaguuuuguagagauaggguguugcuauguugcccaggcugcuuucaaacuccuggcuccaagugaucuugccuugggcucacaaagugcugggauucuaggugugugccacagcacuuggugugccacuucuguauuuugagcuggcuauaacaacuuucuugggcugcuugugaaugucuguucuugggguuaaugaggacucucugagcugcuuaguagaaaggguagucuuggucucuguauuuuaaacuuaacaguuuuucaggguuuuuuuuauuguuauuguuguuuguuuguuuugagacagggucuugcucugucacccaggcuggagagcaguggugcgaucauaguuuacuacagccucaaacuccugggcucaagcgauccucccaccucggccucccaaguagcugggacuauaggugcaugccaccaugauggucuaauuuuuuauuuuuugguagagaugagggucuuauuaucuuguccaggcuggucuccaguuccuggccugaagugauccuccugccuuggccuucuaaagugcugggugugagccaccauacuuggccacuuaacaguuuuagaucuggaaaauuauuggaaaauuagaucuggaaaacuaaacaagugauccuccugccuuggccuucuaaagugccaggugugagcuaccauaccuggccacuuaacaguuuuagaucuggaaaauuauugcaaagauaguacagggaguuuuuauauaccccacacccagucuucccuauuauuaacaucuuaacauaaguaugaugcauuugucacaauuaaugaaccaguauugauaucuuauuaugaaaguccguacuuuauucagauuucuucaguuuucgccugcuguccuuuuuuaauuccaggaucucauccagaguuacguuacauuuagacauuaugucuucugaagcuucuuuucagccuuuccuuguuuuuuagaccuuuucuuguuuuugauaaucuugacaauuuuaaggauuacugauuagguguuuuauauagaaugucccucaauugggaauugucugagucuuuucucaggauuagacuggaguuguggguuuucggacaaagaccacagaaguaaaguaccaaucucaacacaucauaacauggguauguuuuucaaaaugauuuaucacuacuuauguuaaccucuaucaccuggcgugagauagugcuugucagguuucuccacuauaauguacucuuaaaaaaaaucuguuuccauacuguacacuuuggaagaaaguauguucacccucacuuaaugaguggguaguuauguuuuuccuccuuaaggacagaguaucaacauaaacuauauggaauucuucugcaaaggagauuugucucuucucccucauuuauuaacuuaauaauuuacuuguaucgguauggacucauggauauuuauuuuguacuuuggcuuauaauccaauauuaguuuauuuuuuuguugcucaaauuguucuggcucuggcuguuggagagcuccuucauuaacuccuguauccccuucuuacuuuuauagugccagaaaguacagagaauuuccacauacccuacacccaguuucauugugacauaccccuuucuuacuuuuugguacuuuuagaugcucuaggccuaucuauacguuuccuacuccagcccuagagucaaccauuucuccaaggaaccuugguuccuuuuauuggagaauggcauuagaaaccaaggucugcagcugggcacgguggcucacgccuguagucccaacacuuugggaggcugaggcuaguggauuucuugaggucaggaguucaagaccacccugacuaacauggugaaaccccaucucuacuuaaaaauacaaaaauugggccagacacgguggcucacgccuguaaucccagcacuuugggaggccgaggugggcagaucacaaggucaggaguucgagaccagccuggcuagcauggugaaacuccgucucuacuaaaaauacaaaaaauuagucggguaugguggugcgcaccuguagucccagcuacuugggaggcugaggcaggagaauugcuugaacccggcaggcagagguugcagugagcugagaucacgccauugcacuccagccuggaggacagcgagacuccaucucaaaaaaaaaaaaaaaaacaccaccaccacaaaaaaaaacaaaaauuaaccgggcaugguggggggcgccuguaaucccagcuacuugggaggaguaucguuugaacugggaagcagagguugcagugagccaagauugugccacugcacuccagccugggcaacagaguaagacucugucucacaaaaaaaaaaaaagaaaccaaggucugcuuggcagauaugcucguugcuacuauaagguuaucuuuggaaaucaaggaauccuuucuccagaggaaucagaaaggugauauuugguuucuuucacauuauuaugccauucugucacuuccagucuguuaccuggguuacuaaacacauaaauuccuuuuuuuuuuuuuuucugagauggagccucacucugucacccaggcuggagcgcaguggcgcagucucagcucacuucaaccuccacccgccgggcugaagugauucuccugccucauccuccugaguagcugagacuacaggugcaugccaccaugccuggcuaauuuuugauuuuuuaguagagacaggguuucaccauguuggccaggcuggucuuuaacuccugaccucaagugaucugcccaccuuggccucccaaagugcuggauuacaggcaugacccaccacauccggccuugaacauggaaauucuuuaagggagcuuuaaguugcuccugucuuguccaaagaagugagaaacaacccccacuucucugagauucccucaaacuuucugauuuuuuaaacuucccucuaaaggguuucagccuggagggguguauuaguuugcuagggcugccauaacaaaaugccacagacuagguggcuuaaacagcagaaauuuauuuucucacauuuuugaagguuggaagucuaagaccaaggugccagcaggguuguuuuucucugaacuucucuccuuggcuugcagauggcaaccuucuugcugcuuuauugugacaugauagucccucuguaugcacacauccuuggugucuuuuccucuucuuaaaaggauacgagucauauuggauuagacccacuguaacuuaagcacuuuaaagaccuugucuccaaauacaguuacauucugagauccuggaggcugggacuucaacaugugaauuugggggaaacacaguucaucuuagaacaagggagauccaccacacauacacacacacacacacacacacacacacacagacacccuuuuauuuccucuuuuaucagaaaaguccuuauuucucuuuccucaguacagggcaugucucuuaacuuugauuauuauucucucucucuuugucuuuuaaagagauggggucuuacuacauugcccaggcuagaaugcaguagcuauucauaggugugaucauagcacaccacagccaggaacuccuggucucaagugaagguccuccuguuuaagccuucugaguagcugaaacuacaggugugcaccacugugcuuggcuccuaaacuuggauucuugcaaacuguagcucauacuaaagcuaugugguccagcuguggcacgucaagcucuugauaaauaaaaggagcuguuagaauguagaaaaaguccucaaaauugucguuuuauuacacacauacacacacauacacacacaucaguuuugagguuugaagcugaauaguaaaugaccuuuuuucccuuuaacaaccauaauuuuccuugaggcagccuaugccuuuaguugaauggggaaaaggucauaugucagaaaggaggaugagaagcguauuacaaaaaaaugcuuuuugggggaaaauuuuggaauauaauaguagucucucuuauucuugagagguuugaguaaauugauuaaaauucuuaaaacagugccuacuacauuguuauucuacagcuacuuccuuauuucuuuucugccuuuuuuccaggaugggacucugucuguguuccugcccaagaucuggucccagcccuagccuaccugccucacccuuugcuccugaaugucugacuguuuuuguuauuugcuuguuuucaguuuccugguucauuuccaguuaggcuuaguuggcuccucccauaggugucuuagcugacucccuagagcuugccuguucuucuguaauuugaguaucaaccuucuacaguucuaauaugcugcacaugauaauuccugccuuugccucugccucaccagccauaaucuggccaacuuuuaacuguaauuucuaccucaaauuauucauaaaccaaucaaaacugauaacucuuccaaacgauaucccuuuccuaccuucuugguuccuauaaaugaugcccaugcaacuguuauuuaagacugagguuagaaauuugguguugucuuugauuccuucaguguaucauauugagugcuucaacaugcagaggaguuacuugaucgaauuaaaaaaaacgucauucugacugcagaauagagaacuuggcagaucccuaacuaguccccuuuccuuggucuccauuucuuuuugucaguucuccugugaagccagccugaacuuccucaaaccuuauuuucagaguggcuguaugacucacugacuacaucagguuagaauucugcugucucaucuuuaaggucuuccauagaauggcucuagcuaccuuugucucccacuaucuccugacccaaauuguauuucaggcugauuguuuugcuuacuuuugccuucccaccugccuuucugugucauguuaauuccuguuucugugccuuuguuccugcuguuugacucuuaguuucuugccucuuuucuguauauuuauuauaccaauuuuuuuuuguuuuuuuuuuuuuaauugaggcagagucuugcucugucgcccaggcuggagugcaguggugugaucuuggcucacugcaagcuccgccucccggguucacaccauucuccugccucagccuccugaguagcuaggacuacaggcacccgccaccaggcccagcuaaauuuuuuguauuuugaguagagaagggguuucaccauguuagucaggauggucuccaucuugaucuccugaccucaugauccacccgccuuggccucccaaaguguugggauuacaggugugagccaccgcaccuggccuuuuuuuuuuuuuuuuuugagauggagucuugcucuguugcccaggcugcaguacagugacgcaaucuuggcucauugcaaccuccgccucccggguuuaagcgacucuccugccucagccuccugaguagcugggauuacaggcacgcaccaccaggccuggcuaaauuuuuuuguauuuuuaauagagaugggguuucaccauguuggccaagcuggucucgaacuccugaccuugugaaccguccaccuugaccucccaaagugcugggauuacaggcaugagccaccacaccuggccuauucuaccaaucuuuuauccagcuucugauccauguccacuaugaagcccccugggacuucugaccuggaauaugcuuuuccuucuuuucuuuuucuuuuuuuuuuuuuuugagauggaguuuugcucuugucgcccagguuggagugcaauggcgcgaucucagcuuacugcaaccuccgccucccagguucaagugauucucuagccucagccucccaaguagcugggauuauaggcacccaccaccauggccggcuaauuuuuuuuuuuuuuuuuguauuuuuaguaaagaugggguuuuaccacauuggccaggcuggucucgaacuccuaaccucaggugauccacccaccugggccucccaaagugcugggauuacaggugugagccacugcucccagccaugcuuuuccuucuuuauacaccauuuacauuuauuguuugagcuucauuaacuuauuuuguucauuuuuuacuaauagcuuauuguuugugaacuucguuuucucaacgaaauuuuaaguuccuugaggaaggacuauguuuuaaauuuuuuccugcgggaaaaauuguucuuagugcuguuacaaaauguacgagguugauuuguauccccuaaaaggauauauugaagucuaaaucaccugugaauguuaucuuaguuugggaauagggucuuugcagauguaaucaaguuaaaaugaggucauacuggauuaggguggccccuauuccauuauaacugguauccuuauaagaaaaaaaaauagaauuagggagaacaccaggugcaugaauacacagagacacacagacacauugcagagaccgcauggcagauaaaggcagagauuggaguuauguuuccacaaaccaaggaaugcccagggcuaccagaagccagaagccaggagccucccccuagaggcuccagugggaacagggcuuugccaacaccuugauuuuggacuucuagccucugaaaccauccucuagcacugugagacaauacauuucugcuuuaugcuauucaguuuguggcacuuuguuauaucagccuaggaaacaaauacacaaaugcauacuuaaaaguuaauuugauuuuuugacuagauaauuguuuuuguuuuuuuuuuuugagacagagucucgcucugucgcccaggcuggagugcaguggcgcgaucucagcucacugcaaccuccaccucccgaguucaagugguucuccugcuucuuccuuccgaguagcugggauuacaggcacgcaccaccacacccagcuaaauuuugcauuuuugauagagacaguguuucaccauauuggccaggcuggucuugaacuccugaccucaggugauccgcccgccucggccucccaaauugacuagauaacuacucuuauauaauauauacuguguggcaguaugguucacuggaaagaacaaggguuuuuggagucaaacagacuugaguuuauaauucuaccauuauguuaccucuccuuaagccuguuucuucacucauaaaaugaagaggauucaugaaguaaaauauuuagaggccugucccauacaaagcuugacauuuaauaauauugguuccuuucuuucaugggugcauugguauagcuaaucuugaagaaauuuggggcuagguguaguggcucaugccuauaaucccagcacuuuggguggcugaggcaggaggaucaugugaggccaggagguugaggcuagccugggcaacauagcaaaaaaaaaaaaaaaaaaaaaaaaaaagcugggcauggugacacaugcccauagucuuaauugcuugggagguuuaagcuggaggaucacuugagcccaggaguuugaagcugcagggagcuaugauugugccacugugcccuagccugacaacagagcaagacccugucucaaaaaaagaaagaaaaggaaaaaagaaaagaagagaggagaggaggggaggggaggaggaaagagaaggaaggaaggaagggagggaaggaaggagggaaggagagaaagaggaagaaagagggagagggagagggaagaaagaaaagaaaggaagaagggagggaggaaggaaggaagaaguuuagucuuguauuauucuauugaaacccaaguauauuaauucaguugacaaaaauuuauuaaauauauugggcacuuacugugcuauacacuaaaaugaucuuugaaacaaguuuucacuuuucuuugucucccuuucuuauuuuuguauuucucuguuuuuucuuacucuccugauaaaggacugaguaaucucaggagguuccaugaagaucauaaaacaagcugcuuuuugaaaaaugaugacuaggauuuaguugugcagaaaaaagguaaaaggacauucaaggagcucccuuuuacuuacuccauagaggcaaacaaacaguucuuauaguguggcauguaacaucugucuccugaagugacagggaguaccuuuugacuuaugaccucauuaaacaggaggaacuaguccuuacaauuuuugguugaagaccuuaaaguuccccauguuagccucuuccucaaaagagaguuaaaguuuccuugaauucaaaguccaggcuuuuuucuagggacagacugggcaugcaguaauuucaguuucucacagugcuucaaggcucucuuucuuguucuuaauuaacuuuaucuaauuuucuuacacuguuucuggccagguaguuccucuuuugaacaauguugccacagagcuuuugcucagaugcuuuuaaugucugauucuuucucuuuuccaaacuacacuuuuucccugaggaugacuucaaaacuuacauccacgaagcuuuuucuauuuaauauaaaaugauuugcuuuccuuuuacaauuucaauuuucuauauccaauuuaaguucaacuuaggggaacauuuuuucucauuugaugauuaacaaaggccucucauagcucacugcagccucagacuccuggccucaagugauccucccgccucagcaucucaaagugcugggauuacaggcaugagccaccaugccuggcuacauuuucacucuuaaacuugacucucuauagcauuuuauacugaugaucucuccuuucucuccuuuuugaaacuucuucccuuuagcuuuaauaauacccauuuaucuugguuauccuaucauuuucccacucaauguuuacauaugcugugcuuccaucuuuaaccccauuuuaauuucuuuauugaacaaauauguucaaguuucuauuuuggaucaguuacuaugcugcaugcauaucacauagugaaugagugaacaagacagauaugguauacauugacuauggaacuuacccuugagcaggggcuaugaggggaagaccuaaccuauuuuagaggcuuagggaugacauucuugagaguuuuaguugaguccuaaaaaaaagaucaggauuuaaugaggcaaagauugagugagagguuugagauaagaggcucaggagagaugaaaagaggguuccagauguagaauguugcauauuuuauuuuauugcauauuuuaaagcacaggauaucagccggguauggugccacaugccuauaaucccauuuacucgggagguugaggcaggagaauuacuugaauccaggaggcagagguugcagugagccaagaucaugccaagugcacuccauccugggcuacagagggagacccucucucaaaaaaaaaaaaaaacuuaggagccaaggucauggcaccacuguacuccaggcugggcaacagagugagauccuaucucaaaaaaaaaaguucaccauguggaaugagggagcuagaaugagugugauaauauuugauguugcacuacaagacuggauucagauugugaaaagauuugugagucauguuaagggcaauaggaagccauugauugacucucuuuuuuacauuuaauuuuuuuuuuuuuuuugagauggagucuuacucuguugcccaggcuggagugcagugucacgaucuuggcucacugcaaccucugucucauggguucaagcgauucuccugccucagccucccaaguagcugggacuacaugcacaugccaccacacccagcuaauuuuuguauuuuuaguaaagacaggguuuugccauguugacgaggcuggucucaaacuccuggccucaagugaucuguucaccucggccucccaaagugcugggauuauaggcaugagccaccacgccuagugguucuaguuuuuuucuugucuuccaaugauauauugugaauuuucuuucuuuccuauuuuuuuugagauggggucucacucuguugcccaggcuauagugcagugucaccaucucagcucacugcaaccuccaccuccuagauucaaucgagcuuccugccucagccucccagguagcugggacuacaggugcacaguaccacacccagcuaauuuuuauuuuuuuuguagagaugggguuucauuguguugcccaggcuggucuugaacuccaggacuuaagugaucugccggccuuggccucccaaaguguugggauuacaagcaugagccaccauauccagccugugaauuucuugacuauaaaaauauagucuaggcugggcgcaguggcuuacaccuguaaucccagcgcuuuaggaagcugaggugggcguaucacgagguccagaggucaacaccauccuggccaacauggugaaaccccgucucuacuaaaaauacaaaaauuagccgggcguaguggcggacgccuguagucccagcuacuugggaggcugaggcaggagaaucaauugaaccugggaggcagagguugcagugaguggagaucgcgccacugcacucuagccugggcgacagagcaauacuccaucucaauaaauaaauaaauaaauaaauaaauaaauaaauaaauagucuaaaucuaguauaaaucuaacacuuaauauuucauacuauucccuaugucuggacucaguaaauauuugaugauugauuuagcaauuuguauugcuucuugaaccaacgggugcauaaauauguacuagggcuaccacagauauuauccacauaucugauugcacuaccuuuucuggaagacauaacuaaaauauucagauguaaaacuacugcuugucaacucaucuuucuaguauacauagaauauaucuuuuauuugaaacguguuauaguagaucuagaauaauauuuuauucauuuagaaacucaaaaauauuuuucugauucaauuuaguguuuaagugaagagaacaaaaccuugggauuagcuucauggggauauaaugaaaaaaaguuugaguuauaagcauagcuuggauuuuuguuuguuuuuuuuggugacagggucucauucugucacccaggcuaaacugcaguggcaugaucauggcucacugcagccuugaccuucuggacucaagcaauccuccugccucagcaucuggagcagcuaggacuacaaacuugugccaucacaccuggcuaauuuuuuuuuuuuuuuuuuuuuugagacagagucucgcccugucaccaggcuggagugcaguggugugaucucagcucaacgcaacuuccaccucccagguucaagcaauucucgugccuuagccuccugaguagcugggauuacagacaugcaccaccaggccuggcugauuuuuguauuucaguagagacaggguuuuguuggccaaguaggucucaaacuccugaccuuaagugauccgccugacucggccuuccaaagugcuaggauuacaggugugaaccacggugccuggccacaccuggcuaauuuuaaaauuuuguagagauguggucuugcuauguuccccagggcuggucuugaacuccuggccucaaguaauccucccaccucaaccucccaaaguccugggauuacaggcauaaaccaccaugccuggccuauucaaguuuuaucaugagauugcaguaauucagucacgucuucaggcuccacuucuuuuuuuuuuuuuuuuuuuuuuuuuuuuugagacagaguuucacucuugugucaaggcuggagugcaauggcaugaucucggcucacugcagccuccgccucacagguucaagcaauucucuugucucagccuccugaguagcugggauuacaggcgcccaccaccacaccuggcuaauuuuuguacuuuuaguagagacaggguuucaccagguuggccaggcuggucucaaacuccugaccucaagugaucugcccuccucagccucccaaagugcugggacuacaggcauaagccaucgcucccagcccuccaggcucuacuucuauuucuaguucucucucuuucucucuuacucagucacuuaggcugaaugcaguggugcaaucacagcucacuguagccucaaccuccuggggucaagcaauucucccaccucagccuccugaguagcugggccacaggccugagccaucacuccuggcuaauuuuuaaaaaaugguuuguagaccagggucuugcuauguugcccaggcugguuucaaacucccauacucaagugauccuccugcccuggcuucccaaaguacugggauuacaggcauaagccaccgugccuagccuaauucuaggucucuugcuauuuguaccacaucugcaguuacuuccuccacugaagucuugaauccccucaaaaucauucaugagaguuggaaucaacuuauuccaaacucauguuccuguuaauauuuuagccuucuucuaugaaucacaaauguucuuuuuuuugaggcacagucucuguugcccaggcuggaguacaguggcacaauucauggcucacugcagccuugaccucccuggacucaggugauccuccuaucucagccuuccgaguagcugggacuacaggcacaugccaccauaccuggcuaauuuuguauuuuuuguagagguggaguuuugccauguuauccaggcuggucucaaaauccuaggcccaagcaauuugccugccuuggccucccaaagugauggaauuaauggccacugugcccagccacaaauuauuauaauuuuuuuuuugagacagagucuugaucugucacuuaggcuggagugcaguggugcgaucucggcucacuacaaccucuacccccugagcucaagugauccucccacuucagccuccgaguagcugggaccacagguaugggccucuacaccuggcuaauuuuucuauuuuuaguagagacagggucuccccauguugcccaggcccgucuugaacuccugagcccaaguguccacccgccucugucucucaaagugcugagauuauagacgugagccacugcacccagccucuacaaauguucuuaauggcaucuagauuggugaauucuuucuagaagacuuucaauuuauuuugcccagauccaucagaggaauuacaucaugguagguauagccuuaugaaagguauuuguuaaauaauaagauuugaaaguagaaauuacuccuugcuccauggguugcuguuagcagacaugaaaagauuaauguccuuguaaaucuucaucagagaucuugggugaccagggacauugucagugagcacuaguauuuugaaaggaaucuuuuuuuuaaguaguauaucucaacagugaacugaaaauauucaguaaaccaugcuguaaacagaugugcuaucauacaggcuuuguuguuccauuuauagagcgcagauaaaacagauuuagcacaauucuuaaaagcuaggauuuuaggaaugguaagugagcguuggcuuccacuuaaagucaccagcugucccuaacaggagaaucagccuguccuuugaagcuuugaaaccagauauugacuucucugcagcuaugaaaguucuagauggcaucuucuuccaauagaaggcuguuucauuuacauggaaaauguguuguuuaguguagccaccuucagugaucuuagcuagauuuucuggauaacuugcugcagcuuuuucaucagcacuugccacuuccccuugcaccuuuauguuauggagauugcuuuuuuuuuuuaaacuucaugaaccaaccucugcuggcuuccgacuuuucuuguacagcuucuuuacccuucacccuucauagaauugaagagaguuaaguccuugcucuggauuaggcuuugguuuaagggaauauugugguuaguuugaccuaucuggaccauggaaacuuucuccauaucagcaacaguaaggcuguuuugccuucucguuauucauguguucacuaaaguaacacuuugaauuuccuuaaagaauuuuuccuuugcauucacaauuuggcuguuuggcacaagaggccuagcuuuuggccugucuauguucuugacgugcccuuuucacuaagcuuaauuauguuuagcuuuugauuuaaagugagagacauacaacucuuuuacuugaacacuuagaggucauuguaguaucguuuugucucaggaaauagggaagccugaggagaggaagagagaugggggaaugguuauuccaugguaacucccguuaucgucuccccaacccuuggcaaccucuauucuacuuucuguuucuauaaaguuguuuauucuauuuacacacacaacauuuauugauuaaacucacuguccucuaugagugcaguuuguggugcccccaauuauaauaauauugaaggucacagaucacagaucaccaugacagauguaauaaagaaaauuuugaaauauuuugagaauuaucaaaaugugacauagggacaugaagugagcacauguuauuggaaaaauugugccaauacauuugcucgaugcaggguuauaagaaacgcauaaagcaagguacaauaagacaagguaugccuguauccaaguuauacugcuuaucaucagggacuugucucauaagcuggaaacuaacaugauacuaauucuuuuuuuuuuuuuuuuuugagacagagucuggcucuguggcccaggcugaagugcagugguacgaucuccgcucacuguaagcucugccucccagguucacgccauucuccugccucagccucccgaauagcugggacuacaggagccuaccaccacgccuggcuaauuuucuguauuuuuaguagagaugggguuucacaguguuagccaggauggucucuaucuccugaccucgugauccgcccaccuuggccucccaaaguacugggauuacaggcgugagccaccguguucagcccacaugauacuaauucucaaugggcagaaugaaauaaaaccauuuauugauauagugcuuuaugauuguucaaaguuuauuauaugcauaagucauuuauuugggaaaguugaauaccaugugguaugugauagggauagaaagauaguaagauucccguucuuugaagaagugagggaggcacacauagaaaaauaauccauaaugcaugauuaaaugcuauaguaaagcugcuuacaaagggguuugagaauacagaggaauaacugauuaacuuccucaggaagucaagagcgaaauaauucacugaaaaggugaucuuuaguaauuuaacaaaaugagaaagggauaaggacaggaggaacauaaaugaggccaggaaagcuggaaaguauguuguaccuucacagaaggucaagcaguagaauaggagaguguaauauaagguacaugguauugagaaguaggggaaauuaugucugaguuaaagcuauuuggggccagaauaaugaugauuauuguuauuacuauuuuauugugguaaaacaucuauaacaaaauuuacuauuuuuaccauuuuaaguguauaauuuaguggcauuaaguacauucacaauguuguguaaccaugauuacuaccaucuauuucuagaacuuuuucacgaucccaaaccaaacaaaaccucuacccauuaagcaguaauucccauugcccuucccuccagccugugguaaccucuauucuaguuucugugucuaugaauuugucuauucuagauaccucauauaggaggauuauacaauauuuguccuuuuuuaucuggcuuauuucaccuagcauaauguuuucaagauucauuuauguuguagcauguaucagaacuucauuccucuuuauggcugauaauauuuuauuauguguauauaccauguuuugcuuuucauucaucuguugaugaacacuugaguucuuccccucuuucaguuauugugaguaaugccucuauaaacggugguguacaaguaucuguuugagucccugguuucacuucuuuuaugucuagcaguggaaaugcugggccauauucuauauuuaacuuuuuuuuuuagagacaaggucucuuucugucaccuaggcuggguacaguggcaugacuguggcucacugcagcuuugacccaccucaagcgauucucccaccucagacuccugaauagccgggacugcaggugugugcaccaaaagcacaggcaacaaaacuaaaaauugacaaaugggauuacaucaaauugaaaagcuccuguacagcaaaagaaaacuaucaacagagucaaaagguaccuacagaguaggagaagauauuuggaaaucauauaucugauaaggguuaauauccaaaauauauaaggaacuuauacaauguaauaacaaugaacaaccuguuuuaaaaaugggcaaaggacuggaauagacauuucuugaaagaagacauacaaguggccaacagguacagucauauggaaaaauguucaacauuauuaaucaucagggaaaugcaaaucaaaacuacagugagauacuaucucacaccugcuagaaugauuauugucagaaaggugaaagauaacaaauguuggugaggauguggagaaaggggaacccuugaacauuguuggugggaauguaaauagccauauggaaaacaguauguaguuuccucagaaguuaaaaauagaacuauauuaugaucuggcaaucccacuucugagcauauauuuaaaggaaggcuaccagggacuaggggaaggggcaaaugggauguuggucaagggguacauaguuucaguuaugcaagaugaguaaguucuggagaucaauguauauaagcauaucaaaucaucaaauuguguaccuuaaauauauacaaucuuuaauugucaaauaucccuuaauaaaaaaguaauugagaaaaaaguaaauaaaauaaaaaaauucuaugagauucccaauuuauuguuuuagcuaaaaaggcuaaaagcuaaagacuuuuuuuucuuuuguguuguuuuuaagccagucaaauuuagcagugggacuuuguagaaauaguaaagaagacauucuacuccuuuacauaguaauagcuaauguuuauuaagcccuuaccaugugccagccaguguuguuaacacuuuaucucuggcauaaacuuuuugacaaugcuaugagucagauaauauuuucucauuuuauagauaaaagaacugaaacagagaagguaaacaguauguccaaggaaauagagcuaacaaguagugaauucagaauucagacucaggcaaucuaauuuuagaggccccacccccucaccagcuuuugguuuuuuuuuugauacggaguuucacucuguugcccaggcuggagugcaguggcaugaucuuggcucacugcaaccuccgccuccuggguucaagugauucucaugccucagccuccugaguagcuggaacuacaggcaaaugccaccaugccuggcuaauuuuuguauuuuuuguagagacuggguuuugcaauguuggccaagcuggucugaaacuccugaccucaagcgaucugcuugccguggccucccaaaguacugggauuacgggcgugagcugcugcacccagccagagccccuucuuuuaagcacuaugcuauuggguuucugcauagucacagucuuaauuuacuuugugcagcauuaauuacaugaugcaaguuuaagaauuauccagagaagagcaauuaaaaucaccaagggaugaaaggguacucacaagagaaccaacuaaaaagacuuggaaaggcugggaggccaaggcgggaaucucucugagauuaggaguucgagaccagcuugggcaacauagugagagucucucuuucucucucucucucucuauauauauauauauguauauauauauauauauauacacacacacacccacacacacacacacacacacacauacauauucagauagccagguguggugaugcacaccuauaaucccagcuaccugagagauugagguaggaucccaggaguugggaucaaacuccuuugaucccaggaauuugaggcugcagugagcuaugauugugccacuguacuccagccuggaugacaguacaagacccugucucaaucaaucaaucagucaauuaaaaaauacauaggccaggcacaguggcucacgccuguaaucccagcccuuugggaggccaaggcgggcggaucacgaggucaggaauuugagaccagccugaccaacguggugaaaccccauaucuacuaaaaauacaaaaauuagcugggcaugguggcacacaccuguaaucccacuuauucgggaggcugaggcaggagaaucgcuugaacccgggaggcggagguugcagugagccgagauugugccacuucacuccagccugggcgacagagugagacuucauuucaaacaacaacaacaacaaaacgaacaagcaaaaaacaaacauacauacauaccuggaaaaguucuuaaaagaacauaugacuaaagaauauggauauaaacuuuccauaccaaauccugcaagguaguuuuauacuuauacauguucuacuuauaaaugacccauucuuauagauuaugccacugccuugaugcuacaugugguauuucuuaccuuaacugaaaaagagaaaacuauuuuagagcuuaguggggaaaguuucuuaacagguuuuacuucccuaaaugguuccccucccuaagaggaaaaacauuuuuccccaaaaauguuggggaaaugccuccaauuaaagaggcauuccaggcaccauaacuuuaaugugaauuaauggcauagugccuguauuuuucaaaugaaauucaggacaugaugucugaaaaagauugcuuuucuuuuuuuuuuuauuauugugguaaguguguaugugguaaaaaacacauaccuucaaaggaguggggagagacaguccuucgaagggccugggaugagaacuagaaauauuugccaauguuaaugaacuaucaaaagucuugauuauuaauucauucuaacauaaaccuaauauaggauugcuuuugugugugugugugugugauggagucucucccugucacccaggcuggagugcaauggcacgaucuuggcucacugcaaccucugccucccggguucaagcgauucuccugccucagccucccaaguagcugggauuacaggugcccaccaccaugccuggcuaauuuuuguauuuuuaguauagaugggguuucaccauguuggccagagagaucucgaacuccugaccucaggugauccaccugccucggucucccaaagugcugggauuacagguuugagccaccaugccaagucguuaacauaggauuucaaauccuugaaauuuaaaguuugugaacuucaaacuugcauguucuugggagaauguaacaagaaagagauuaaaaccgcugaauaaaccauaauuguucuccaacuuuaucuggaccucuaaucuauuaccucuuccuuucuagcagcccuauguauucuuuacuuuccucccuauccagcugagauuuuguuucaauuuaguuucuugccauuacccucucuuuuacaugccaauuucaagcacagcugcagaaaaucauauaaccagauuugcaggaauuuaugaucagcaaacucaacuggguuuucaguaacacguuacauauuauauuucuccaggcaacacacccuuuccaacagcuuucagaucuuugcccuccuuaggcccauuuaaacuuuuuuucuccuuucucaagcuuaguaggugaucuugucuccugcuugaccaagaauuggacugauaaaacuuuaacuaccaaaucuguaggaauaccuacaucuguacccaucugucuuuccucuuuguuaaaauaaaagaagguucauccauucuccagggccagccucucuaccuguucucuggauccaaugucuuccaucuuuucaaagacuuuguagaauuaguaauccaguccuccucuuauauucacccucucagucuaugcuugcuccucagcauuuaaaaaauaguugucuggccuggcgcgguggcucaugccuauaaucccagcacuuugggaggccaaagcaggcagaucacuugaggucaggaguucgagaccagccuggccaaccuggugaaaccccgucucuacuaaaaaauacaacaauggcugggugcgguggcucacgccuguaaucccagcacuuugggaggccgaggcaggcggaucacgaggucagcagauagagaccaucuuggccaacauggugaaaccccaucucuacuaaaauacaaaaaauuagcugggcgugguggcgugcuccuguaaucccagcuacuugggaggccgagacaggagaaucauuugaacucaggaggcggagguuguagugagcugagaucaugccauugcacuccagccugggcgacggagcaagacuccaucucaaaaaaaaaaaaauacaaaaauuagccuggugugguggugggcaccuguaaucccagcuacuugggaggcugaggcaggagaauugcuugaacccaguagguggaggcugcagugagccaaaauugugccacucacugcacuccagccugggcuacagagugaaacuccauaucaaaaauaaaaaauauuugucuuacuuccccuuuccaggaaaauuucuugaaaagacauuuuaucucugcauuuucugcuuucaucugcauuuucuccuccuacuccugauaaucucagcaucuuuuccccagcauucuauguucuuggcuucuuaucucucaguuuacuucuuagucuccuuugcugacuucaccuguauucauuauuaaauguuauaguucauaguuuugugucuguaaucuucucauucuacucucuuacuacgucaucauacucacuuauaaaacuuguuacacuuuaugugcuaaugacuccaaaucuguauccuuuauccagacuucucucuuguuucuuauauauugcuguaucuuuaggcuuuacacagugucuuucacuuagcagguguucaauaaauguuucuuugugacuggcugacugacuaaauaaguaaacuuuauaguaauucuuugugauucuucuuaacagaccaagaucaaauccuuuguaucccuaggucuagcacauaguggguacucacuaagugcuuuauaaaugacugauugaauaaauaaugaauaagcaccacaauaaaauaaaauuucuuaauaagaugaaugagugaaugaaaaaaaacuuugugcuguucauuauagccagucaagaccaaagaccuuguuuauucucuuugaaaauguaacugggggccaggcgcaguggcucaugccuguaaucccaacacuuugggaggucgaggugggcagaucacaaggucaggagauugagaccaucuuggcuaacacagugaaaccccgucucuacuaaaaauacaaaaaauuagccggguguuguggcgggcgccuguagucccagcuacuugggaggcugaggcaggagaauggcaugaacccaggaggcggagcuugcagugagcugagaucgcgccacugcacugcagccugggcaacagagcaaaacuccgucucaaaaaaaaaaaaagaaaagaaaagaaaauguaacuggguaggccgggugcgguggcucacaccuguaaucccagcauuuugggaggccaaggcagguggaucaccugaggucaggaguucgagaccauccuggccaacauggugaaaccccaucucuacuaaaaauacagaaauuagcugggcauggugguguaugccuguaaucccaccaacucaguaggcugaggugggagaauugcuugaaccugggaggcggagguugcagugagccaagaucgcaccacugcauuccacucugggcaauaagagugaaacuccaucucaaaaaaaaaaaaaaaauguaacugauaacuggauauaaauuauacuaaaacuugguuuaagaagacaguaauucauuaacagauaaguaaaaguugcagaugugauuggaauguugacugcauacucugugugaacuaugaguagugagaauaaaaaauguuaaucaccuaccaggucuaguauauacacaguagucacagacacagacucuggacggggucuauuugagaaaguauucaaaaccuccuguagguauaugacugaggacacaguuuccucauuugugaaauggggaaaaauaacuaugcccacuuucauagggagguugugagaauuaaaugagauaaugcuuguaaagcacuuagccuaggaccuggcacaaaaauaaucauuuaauacccgcuuguuauuauuaaugcuauuccauuuugauccagcugguauagguguuaaccaugcuauagaugaauaauugccaaaccuggcugcuuaucagaaucacguaagauuuuuaaaauuaaaauuccugggccuuucccagacuacugaaucagacuggaaguagaauaugucuuuuuuaaagcuccccaggugauucugagcaucagccagguuuggcaguuauguuacagaagauagacuugucucuagaaaucaucugaguaugaaauauaaucaagaaaaauauuucugguguggagaaaaaggagucaagaaugacaucuguaguaagccaauuguauauaaccuuuggaauaaauggucauaguugugcugauugcccaagaacagaccguaaugaaaggaaagcaggcacagcugagccauuuucaagguucccccaaauggaaagagaagcagagcaacugagcuguuaagagcugccaaaauuaauuuagagaagccacguaggauggggaaacaugaaaagaacuucagaagagagcugguagaaaaauaaaaaugaaguuuuugauauugcaggaagaaagauuaagggaaaauaaaugaaguagcuggggaugaacaagaaguacuauagggaaguaucaggaaaaaagaauucuugcugaggaaaacaaauaaagagcauaaacaaagaacauaaaacucaggagagaggucucaggaaggacaguaaacacauuuuaagagauucacagggaaaaggccaaacagagcaaggauaauuggccuauuauagauggacucaaaaucccaaagaaacaaguauuacaaaaagagagggauaagguaaagccuaaaggcaaugacggcgauaacaaggggaaauaaaugaaggcgcucaaaagaaaccuugaagaauaauuaaaauugugcaaauauggauaaaguauaacuuaagguaggagaguguguaguacaaagaguaugggacauaaaagucuaggggaucauugagcaaacauuuauucaguguuuauggguaucaggaaguuuaugugcuguuaccuguguggaauauauuuagaaaaaaagugaaaauauucuggaagcaugaucaguucaacagagaauauguguggcaaaaugaagauaaucucuuuuucuagucauguaauaguaagaacuccaauuaauuucucaacagcagggacguuuuggcagucauuuagaagauaagcauauuccuaaugaccacaaggaaauuaaaacugugaggagagagcugggugugguggccugagccuguugucacagcuacugaguucgaguucagccugggcaacacagugagacuccaucucuaaaaaaaaugaaaaaacagugaacuaugagaaggaauaguuagaagggaaguuaagcuuucuuuugaaggugaggggauggugguggagauauuaaaugaaggcucucagaggaaggguuaaagccaaaggaguuaaagagcuggcccggcgcgguggcucacgccuguaaucccagcacuuugggaggccgaggcagccaaaucacgaggucaggaguuccagaccagccuggccaacagggugaaaccccgucucuacuaaaaauacaaaaacuuagcugggcgugguggcaggcgccuguaaucccagcugcccaggaggcugaggcaggagaauggcaugaacccgggagguggagguugcagugagccgagauugugccacugcacuccaggcugggcaacagagugagacucugucucaaaaaaaaaaaaaacaaaaaagagcuaaaagaccagacugggcaacauggcaaaacccugucuguaccaaaaauacaaaaauuuagccaggaguggucaucugugccuguggucccagcuacucgggaggcuaaggugggaggaucacaugggcuugggaggcagagguuacaaugaacugagauugugcuacuacacuccacccugggugacagagggacccaggcugaauauauauauucaacuauagauugaauuuccccaccuccauuagaauuuuuuuccaauguauaagaauaugaaagagacaguucagggaagcugaagccacucacagccuaauauuuaagaagagcauaccucuaccaauuucagaagcagauuuaaaauggaguacagagaaccuggcauagcaucauaaaaauugauuuaaaaaagugagacccccccaucucuacaaaagacaaaaaaaauuaucugggcgugguagcacaugccuguggucccagcuacuugggaggcugaggugggaggaucuuuugggccugagaaaucaagguugcagugagcuguggucaugccacugcacucuagccugggcaguagggcaagacccugucucaaaaaaaguguuuuuuuaaauaaaaaaccaaaguguugaaaaugaauacaaaggaagaugauguucuuggaagggcaacaaguacaaaaagagauuagguucugcaaaugaaggaauugggaaacaaaguaaaauacaggcuaauuggaaguuauuacggagcaguucugagugagcaaacugaucaaauacuguaguuguuggugucagguuuuuuuugcuuccccuguagcuuucccucagugaucucauuccuaugaccuggauuaccauuugaaugugaauggcucucuggucgucgcccgagcuccauauguccaacugccuacugaagaucucuucuuggauaugucacagaugccucaaaaucaauaggucaaaaucucaaaaaaucauuuccccaauucucucccugaccccaagucuguuccucuuccuguguuucccuauuacagaaaauuauauucuuacucaucuagucaccccgauuagaaaucuaagcaucauacuugauguuucuccuuuuacgccuguauauaaucaauuccacaagacuauucuuccccuuuaauaucucacauguauuuaccucucuuuucugauucuauuaguuuagaccagaaauugaaaagaccuuuucuguaaaaguccagauaguaaauacuuuaggcuuugcaggccauauagucucugccacaaccacuguagcucaaaagcagccacauacaauauguaaacaaauuaguguggcuauuuucccauaaaacuuuauuuguagacacugaaguuucauuuucauguaauucauauaucauaaaaucuucuuuugauuuuuuccuucagcuauuuaaaaaaaaauguaacagucauccuuagcuuccuucccuacaaaaacaggcucacaggccauaguuugcccaccucugacuuagaccaacauucucaccuaugauauggcaguaguacuuggucucccuccuucucaucuugcccacucuggucuacucuucauguugcagccagauugacuuuuuaaaauugcaaauugggacugggugugcguggcuuacgcccauaaucccagcacuuugggaggccgagguggguggaucgccugaagucaggaguuugagaccagccugaucaauguggugaaacccugucucuacuaaaaauacaaaaauuagcuguguguggugguaugugccuguaguccaagcuacuugggaggcuaaggcaggagaacgacuugaaccugggacguggagguugcagcgagcagagauugggucgcugcacuccagccugggcaacagaccgacacucugucucaaaaaaaaaaaaaaaaaauuggaaguugaauuuuacuaccuuguuaaaagaacuuuaaagauugaccauagcuuacaggaugaauccauguuucuuggaagacccuucauaauugugaaccuuacuuaccuuucuagccauauuucuuaccaguucucccuaauucucuguugcagcuacugggaauuguuuauaauuccuagaauguuaaguguuuuucauaucuaaguuuugacacgugccuugaaugccuuucuuccuuaucuucucccuacuuauaccugguuccugcaggacucauaucagucaucaucaucaucuccagaagccuucucucacuccaugaaggcuguauuaaauccuucuauuaaguucgcccaucaugucuguagaaccgaaugauagcauuuauuuuacgguauuaugauugccuauuuacuugacuccccuccuaaauaguaagcuccuugaguacauaguguuugucuguuguguuauccucaguuuccauuuuucuuuuuuugagauggggucuugcuccguugcccagacugaagugcaguggcuugauuauggcucauugcacuccugacuucugggcucaagugaucuucccaccucagccucccaaguagcugggacuauaggcauaugccaccaugcucgacuaaucuguuuauuuauuuauuuuuuauuagagaugagaucucacuguguuuccaggcuggucuugaauuccugaguuugaaugauccuccugccucagccuccaaaaugcugggauuauaggcaugagccaccacgccuggccuuccaguuuccuguaugauaccccauaguaaugugugagugggguuuuuguuuguuugguugguuuuguuuucauuuuuguuuuugagacagggucucgcucugccaccuaggguaggagugccguggugcagucacagcucacugcaaccucaaccuuuagggcucaaucaguccucccaccucagccucucaaguauccgggccuauaggcaugcaccacugugccuggcuaaguuuuuguauuuuuuguagagaggggauuuugccauguugcccagaguagucucaaacuccuggccucaggugaucugccugccucagccucccaaaguguugggauuacaggcgugagccacugcaccuggccauuuuuguuuguuuuacauuuuaaaaauugacguauaauucauguaccauaaaauuuauccuguucaaguguacaauuuagugcauuuuacuauaucuaaaauguugagcaacuaucaccauggucuaauuccagaacguuuucaucacccccaaaagaaaccuugugcucaacaaaaagucacuccucauuccuuccugcccccagccccuggcagccacuaaucuacuuucuuucuuuauggcuuuaccuauucuguacauuucauaucaaugcuaucagauaauauuugaacuuuugugacugucuuuuuucauuuagcauauguaauguuuuccaagcucauccauauuuuaucauguucuaguacuuuauuccuuuuuucuuacugaauaucaacauuauauuucauuauuuauuuauuuuuugagauagggucuugcucugucucccaggcuggaguacacuggugcaauccuagcucacugcagccucaaacuccugggcucaagugauccuccuaccucagucaccuaaguagcuaggacuacagacauguuccaccaugccuggcuaauuucauuuuuuauuuucuuuaguuuuuguaggucucacuguguuggccaggcuggucuugaacugcuggccucaagugauccucuugcuuuggccuuccaaacuacugggauucuaggcauaaaccacuguguccgaccuagcuguauauuuuaaacuucauucuucaaagcacccaggacucgggggggugaaaaagagggacccccuagacuccuucucuugcuucaccuagaacauuuauauuuucaucuauuuauggacaaacuuuuauuuuaaauuugaaagucgugggcucucagauugaagaauacacucuaccugggacugaaagauacuccauggucuuuuuacuccaucuuucuuuccaacucuucuuuucaugugcuccagucagacaguauguugguggagucuugagguauaccucaugcuuucuugccacuguaucuuuucuuauaccaucuccuccaucugaaaugccccuuucccaucuguuuaaauuuuuaccuaacuuucaaugccuaauacagauauaaucaauuccaugaaguuuucccggaucucuggauucuuguaguaauuauacugcuuuagauggugccuugucuaauuucuugagacuacucucauguuuucuuaguuguuuuauacuuucccauugaguggcuggacaugggauggugggggacuggggguugggggugacuauaacagauugcaugggccaggcauugugccucacuccuguaaucccagcacuuugggagaccaaggcaagaggauugcuuaagcccgggaguucaagaacagccuggacaacauagcaagaccucaucucuacuaaaaauaaaaaaauuaaccuggcaugguggcaaaugccuguagucccagcuaucaggaggcugagguggaaggaucgcuugagcccugcagauggagacugcagggagcuguuuugccacugcacuccagccuggucugcagagugagaacaugucucaaaaaaaaaaaaaaaaaggggggguggggggauagcaugagggagaucuuugugaugauaaaaguauucugcaucuugauugugaugguaguuauacaaaucugcacauauuuuaaaaugacauagagcuauacauucauauuguaccaaugucaguuuccugguuuugauguuguacuguaguuacauaagaugcacccauugugggaaauuaugugaauugugugaagguuaccugggaccucucuuugcuaucuuugcaauuuccugugaaucuguaauuaauuuuaaaauaaaaaguuuagguuggccauggugguucaugcauguagucccagcacuuugggaggccagcaggagaaucacuugaguccaagaguucaagaccagccugggcaacauagcaagaccccgucucugcaaaaaaauauauuuuuaaaaauuaacuggguauuaugauacauaccuguagucucagcuacuugagagccugagauaggaggauagacuugggcccuggaggucaaggcugcagugaaccgugauugcaucacuguacuccagccugguugacaaagcaagacucugaaaaaaaaaaguuuaaaaauauauucuucaggccaggcgugguggcucaugccuguaaucccagcacuuugggaggcagaggccggcagaccacuugaagucaggaguucgagaccagccuggccaacaugguaaaaccccaucucuacuaaaaauacaaagauuagcugggugugguggugcgcaccugcagucccagcuacuugggggcugaggcagcagaauaucuugaaccugggagguggagguugcagugagcugagaucgcaccacugcaccgcagccugggcgacagagugagacucaguauaaaaaaacaaaucauuuuuccauggugcuacuucugauuaaugugaaucugccugugccuuccaaaguaaaguuacuuugggguagacaagagauguauuuuuagugauauuuuaguuacauuuuacaauuagaacaaacuugucuaaagcaauaacugagacagagugguuaguucccugucuacgagguccuggcuuauccaaggucuuauuuuaauuuuuaaguugacugguaagccuuugagucauguuuucguauacuuuuaaguucuuaguauucuuauguacuggcuccuagaagacagugaccauagcucugaguuuuagaaaaaaaucauuaugugauguucaguucaaacuuuaaaacuuuuaaaguuguuacauuguuuaucaauugaaaugaauuuucuugugcaaauuuaaaguaagcauuacaagaucagaauuauugcugauuuuuuuuggaaagagguagaguauaaauaaauaaccagaguuuuuuguuugcauuuaugaucaagcucaaagugaauaugaaccaaaaaaaugaacaaaacuacauauuuuuuaguaaaaugagaacuuaauuuuuuuucagguuaaacuacagaacaacauaucguaucagauggcagacauacaucauuuaaaggguaagaaccuuaauuccagauuaaagauaaaccaaggucacuaaaugccuaaaauugugaagaauuaagaaauaguaaauuagccuagugaaauacaauuuucugaacaaacuccucugaugguaaaacauuuauccuuuugccuuaagauauaauaaauuauuuaaugaugcuuuauauaugauaaauccaaguuaaaauuugagaucugugucuuaaccuugagcuacagacaggguuaugcaaugaaauguucuuaagagaauacucaaaaaaaaauugagcuguagcuucagaagccaucaaauuucuagggaaaaggugagaaguguucccucuguacuguguccaaucugcuaaauuaauucauucaggucuagggaugcuuuggauagagccuccaagcuuaagguuuuagauacccugggaacagaaagaaaccuggaaaauagauaaauauauaauaaauaaauaauaauaaauauaaaaauacacacacauauuuuuacuuggaugaagugauaaagagguacuacagcuuuuauggagaaaaaaaaaaagcccugcaaucugcuuauguuacuucaugccauagcuguuagccuuugaaguuuggguucugaggaacaauccucaucucccucacacccuuugguuauaauacuguauuuuaaaauuuugcaugcauugucucuagguuuauguauguggguaguacaugcucucuagcuucaaaaauauccuuuauucuauuauccuuuugagccucuuuggauauacuuagauaaucuauuuuuauuguccucucgaaguagccaaccuuagcuggcuuuguaauguaguaaaauuuuucuccuuaccuagcacaaucaauaggaaguguuuuuguguguuguaacccuaaaauaaguuguugauuuccuauuauccaugauuuagaacagcuuugauuuucuguuagaaaugcuuucugggucaucacauggguuuuuguugcaucuguguccauguucucuuuuugacucaccaaaauauauuaggaugacacagaagaugccacagugucagugcugcuuccaacuugcaauuuuuacaaaugcuuucacuugucaucaaaguauacuucuuauuaaauguuaagaaauacuauuagggcuuauuaaagcaguaacuuaaugcuuauuaacuguuuauuaaauagaucaguugaauaagaaguccuguggcuucuguuaguaugugucaacaaaaaugacaaccuguguuacugaguaaaaaucuuuauuguaccauauguguuggaguagaucuugagauauuuugaaauuguguaugauacucuucagcagagaaaaaggucuugauuuguauguauagcuauacaacuuuugguuuugaagcuugggcucuuaaauuugaauuuaaaaauuuaaaauugaaauucaauaaugugacuuuugcaacuggaaugauuucuacugaaacaaacuucuugaaaacuugccuuuuauaggcaaguuuucuuugaaauuaauaucugcuauaguagaauuaauagacacuaagacacuugagaugguuuauauuuucuuggaaauaaaggaaaguugguuuuuucaaucauugagguaauaaauugacauucuacuaucagauuuauuuugauuagcuuaccuuguuuuuaugccuguuacugaaagaaaguucaaagucaaaguuuucuagaaguaauuuucuuuuuuuuuuuaaagcuggccccaggcaacccauuucuuaccuaucccuaaucuuuugaaguuaaacuaagggaguacagccaugucuuucuauaacauaacugguguugcuuucaaagauagagcguccuguacaaucaaccugacucguguuaacuuacucuaagaguucugcuacggugaccuggagcagccacgcuagacagaauaucucuggguucauauaaagaaaacacaugccaaucagucaaaaguaaaauugauuuuuuuuaaccuuuauuuaaguucagggguacaugugcaggaugugcagguuuguuacauagguaaacaugugucauggggcuucauuauacagauuauuucaucucccagguauuaagccuaguauccaucaguuauuuuuccugauccucuuucuucuuuguuuugcuuucuggucuucuuacuuuuccccuugcaaaucucuguuuugacccacuggaaaucaccaauuaccucccugcuuuaugaucuuucucuguauucaaauaggaaauaaucauauuuuacaugggcuaaaacucauauuaauguuuuauuuuucuuugucaauuguauuuuaagucuuuuaucuucaauuacaaaggaaaauuuuauuuccugauagaugaauuucaaauaccaucaaugggaagcuuuguggggggacagagaagccauccaagaaucuuaaaaucauacuaagccucagguucauucugaagcuauuucagguauuuuacagcauagccugaaucagaagggacuguaaucuuuuuguucccuuuuucccgaggagaaugaguccgaaagaucaccaauugaagucucuuucugguaguuguuaaguuuuguuuguuuuuuaguuacaguuuuuaaauuuagcuuucaguucuagaaacuauccagccugagcacagguuuacugaacuagcuaguuugaucccuuagccacaaggcuuuuugcuacugcuuccuacugugaucucauugucucuauagaaucagcauucauagcuggggccaggguuucugguaccucuggccugcuguaucuuaggagauggagacagggaucaggcaacaagcugaaaggguuuuuuauggcuaccuggccaccacagauccaucacuuuuauuugagaugggggguaaaucaaccauguuuacauauuggagaauuaauauuauaaaaagagaaauuuggcugggcacgguggcucacgcuuguaaucccagcacuuugggaggcugaggcgggcagaucacaaggucaggaguucgagaccagccuggccaacacagugaaacccugucucuacuaaaaauacaaaaauuagcugggcacgguggugggugccuguaaucccagcaacucaggaggcugaggcaggagaaucgcuugaaccugggaggcagagguuacagugagcugagaucgcaccacugcacuccauccugggcaacagagcuagagacucugucucaaaaaaaaaaaaaaaaagaaagaaauuuaaaauguggcuugaauaugcaaagauaaugauuaacuacaaauauuuuauaugaaucauugauuuuuucauacuugauuauuauacaauaguuauuaugcauauuguuaagcauuaugugucucagcagauguuuaugugacuuaaauuuuuauucuucguuauugccacaguuauaauuccacaauaaaauuuagaaaguguagaaaaaaaguauauguucaaaauccuacugucagacacauucacugauagcacuuugauauauuuuuauucuagucuuuuuuuuugcauggaugcaauuauauguuuacaucugcuguuuaaaaacaucugcuuuuuauuuuuauuuuuuuauuuauaguuuuuuuuuuuuuuugagacggauucucgcucuguuguccaggcuggagugcaguggcaugaucucgguuugcuguaaccuccgccacucggguucaagugagucuccugccucagcuuccugaguagcugggauuacaggcaugcgccaccacaccuggcuaauuuuuguauuuuuaguggagaugggauuucagcuuguuggcgaggcuggucucgaacuccuggccucaugugauccacccuucucggccccccaaagugcugguauuacaggugugagccaccgugcccagccaacaucugcuuuuuuuuuuuuuugucucgcucugucacucaggcuagagugcacaguggcguaaucucggcucacuguaagcuccaccuucugaguucaagugauucucuugccucagccucccaaguagcugggauuacaggcucagaccaccaugcuuaguuaauuuuuguauuuuuaguagagacaugguuuuaccauguuggccaggcuggucucgaacuccugaccucaggcgauccacccgccuccaccucccaaaguguugggauuacaggcaugagccaccacgcccagccccaacaucugcuuuuuaaaaacagccaggcaugguggcucacgucuguaaucccagcacuuugggagauuuaggcagaaggaucgcuugagcucaggaguucgagaccagccugggcaaaauagugagaccaucucuauaaauacacguauauaucuauaucucccuuuuuacucaggaaaguggcuguauauauaucucccaaguauuuuuggagugcuuuuagaggaauaagacuaauucuguaacccuucuguaaaaaauagauguuauaguauugguacauuauggcuagauguuauauuuuaaucuuaauagcuguugcuuauacaguauaggccccuguuuucauuucuaaaaauuaucuuaauacuacuuuugcuuaacugcuaaggcuguuagcuguuuuuaaaaucaccuaucugugaaauuaacauucacucuuuuccgccugcauuucuuuugucuguaggcuuagaucaugagggaaugaaaucuagaacauguguggcuggugauuauggauuaaacauuuacaaacaaguguuuggccagguuauaauuuacuauccaguuuggaauuucacaugauucauuuccacuaaaaaaauucaguccuaguccagaaauuaugagcuuugaaaauggaauuuugggauauguagagcuaccauccauagccgaacuagaaauguaucuaaagugauuggcaccuauguugguagucgaaugugauuuaaaaugagaaagaaaacuuaaaauuuguacccauaguacuuuuuuccuacuuuaauaaagcagauagauuugaagagauagguaguuuuuuguauugucuccacagcuuagcaugugucuauacaaaguguaacaauguguaauuuaaagaauauuuuggguugaugugaaagccacugaagcuauauuuuuuaaaaaauaaauguugccggucaggcaugguggcuuaugccuuuaaucccagcacuuugggaggcugugguggccagauugcuugagcccacaaguuugagaccagccugggcaacauggcuaacccauaucuacuaaaaauacaaaaauuagccggaugugguguugcacaccuguagucucagcugucugggagguugaggugagagaaucacuugagcucaggaggugcagguugcagugagccaagauugcaccacugcacucuaaccugagugacagagcaagacccuaucucaaauaaauaaaugaauaaauuuuauugaccaugaauguguuacaaaaggauauuaaaugugguguuuguuauauaauuuaauuuccugggaguauuacuaaagaaauugagaauuauguauaauuaaaaaaacaucccauagcuucugaauaggaagcauuacaaugagugaacuugauuccuuugguucuuaccuuggguggauagagcaacuugcugagcuucgucaggaauuucuucgacaagaagaccagcuucaggacuauaggaagaacaauacuuaccuugugaagagguuagaauaugaaagguaagauguuacaugcaacauauguuuaugaaucuaaaauauuuguccagcuuuuggacucaguucauuucuuucucucugacuuuuguuucccuuuuuuucucuucuuucauuuuguuaagccuuuuaaauuccuuuucuauuaucuuucuuuagcucuuugaaauccagacucuuuuauuuugauaaauuaaacagcaugaaguaucucuuagagggcauguugaguuuguguauguuguagaauucauugugagagaaaaucuuacaagcucugaguuuuauuagauguggcaaagauggaaagaagauuugugauucuuuuugacggacauccagaagaugaaaccagcacugggagauguucccagaagagcugagggacugagugccggcugcucuuccugcucugcaugucagcccucuugcugauaccucuacacuuggugaugagguuggggauccucuuacaggccuuucuagcaaucacgccuuaaaacuuuuauuauauuuguaaucaauuuuaugguaaaagauauuuuuuagauuuguacaccaaaaguuagaaagauuugccauauuuuaaagcauuuuguguccauuucugacuucuuacucuuguagguuaucauuguacauuuacuuaaauauauguauuuuaacguaacaguauucaguauuuuucugcaugucuauaggauuaaagauuuaacguauguacagguaauauauuauucuagcauauuaauguaccaaaacuucuuuagucucuuccaauugugggaccacaguaggaguuuuccuuuucucacuuuaagacuaucacaggcuagguuauggugguucacaccuguaauccuaacacuuugggaggcugagacuggagaaucaucugagcccagaaguuaaaagaccagccuaggcaacauagugagaccucugucucugaaaaaaauuuuuaaaaauuagcugggcaugauggcguaugccuguaguccuagcugcuugggaggcugaggugggaggauugcuugaguccaggagauugaggcugcagugagccaugaugaugccacuacacuguagucugggcaacagggugagaacuugucuuuuuuuuuuuuuuuuuugagauggagucucucacgucucucgcucugucgcccaggcuggaaugcaguggcgcgaucuuggcucacugcaagcucugccucccggguucacaccauucuccugccucagccucccgaguagcugggaccacaggugcccgccaccacgcccggcuaauuuuuuguauuuuuaguagagacgggcuuucaccguauuagccaggauggucucgaucuccugaccucgugauccacccgccucggccucccaaagugcugggauuacaggugugaagaacuugucucuuuaaaaaaaaaaaaaaaaaaaaaaagcugagugcaguggcucacgccuguaaucccaacacuuugggaggcugaggcggguggaucaccugaggucgggaguucaagaccagccugaccaacauggagaaaccccauuucuacuaaaaauagaaaaaauuagcugggccugauggugcaugccuguaaucccagcuacuugggaggcugagcaggagaauugcuugaaccugggaggcagagguuguagugagccgagaucgcgccauugcacuccagccagggugacaagagcgaaacuccaucuggaaaaaaaaaaaaaaaaaaaagacuaucacagcuauaaaaaugucuaugcaaaaaagauuucccaaaacuagcuggguaugcuggcauacaccuguggucccagcuacuugggaggcagaagugggaggauugcuugagcccaggagguugaggcuacagugaaccauaaucaugccugcacuccagucugggcaacagaaugaaaccuugucucaaaaauaaauaaaaaaauaaagauuuccccuccccuuguuauuucaguaguauauuuucucaaauguagaauuccucuaaaagaaugauuuaccaguuuuguugcuuuuacagcauagaugaaagguugcuuucuaaaaugauuguacucauuuauaauguagacauuuccccauagcccuaccaaauuugguuuuaauucuaauuuaauuuuguuaguauaggaauaagauacuacuauauauauauacauauaggaaguugguggguuuuuuuguuuuguguuuuguguuuuucuuuuuuugagacugagucuguuucugacgcccaggcugggagugcaguggcacaaucucagcucacugcaaccuccaccuccuggguuuaagcuauucucaugccucagccuccugaguagcugggaccacaggcacguaccaccaugccuggcuauauuuuuuguaucuuuaguagagacagggugucauuguguuggccagacugaucucaaacuccuggccuccagugaucugcuugccucagccucccaaagugcugggauugcaggugugagccacccugccuagccacauauaagaaguuuaauuugcauuuuauaauggugaaaguuaacauuuuucuauauguguguuaacuguuucuuuuugcaugauugguguauguguauccuuugacuacuuggcuagcagaaagucaccaucuuuaucuguuuugcugcuguucacuuucuccugauggcaccagucuaucuucuuuauuaguuucuuucguuccuaguauucuaugguuuagccuuuuauuacaguguuaaacuacuauuggaugaaucuucugcugccacuucuuaucagcucucauaauucuagcuuuccucaucuguuacuauaaauuggucucacaguuuucucuucuauaguauuuuucucuucugugauugaaguugguuuugaaaguuuuuuuuuaauagaugcaauuuauggaaauaauaggaaaagaauuguuuuuaucuuuguaauuucuguuuucucaauuagcuuuaucaguauuaucuaccuccuauuacaaguucaaguauuuuaaaaguuuugauugugagcuauuuguaugcucuguuuuuuccagcccacucuccccugcuaacugaguguuuuaucuuucuuauguaugugucaacuucuggacaacuuugagaauccaauccaagauaauauaaucuaaaagaaugacuuuguaauuuaguuuucaguguggacagcagaugaaggaauugagagcacagcaugaagaaaauauuaaaaaguuagcagaccaguuuuuagaggaacaaaagguaaauuuuaaaaauauacuuaaauccaaauauuuuuauuauaaaucaugguaauuuagaaauuaaaauuauaauuuugucacaaaacacuauauuuuaaguuuuccagccagccuaauuccaaaagugauuuacaauggcuuuauuucugaguaaauuaaacauuugcaaaaauauaaucuuaauucuuaaaacuggucgggcacggugguucacgccuguaaucccagcacuuugggaggcugaggcgggcggcucacucgaggucaggaguucaagaucacccuggccaacauggggaaaccccaucucuacuaaaaauacaaaauauagccaggcuuggugguguaugccuguaaucucagcuacucaggaggcugaggcaggagaaccgcuugagccugggagacggaggagguuacaaugagccaagaucacaccacugcacuccagucugggcaacagagugagacuccguuucaaaaaaaaaaaaaauuuaaauuaauuuugaaccaaaauauccaucuuuuuaaaaaaauaauuuuuguuguuaauauauuucucagauuguaaagugggcaacuuuuuuacugaaaaucaacuacuuccuuuuuuauacauuugagaaauagaaaaaaaagaaacacuuuuuccuuuaucaucagucucuguuauucugacacccuuuccuaaagcacagaaaugagacacuagccacuacaaccaauuugauucauacuuuuuuuggggggggcaaauucuuuuauuaauucauuuuaaguuaauauguauuaugaagauucuuuuagcaauagaggaaauugucugaagauuacuaauuauuaaggacaugauucauuuuuuuuugugugugugauggagucucgcucugucgcccagcuagagugcaguggcgugaucucggcucacugccagccccgccuccuggguucacgccauucuccugccucagccucccgaguagcucggacuacaggcgccugccaccacgcccggcuaauuuuuuguauuuuuaguagagacaggguuucaccauguuagccaggauggucucgaucucuugaccuugugauccgcccaccucggccuuccaaagugcugagauuacaggcaugagccaccgcgcacagccaauucauuuuuuuauaccuuguaaucuuaccuaaccaggcaugauuuuuaugaacucuugugauuuaaaggaaaaaaagauuuaauagugaaaaguauuuguuuugcucuuugguagcaucucaacuaaaggacuagaaguuaaggauaucagguuuucauucuuagcuuuuucacaauuuuauaguaggauauagagggugucauuucuuucuccauuucauuuuuugaaucuacaaaguggaauaccugcugccuaucugcagucuacuuugaagagguguuuaaggauggauugguggacgaaggcaggccugagugagcuaccauaguagaggcauugagggcaaccaaaagguauuauugagacacuggagggucaaaagaacauaauggaacacaaaaggaaggggaagagagguuugcuguugcaauugugucauuauaagcguaguauauaaauaaugggauaaguuugcucucuucuauucucuuuuuuuuuuugagauggcgucucacucugucacccaggcuggagugcaguggcgugaucucagcucacugcaaguuccgccucccagguucacacauucuccugccucagccuuccgaguagcugggacuacaggcaccugccaccacgcccagcuaauuuuuuguauuuuuaguagagacgggguuucaccauguuagccaggauggucucgaucucccgaccucgugaucugcccgccucagccucccaaagugcugggauuacaggcgugaggcaccacgcccggccgcucucuucuauucucuuaaggaauacagaugagagcuuucccuuuuuuuccaagccaguguaauucucuuucuguucuucuauacuaggcuauuuuuauguuauuaauuaacuaaugcuucuccaauucuuccuugccauuauccuacccuaaauggaacaaggcauggcaggaauugaggugcccagagaacuucuccuuucuggguagcacaucagcccuuacccucuagaucagcuaccuaauucuacuccccacccuucauuuccuguacuuuaacuacuauggcaaguugguucugugcaauuugaguuuucauagagacaaauccaauguuagcuauaugaaauaagcauaaauuguauucagggauuuaucuuuuuguuuuauuaauuuuaaaauuaauuaaccagccacaugucuaucauagaaaugacucuggaaaagaagucagcaaacuauagcccgcaggcugaauucagcuugcugccugcuuucguacuguuuagaggccaaaagugguuuucacauuuucaaaugguugaaaaaaaucaagaaaaaauuaucuuaguacuugggaaaauuauaagaaauuuauauuuugguguucauacauaaaauuuuauugagacacagccaugcuuauuuguuuacugcguucaugcuguaagggcagagaaacucucauagcccagagaagacuaaggagacuaaggacuuaaaugcaguguaguagcugggggcgguggcucacaccuguaaucccaccauuuugggaggccaagguggguggaucaugaggucaggaguucgagaccaaccuggccaacauggugaaaccccaucucuacuaaaaauacaaaaaguuauccgggcaugguggcuggcaccuguaaucccggcuacucaggaggcugaggcaggagaauccuuugaacuggggauauggggguugcagugagccaguacugcaccacugcacuccagccugacagcagaacgagacuacaucucaaaaauuaaaaaauuaaaaaauuaaaauaaaugcaguguaguauccugaauuggauccugaaacagaaaaaggacuuaguggaaaaacuggugaaaucuaaguaagucuggaguuuagguaguaauaauauacugauuuucuuuuuuaguuuugcaaauguaucaugguaauuauggaugguagguuaacaggauuuuaacauuagggaaaacugaguaaggggugauuacuuuucuguaaaucuagaauuauuucagaauaagaaguuuauuuuaaaaacaaucaggaggcccacuaaccaaaucacaaacauuacaucuagaaaagcaucuuauuuuauuaauauuaauauuguccauucauagaaagguacugucaauaguacauuaaagauacaacaucuuuguuaacuauuuucaauggaaaaguauuuuugaacaguagcuuguugacuuuuaauuuuguucaauauuuuucuuauccauaucuggaaaagagugaagaguacuauagcaauagccuuaugagauagcauuauagugaagaugcacagacaugcaagcuggcugcucagguuguaccucauggauuuucucacccuugguguuuauauugacauguucaaaaauuucaguuuaucauuucauucaucaaugauuaaacuaucagaauugauuauagcuuaccaacuuacaggaaaugugggauuuggagucagaaagacugugguuagaauuccuucuucacaauucucuaguuuugugacuuuggacaaacugcuuuuuuuuuuuuuuuuuuuucugagacagagucuugcuuugucacccaggcuggaguacaguggcccgaucucggcucacugcaaccucugccucccggguucaagcgauucuccugccucagccuucugaguagcugggauuacaagcaugcgccaccaugcccgacuaauuuuuguauuuuuaguagagacgggguuucgccauguugguccggcugauuuugaacuccugacuucaugauccacccgccucugccucccaaaguggugggauuacaggcaugaaccaccgugccuggcccaaacuacuuaacuuuuucuauuuaauggaguguugcacuguugcccaggcuggagugcaguggugccaucuuggcucacugcaagcuccgccucccggguuuacgccauucuccugccucaggcucccaaguaacuaggacuacaggcacccgccaccacacccggcuaauuuuuuguauuuuuuaguagagucgggguuuuacuguguuagccaggauggucucuaucuccugaccucgugauccgcccaccucggccucccgaagugcugggauuacaggcaugagccgccgugccuggcccaaacugcuuaaguuuuuaauaccucaguuuuguuuuucucaaaacuauuaauuuuauuucuacuagaggacagcuaugaaggcaauuuggaaacuaugagacacgaugcaaauauuuauuguugauuuuacuugccaggacacuggaauaccuacaccuaauugucagaguacucuuucuccuuuauugugacacacucuuaagauuuggcuguuguggccggguacgguggcucacgccuguaaucccagcacuuugggaggccgagguuggcagaugacgaggucaggagaucgagaccauccuggcuaacacagugaaaccccgucucuacuaaaaauacaaaaaauuagccgggugugguggugggcaccuguagucccaguuacucgggaggcuaaggcaggagaauggcaugaaccugggaggcggagcuuggagugagccgagaucgcgccacugcacuccagccugggcgacaaagcaagacuccgucucagaaauaaauaauaauaaaaaaaaauauuuggcucuuguuuuucuagauuccauauagauuuuucguacuauuuuuauaacauuacuaagaauuauauuucauacugcauuagaguuuacaaagcauuuauagaugcauuaaauguugacuagaggaaccuguauauggcaucccaagcuuguguacuugaauccuugcugcucccaauuuuccauggaggcaaacuuaauacugguccaccaagagaauugaguuaggccuaaccauguaccugaagauucacauuuccaagaagaugcuagguuaggaacagguuagaggaagcacugaccuguuuauuguccugccacuacuugcuguguuucgguggccagcacacuuaggaagaagauugccuguuuuucacccuugcucuugaagaggcaccuguguaccagucuccuccuuacugccauccugcuugguucuaacauaugcuuacagagaacccacccugcccauagcacccaggaagaugcccaauuuuaggccauuaggguaaccuagaguauucagcaggcugucuugcagaaucacacaccucagcauagccaagcagagucaccucugccuaccaaaucauucauuuacuguagcuagagauuuucaaaaguguuauucuuugacuuuuuaucagguauaaaaaucacacagaaaauaauguauccugcaucuccaauuguucauuauuugaacccaugguauauguuuuacaagaugaacuguuucagaacauuuaauuaauaguugugucggugguuuaacaauuugaacugaaaaauauuauuaccaaauuuugucuaacagcaagagacccaaaagauucaaucaaaugauggaaaggaauuggauauaaacaaucaaguaguaccuaaaaauauuccaaaaguagcugagaauguugcagauaagaaugaagaacccucaagcaaucauauuccacaugggaaagguauuauuguuauuauucuuuuguuuuguauuaauaggauauugacuuuuucuucccauuuugaaguggauauuuucaaucauaaagaaaauuguuugauuuuaguucacacaugauuaagugucugcauuguuucaaauuuggauuguuugauagaagagaaaaaagaguaaguuauuuuagaguuacagcuauguccaaagcaagagguaaagauguucaguugauguagccuauuacuuuuagaaacugauuguuacauuccuucaaaacauuuucaaauuauguaagaaaaacgauagaauucuaucuuuuuguuacuugggcagaacaaaucaaaagagguggugaugcagggaugccuggaauagaagagaaugaccuagcaaaaguugaugaucuucccccugguaaguaaaaauuguuagagaauucgacuaaagugaugauaauacauuucaugugaccccauucucuuuuucgguaacacuuggaaaagucacagauaucuggaugaucgauauuucuacuuaauuaaguacccauuaauugccaggacuuuuuuuggauccaacuuuuauaaaauuuuuugcuaagauguauaaaauacuuguuuuugccuugauaagaaucaccuauauuugaaucuuuucuuugcgacucugaguuuuugcuuaugacaguuguacuauauagagucauuuauguuuacuaaaaguaugcauggcucuuuucuuucccaccaaaugugcccagauuccuguguuguuggugugcuuuaauauggcauaguaauacccuaauaagaguuauuuaauuauuuaguuuugagggcuuggcuuguccuuuuagugaauuaccccacacuuuuggauaguuuguuuaacauuuuuuuucuucuuuucuggccacuucuguucauuguaugucucuuuccuccuuaaugugucugcugcuuauccauuuucacuugaaggccugcucccacuugcugcuauucuaauccccuucauuuuuuuccuucaugucucuucuuuguuuuucuugccauaucuauguuucuuggcuauuaaugguacuccucccugcugacuccaauuuauuaggguagaaaaauaagaaauuaacagcaugccucuacugcuuuuggcugauuuuauuucuucucagucucaguaauuacuucugugauuauagcuaguuguacaugacugaaauugcugaauguuuagaucaaauaaaugaaauauuuguccuuucauuuauauaguuuuauugucuucucaaauucuuauggguuuccaauucauagugauuuccccuaaaauaaagguaaggacaaaagcaauaacaugaauuugaaaauaaagaaucagaauuagcaagcuuuguuuguaagacaaugaaguaauccagugauuuuuuaaaauuaauuaauuaauuaauuuugagauacagucucucucuguugcccaggcuggagugcgguggcgugaucuuguuucacugcaaccucagcuucccagguucaagcauuucuccugccucauccuccugaguagcugggauuacaggugugugccaccaagcucagcuaauuuuuguauuuucaguagagacgagguuucaccauguuggccagcuggucucgaacuccuaaccucaagugauucucccaccuuggcuucccaaagugcugggauuacaagcaugagccaccaagcccggccucuuuuuaaaauuuugagacagggucucacucugucacccaugcuggagugcaguggugcagucauggcucacugcaguuuugaucuccugggcgcaagcuauccauccaccucagcuuccugaauaacugagacuacaggugugugccaucaugcccagcuaauuuuauuuuuuauuuucuuuauuuuuuuauuuuugugauaugggaucucgcucugucacccaggccagagugcaguggcaugaucacagcucacugcagccucgaucucccgggcauaagcgaucuucccaccucagccuccugaguagcaggaacuacaggcaugugccaccacaccugacuaauuuuuauaguuuuuuuguagagauaaguuuucaccguguugcccaagcuggucucgaacuccuagccuuaagcaaucugccugccuuggccucccaaaaugcagggauuacaagcaucagcuaccaugcccagccuauuuucuuuauuuuuuuguagagacaaggucucaccauguugcccaggcugaucucaaacuccugggcuuacgugauccucccaaagugcuaggauuacaaacaugggucacugcacccagccaaaaaauauagagagagagagccaaaaauuacauauauuuuuuucagagacagggucucauucuguugcccaggcuagagugcagugaucauaguugaugguggccucaaacuccuaggcucaagccauccucccaccucagccuucuaggacuacaggcacacaccaccacaccuggcuaauauuuuuauuucuguagagacggugccucacuguugcccaggcuacucuuuaacuccagucuucaagcgauagucccgccucagccucucaaagcacugggauuauaggcgggagcuguggugccuagcuguaauucggugauuuuuaaaguguggucuuuggaucagcagugucagcauuacccaggaaccuguuagacaugcaaauucuuaggucucauuccagaccuacuuaaucagaaauuuuggaauggagcccagcaauuuguuuuaaaaagcucuccuagugauuuugaucuaugcuaaaauuugagaaccacugacuuagauguuaauuuaaagaaauguucagagcaggaacucuguauucuuccaaauuuuuguagcacuuacucuaguccuaggcacaguugaguuuuagguugauuaaucuauuuuacauugcgguuguguauuuuaaaaacuauacccaaaguuuugucaaggacauacugcugguuucugauacauagaagcacucuauucagauaugagcaacaguuggcuaccugcauacauuaauuuuucauguaauauaccugaaaaauguauuauuuguguuuaaauauauauaauuuuugaccucuauuauuuauuuccacauacuuuucucuuuuuuuuuuuuuuuuuuugagacagagucucacucuguagcccaggcuggagugcagugaugcgaucuuggcucacugcaagcuuugccucccagguucaugccauucuccugccucagccucccgaguagcugggacuacagaugcccaccaccacguccagcuaauuuuuuguauuucuagcagagacgggguuucaccauguuagccaggauggucucgaucucccaaccuugugauccgccugccucagccucccaaagugcugggauuacaggcgugagccaccacgccuggcauauuuccacauacuuuucaaguuaaaauuuuaucauuauuacucuaaauguguaaugucuccauuuauuuucucauuggucauaauuuauuacccagccaccaggaaauuccaguguuuaggguaaaaugaaaugggaauacaagagaucuuagagaucuugucuugaccauuauuagguauauuguccuaucagacagugguuuucaaaugucuuucauauaugaaccacuccagcaggauagaaaucuuaucuugccgcuucugcuuucuuaauaauaauuuuuaaaaaguacacaacaauuuuauuagauuuuuuuuuuuuuuuuuuuuuuugagaccgaguuucacucugucguccagccuggagugcagucgugcgaucuuggcucacugcauccucggccucccggguuuaagcaguucucugccucagccuccugaguagcugggauuacagcgcccaccaccacgcccggcuaauuuuuuuuguauuuuuaguagagacgggguuucacuaucuuggucaggcugauccugaacuccugaccucgugauccaccugccucagccucccaaagugcugggauuacaggcgugagccaccgcgccuggccaauuuuauuagauuuuauaagaaugaauagcgcuacuuuugaugagaugccaacaaauucauaucugauuuuuacaaugugaacuugccauaugcaacuuacaugguugcagcacuauaauuuggaacugggaaaaacaccacguguauuaacauuuuguguaaauugaucguuaauguaaaaaaugucaccauaugcagacauuuucuacauugucauggcauauuaaaggccuuccucuggauuguuuuuuuuuuuacuuuuauuuuuauuuauuuauauuuuuugggacagggucuugcucugucaccuaggcuggagugcaguggcaugaucauggcucacugcagccuugaccuccugggcucaagugguacucccacaucggcucccgaguagcugggacuacaggcaugugccaccacauccagcuaauuuuauuguuguuguuuguagagacagggugucguuauguuauccaggcuggucucaaacuccuaggcucaagcaguccucccaccuuagccucccaaagcacugcaacuacaggugugagccaccaugccuggccuggauuaauauuugaagcucuuuaaacuauuggugcuuugcuuugauaaucauuuuucauagcaauuauccuuaauuauuugaggaaguauuuugaguguaaagauuauuuugaaaugguaacugguagaaggaaacuuugagcucugugaucauucggaugcaaacacgaaggaaagccauuucauaucuuuguaucuggagcucccuacaugcugccuugcauauagcagggucccaguaaauguguaugguugaauuaucaggcuaucuuuaauggugagacaauggucucuggagucaaauugccuagauucaaaccuuuggcucuuaucuuuuaacaauuaugugacaauuuuuugcccuuauauguaaaauagaauaauaacaauuccagccugacaggaauguugugaaauuuaaauguaaaacacuuagaacagugccuggcacauagcaagugcuauauauaucuuaguuucuauuggccgggugcaguggcucaugccuguaaucucagcacuuugggaggcugaggcaggcagaucacuugaggucaggaguucaagacccccuggccaacauggugaaaccccaucucugcuaaaaauacaaaaauuagcugggugugguggugggcaccuguaaucccagcuacucgggaggcugaggcaggagaaucgcuagaauccagaaggcagagguugcagugagcgaagaucaugccucugcacuccaaccuggaagacagaaaaaaaaaaaaaaaccaacuuaguuguuguuguuauuauuauuucauguaauuguagccccauuuuuaaucucuuugccacuccuuuuucucaguuuugucuuuucuuccugaaguagaguaugccaaaauucuuaaugucaauguaaguucugguguauaugugguguccuauuagcuauagaggcaguaaccccaaagaggaagcagagaaaagaacauauccuggcugggcauaguggcucauaccuguaaucccagcacuuuaggaggcugaggcgggcggaucacuugaggccaggaguuugagaccagccuggccaacauggugaaaccccgucuguacuaaaaauacaaaauuagcugggcaugguggcacacaccuguaauuccagcuacuugggaggcugaggcaggagaaucccuugagcccaggaggcagagcugcagugaacugagaucgcgccacuacacuccagccugaacaacagagugagacucugucucaaaaaaaaaaaaaaagaaaaaaauauauauccuuguaauuuaaaaauggacuguuauauauacugacaguuuuguuuaagauagcuaggaccauacuagaaauuaugguagagcaaugggaaacuaucuuuaaauauaccucugaggccgggcacaguggcucacgucuguaaucuuagcugagauuacagcuggauaggcugaggcgggagggucgcuugaacccaggaguuugagaccagccugagcaacaugaugaaacccugugucuacaagaaauagaaaaauuagccagucaugguggcacacgccuguagucucagcuacucaggaggcuaaagugagagaacugcuugagcccaggaggcggaggcuucagugagcagagaucacaccacugcacuccagccuggugucagagcgagacccugucucaaaaaaaaaaaaaaauguauauguguguguauauauauauauauauauauauaccucugaaauagucaaggguuauagagcaugugccuaggguuagcauuuuguuucagcuucucagcucccaaagccauacagugaacccuuacuggguuuuguuuguuuuuaaugcuugauuuggaacuaaucgccaagacuuuacaggaacuuuaugauuuaaugaauuaccuucuugaccuggauacuuaccuauaugcugauuuagauaacuguaauguuaggcaguuacauauuuauaucaguaguuuuuaaacuuuuaaaaucuuuuuguuauuuauuauuuuuuauuuuuagagacaggaucuuauucugucauccaggcuagaguacaguggcauggucauagcuuacugcagccucaaacuccuagacccaagcaauccuucugccuuaccuucuagaggggcugcgauuacaggcuugugccaccacaugcaaaacuuauuuauuuauuuauuuaauuaauuuuuuuuuuuuuuugagucggagucucguucugucgcccaggcuggagugcaguggcgcaaucuuggcucacugcaagcucugccuccuggguucgcgccauucucuugccucagccuccugaguagcugggacuacaggcacccgccacaaguagcugggacuacaggcacccgccaccaugccuggcuaauuuuuucuuuuuuuuuuuuaauacagacgggguuucaccauguuagccaggauggucucgaucuccugaccucgugauccgccugccucggccucccaaagugcuggaauuacaggcgugagccaccgcgccuggccuauuuuuuuauuuuuugagauggaguuucgcucuuguagccaaggcuggagugcaauggugcgaucucagcucacugcaacugccgccucccagguucaagcaauucuccugccucagccuccugaguagcugggauuacaggugcccgccaccacauccagcuaauuuuuuuuuuuuuugagacagagucucgcugugucgcccaggcuggagugcaguggcacgaucucggcucacggcaagcuccgccucccggguucaugccagccucugaguagcugggacuacaggugcccgccaccacgcccagcuaauuuuuuguauuuuaguagagacgggguuucaacuguauugcccaggcuggucucgaacuccugagcucagguaauccguccgccucggccucccaaagugcuaggauuacagguguaaggcacugugcccagccuuucuucuugauauuuaggaguucuuuaacaguaugcaaugcaaauaucuucucuguauuauaccuauaaacaaagaggaaaaucguauuucuuucuuggaaacucuuuuuuagcuuuaaaaauccaaucagucccaguaaaaauguaaaaauuaccccuacugacuuacuuugggggaaacccucuauagguauaaagauauuuaaguaccugagcaauugaaaguuauuuuccuaauuaauaacuuggaaagaaaaaaauuacucccuugguucuuauuuuucuuuauuuuuauuuuuauuuucuaucaacagcauccaggaaaagcuuuuagguuuugugugugugugugugugugugugacagagucucgcucuguuguccaggcugaaguauaguagcgugaucuuggcucacugcaaccugcgccuccuggguucaagcaauucuucugucucagccucccaaguagcugagauuacaggcgccugccaccaugccuggcuaauuuuuuguauuuuuaguagagaugggguuucaccauguuggccaggcuggucuugaacuccugaccucaggugauccacccgccucggccucccaaaguucugggauuacaggugugagccgcagcaccuggccaggcuuuuaguuuuuaaauauuagguagagguaaucuauuuguaagauaacagauuuucuagaacagaggcuucgaauggugguugcauauuggaaucucuggggagcuugaaaaaaaaaaagauacugaugccuaaauuccauuccagagauuuuguuauauuuguucugggguuugacuugggcauugaagguuuaaauggucacuaggugauuacauuauguagcuaaggcagaaaaaccuuuacucuagacagauucucuagaucuauacuguauuaaugcaguagccauuggucacauguggcuauuuacauuuaaauucauuacauuuaggugaaauuaaauucaguuucuuagucaaacuagcuacacuuaaagugcuuacuuaguaguuaccuguggcuaaaggcaacuguguuggacagcaccaaugcagaacauuuucauuauuguagaaaguucuguuggacaguacugcucuagauugaaaccaguaauagugguuuuauggggaagaagauuaggacagggaugaaaaggugacuugcuuuucauuauauaaucuucugaacuuuuaaauuuuuguauaauacuaauaaacuaccuauucaaaaaaaucauuauuuaaaaaaauuaaagagaggcuagguguaguggcuuacgccuguaaucccaacacuuugggaagccuaggcaagaggauugcuugaggccaggaguucgaggcuugggcaacauaacaagaccucauaucuuaggaaaaaaaaaaauggcuaggcauaguggcacacaccuguaguccuagcuacuugggaagcugaggugggaggaucacaugagcccaggaguucgagauugcagugaacugugauugcaccacuguacuccagucugggugacagagagagacccugucuaaacaaaaaagagagagagagagagagagaggaggcagagugagauaacugaauagaagccuccacugauuguccucccugcaguagcaccaaauuugacaacugucuacacagaaaaguaccuucaugagagccaaaaaucaggugagcaaucacaguaccugguuuuaacuuaauauuguuaaaaggggcauggaaggaguaggaaagacagucuugaauugaagacaccaccccccaaccccugcaguggccuuguggcauggagagagaaucuauacacuuccaggagugagagugcaguaauugugagacuuugcacuggaacuuagugcugccaacacugagcagaacucagccaaugcccacagaggaagccuguggacuaacccuagucagaggggaaauuuucucucccagcaggcagaacuugaguuuggcuagccuugccaccgcgagcuagagugcuuuggggucuuaaaugaacuagaaaagcagucuaggcuagaaggacugcaacccccaggcaaguacuagaguagugcugggaucagagccaguggucuugcgggggcacacaaccuagugagacagcagccagggugacuaaggaagugcuugugucaccccuuccacacagugccagccagugcaucuugccaguacaaaagagaccccuuccuucuguuugcggacaggaaagggaagaguaaagaggacuucauuuugcaacuugaauaccagcucagccacaggcaucuaggguaccaaguagaguugugagaccccuauuccaggcccuagaugccuauagugucuagacacagucagcgccagaagggaaccuccugccuugaagggaaggaccuagaccuggcaagauucaucaccugcuaacuaaagagcccuugggcccugaauaaucagcacugguaaccagauaggagaugccauggccuugagugagacucugagacaugcuggcuucagguaugacccagcaguagcgacugcaaguaaagacucugcuuaacaaaaggagagggaagaauaaaggagauuaggucuugcaguguagauuugaacuuggucauaguugggaagaguaccaaaugggcucuuagggucccuaauuccaggccuuagcuccuggaugguaguucuggaccuacacuaugcuagaagggagccuguugcucugaagggugagucccaggccugaguguucacaagaugacugaagagcccuugggccuuaagugaacacugucgauacccuggccuccccaugggaggccacaguacuccccaugggccugugguagugguggacacagggagagacugagacucuguuuuggugccaaacuuacugcaguagaaagaauaccagguagauuucugacauuuccaauucuaggcccugguucccagacaucaucucugaaccugcugggggaauuugccacccugaaaggaaggacacaagcccagcuggcuucaucaucugcugauuguggagcucuagggccuugagcaaacauaugugguagccagguagugguuacagcaggccuugguaagacccagugcuguauuggcuucaggucuaacccagcacaguucuaaugguggugccacagugguacaugccuauagucccagcuacuccagaagcugaggugggaagaucacuugagccugggagauugaggcugcagugagcugagaucaugccauugcacuccagcuugggcaccagagcaagaccuugucucaaaaaaagaaaaaaaaaaauuaagacccaacaaucuguugccuacaagaaacacacucaccuguaaagacacacauaggccgggugcaguggcucacaccuguaaucccagcacuuugggaggcaaaggcaggcggaucaccugaggucgggaguuugagaccagccugaccaacauggagaaaccccgucucuacuaaaaauacaaaauuagugggacgugguggugcaugccuguaaucccagcuacucgggaggcugaggcaggagaaucgcuugaacccgggaugcagagguugcggugagcugagaucgcgccauugcacuacagccugggcaacaagagugaaacuccgucucaaaaaaaaaaaaaaaaaccacacaaagacugaaaauaaagggaugagaaaagauguuccaugcaaguagaaaccaaaaaaaagagcagaaguagcuaugcuuaaacaaaauggauuucaggacaaaaacuaagagacaaagaaggucauuauauauaaaagggucaauucagcaaugggauauaacaguuauacauauauaugcacccagcauuggaacacccugauacauaaagcaaauauuagagcuaaagagaaagauaaauuucaauacaauaauagcugaagacuucaacaccccacuuucagcauuggacagaucauccagacagaaaaucaacaaagaaacaucagacuucaucuacacuauagaccaaauggaccuaauagauauuuacagaacauuucauccaguggcugcagaauacacauucuucuccucaguacaugcaucauucucaaggguagaggccauauguuagaccaccaaacaagucuuaaaacauucaaaaaauugacguuauaucaaguaucuucucugaaccacaauggaauaaaauuauaaaucaauaacaagaggcauuuugggaacuauacaaacacauggaaauuaaacaauaugcuccugagucacuagugggucgaugaagagauuaagaaggaaauugaaaaauaucuugaaacaaacauaauggaaacacaauauaccaaauccugugggauacagcgaaagcagaacuaagagggaaguuuauagcuauaagcuccuacaucaaaaaagaagaaaaacuucaaauaaacaaccuaacaaugcauccuaaagaacuagaaaagcaagaguaaaccaaaccuaauguuaguagaaggaaaaauaaagaucagagcagacauaaaugaaauugaaaugaagaaaacaauacaaaagaucaaggaaagaaaaaguugguguuuugaaaacauaaaacugacaaacuuuuagccagacuaagaaaaaaagaagacccaaauaaagucagaaaugaaaaaggagauauugcaauagauacugcagaaauucaaaggaucacuagaggguacuaugagcaacuauaugccaguaauuuggaaaaccuagaagaaaggguuaaauuccuagacacauacagucuacuaagauagaaccaugagguaauauaaaacuugaacagacugacaacaaguaacaaguugaagcuguaauaaaaagucuuccagcaaagaaaagcccgggacccaauggcuucacuguugaacucuaccaaacacuuaaagaaaaacuaaaaccaauccuauugagacuauucugaaaaauagaggaggagggaauacuuccaaacucauucuaggagacgaguaauagccugauaccaacaccaguuaaagacacaucaaggaaaaagaaaaccacagaccaauaucucugauggacauuggugcaaaaauccuuaacaaaacacuaucaaaccgaauuaaggaacauauuaaaaagaucauguaucauugaacaaguggguuuuaucccagggaugaaaggaugcuucaguauacaugacucaauuaaugugguaugucguaucaacagaaugaaggacagaaaccauauggucauuucaauugaugcugagaaagcaucugauaaaauuuaacaucucuucaugauaaaaauccucaaaaaacuggauguagaaagaagaacauaccucaacauaauaaaagccauauguggcagacccacagcuaguaucauacugaagagggaaaacugaaagccuuuucucuaagaucuagaacacgaaguggaugcccacuuucaccacugucauuugaucuaguacuguuauuugaccuagacuuccaguacuaguacuggaagaccuagcuagagcaauaagaaaagagaaagaaauaaaggacauccaaaucagaaaggaaggugaaaggauucccacuuuaagcacugcuauuuaaccuaguacuggaaguccuagcuagagcaaucagacgaaagaaagaaagguggccaggugugguggcucacgccuguaaucccagcacuuugggaggccgaguuggguggaucacgaggucaggagauagagaccauccuggcuaacauggugaagccccgucucuacuaaaaauaacaaaaaauuagccgggcgugguggcgggugccuauagucccagcuacucaggaggaugaggcaggagaauggcgugaacccgggaggcacagcuugcagugagcugagauugcgccgcuacacuccagccugggcaacaaagcaagacucugucucaaaaaaaaaaaaaaaaaaaaaacacagacaaacaaagaacaucaaaaucggaaaggaagaagucaaauuauccuuguuugcaggugauguuauauuuggaaaaaccuaaagacuccaccaaaaaacuauuagaacugauaaauucaguaaaguugcagcauacuaaaucaacauacagaaaucaguagcauuucuauaugccaacagcgaauaaucugaaaaagaaaucaggaacauaaucccauuuacaauagcuacaaauaaaauaccuaggaauuaacuuuaccaaagaaaugaaagaucuuuacaaugaaaacuguaaaacauuggugaaagaaauugaagaggacacacacacaaaaaggaaagauauuccauguucauagauuggaagaaucaauauuguuaaaauguucauacuacccaaagcagucacagauucaaugcaaucccuaucaaaauaugacauucuucccagaaauggaaaaaacaauccuaaaauuuauaugaaaucauaaaaggccuagaauagccaaagcuauccugagaaaaaagaacaaaauaggaggaaucacauaaccugacuucaaauuauacuacagagccguaguaaccaaaacagcaugguacuggcauaaaaacagacacauagaccaaugaaacagaauagagaaccuagaaacaguucauacaucuacagugaacucauuuuugacaaaggugccaagaauaugcacuggggaaaggacagucucuucauuagauggugcuggggaagcugaauauccauacacagaagaucgaaacuagcucccugucucucaccacauacaaaagccauaucaaaaugaauuuacgacucaaaucuaagaccugaacuaugaaacuacuaaaaacaacauuggggaaacucccugggacaucagacugggcaaagauuucuugaguaaaaccccacaaacacaggcaaccaaagaaaagauggacggaugggaugacaucaaguuaaaaaagcucugcacaacagaggaaacaaucagaaaagugaagaguagccaggugcaguggcugacaccuuuaauccuaguacuuugggaggccggcagaucaccugaggucagaaguucgagaccagccuggccaacauggugaaaccccgucucuacuaaaaauacaaaaauuaccugggcauaguggcaggcaccuguaaucccaacuacucaggaggcugaggcaggagaaucgcuuggaccugggaggcagagguugcagugagcccagaucgcgccauuuuaguccagccugggcaauaagagcaaaacuccaucucaaaaaaaaaaaaagaaaagaaaagaaaagugaagaggcaacccacagaaugggagaagauauuugcaaacuaucuaucugacaagagauaaauaaucagacuauauaaggagcucaaacaaccauauaagaaaaaaaaucuuauaauucaguuagaaaauagacaaaaggucugaauagacauaugucaaaagaagacguacaaauggcaaagcagauauaugaaaaagugcucaauaucauuggucaucaaagaaccauaaaucaaaacuauaaugagauaugacuuuagccuguuuaaaauggauuguauccaaaagacaggcaauaacaaaugcuaacaaggauauggagaaaagcgaacccucauacaccauuggugggaaugugaauuaguucagccacuaugaagaacaguuuggaguuccucaagaaacuaaaaauagagcuaccauaugaucuagccauuccacugcuagguauguacuuaagagaaaggauaugaccuggcauucauaugcagaaaaauauauauauagaaaggaaaucaguauauuaaagagauauuugcacucucuuguuuauugcacuauucgcaguagccaggauuuggaagcaaccuaagugcucaucagcagaugauggauaaggaaaaugugguauauauacacauuggaguacuauuuagccuuaaaaaagaaugagauccugucauuuguaacaacauggauggaacuauggucauuauguuaggugaaauaagccagacacagaaagacaaacuucacguauccucacuuauuuguggugggaacuaaaaauuaaaauaguugaacucaugggaauagagaguagaauaaugguuaccagaggcugugaagcuuauuggggaaggguaagggggaaguggggaugguuaauugguacaaaaaauagaaagaaugaacaaggucugguauuugauagaacagcagagugacuaaauaauaguuuaauucuauguuuuuaaacaccugaaagaguauaauuggguuuuaacacaaaagauaaugcuugaggugauggaugccccauuuacccuggugugauuauuacacguuguaugccuguaucagaauaucuccuguaccucauaaauauauacaccuaccauguacccacaaaaauuagaagaagaaaauguaaguaaugcauuuccucaaaaaauuauagguaauuaguauuaauccacuguauguaauugacaucuauuaaccacuucauccaacaacagcagggacucauucuucucaagcugucacagaacacucaccaagauagaccauaaaacgggaauugaacaaugagaacacauggacacaggaaggggaacaucacacaccagggccuguuguguaguggggggaggggggagggauagcauuaggagauauaccuaaugcuaaaugacaaguuaaugggugcagcacaccaacauggcacauguauacauauguaacaaaccugcacguugugcacauauacccuaaaacuuaaaguauaauaauaauaaaauaaaaauaaauaaauaaaauaaaauaaaaugagacagcaaccacacacaaaaaaauacuuauaaaacagauuuuaaaaaauauuaaucacauaaugucuacucucagaccucaguggaauuaaacugaaaaucaauagagaaagauaggcucucuguuccuucugugugauaaaggacacagcagcagccaugcagcagcagccaugcagcagcagccaugucccugagacaguuggugaaauugaagguuguaguaaacacauuuggcuguacugggcaucuggucaacugggcugcuuuuaacucuggcaaaguggauauugucaucaucagugaccccuucacugacuccagcuacauggucuacauguuccaguaugauuccaccaguggcaagcuccacagcacugucaaggcugagaaucacaaguuugucaucaguggaaauccuaucuccaucuuccaggagcaagauaccaccaaaaucaaaugcagugaugcuggcacugguuguguuguggagucaacuggugucuucacuaucuuguauauggcuggggcacacuuagaggagagagccaaagagucaucaucucugcugccuuugacccccuguuugaugggcaugaaccaugagaaguacgaaagcaaccucacaaucaucagcauugccuccugcaccaccaacugcuuagcauucucugaccaagaucauccaugauagcucuggcaucauggagggacuccugaccacagucccugcuaucacugccacccaggagaccuauggauggcuuuucugggaaacugugacgucaugguuguggagcucugcagaacauuauuccugcaucuacuggaacuuccauggcugugggcaaggacaucccugagcugaauggggagaucacuggcauggccuuccucgucccuaccaccaaugugucaguuguggaccugaccugcugucuggaguaaccugccaaauaugauggcuucaagaagauggugaagcaggcaucggaaggcccuucgagggcacacugggcuacacugaacaccaaguuguccccugugacuuuaacggugacacucccucuuccacuuuuaauucuggggcuagcauugcccucagcaaccauuuugugaaguuaauuuccugguaugacaauuaguuuugcuacagcaacggggugguggaccucaugguccacauggccuccaaggaauaacagcccuccggacuaccagcccuagugagagcacgagagaaaaagagaggcucucagcugcugaggagucccugccucacuccgucccccaccacaccaagaagcuccccuccaccacaguuuucaugccauauccccugaagaaugggaggggucuagagagcccccaccuugucauguaccgucaauaaagucuucuguacucagccaaaaauaaaauaaaauaauagaaagauaacuggaaaaucccaaaauauguggagauuaaacaacuauuucugaauaaugcauggaucaaagaagaaaucucaggagaaauuuaaaaauauuuugaacuaaaugaaaaugaaaacacuacuuaucaaaauuuauaggaugcagugaaagucaugcuuagagggaaauguauagcagugaaugcauauguuagaaaaguagaaaggucuaaaaucagucauuuaaguuuccaccuuaggaaauugaaaaaaaaaaggcaaauuaaauccaaaguaagcaaaauaaaagacauaauaaaaaauuagaacagaagucaauaaaauuaaaaacaggaaaucauuagagaaaaucaaugaaaccaauagcugguucuuugacaguauuaauaaaaaugcauaagccucuagcaaggcuaagagaaaaagagagaggacacagauuacuucugucagaaaugaaagaggguuaucacuacagaucccauggacauuaaaaggaaaauaaaggaauacuaugaacaacucugugccuaccaauuugauaaccuagaugaacuagaccacuuccuugauagacacagucugccagcucuacaaaaagauaaucugaacagguuuauauguauuaaauaaauugaaucaauaauaaccuuccaaagcaggaagcaccagguacagauggguuugccggugaauucuaccaaauauuuaagaagaaacuauaccccuuaucuacagucucuuucagaagauagaagcagagggaauacuuccuaauucauucuaugaugccauuguuaugccaguaccaaaaccagagaaagacacuacuacagaccaaugucucucaugaucuuagaugagacaaaacuacagaccaauaucucucuugaucuuauaugcaaaaauucucaaugaaauauuagcaaguugaauucaacaauguauacaagaauuauaggccaggcacaguggcucaugccuguaauccuagcacuuugggaggccaaggugggcaaauugcuugagcucaggaguucaagaccagucugagcaacauggcaaaaacccaucucuauaaaaaaauacaaaaacuagccaggugugguggcacaccccuguggucccagcuacucaggagguugagaugggaggauugcuugagcccaggagauggaggcugcaguaagccaagaucacaucauugccuaggugacagcaagacccuguccccaccaccacccgccccccaaaaaaaagaaaaagaaaaaaguguaucacaagcaagugggauuuaucccagguaugcaaaucugguuuaauauuaaaaaaucaaguaacauaauucaucguauuagcaggcuaaaaaaaaaaucacaugauuauaucagugaauacagaaaaagcauuuggcaaaauccaaaacucauucaugauaaaaacacaguuaacuaggaauacagggaaacuuucucaacuugauacagaauaucuacaaaaaaaucuacaaguaacaacauaccuagugaugagaaacuagaaguuuuccuaacaucaugaacaaggcaaggaugugccuucucaccacuccuuuuuaauauuauacuggaagucuuagcuaguguaauaaggcaaaaagggaaacaaaagguaaacacauugggaaggaagaaauaaaacucucuuuguucacagaugucauuaucuuauauguagaagacccaagagaacugacaaaaacgcuccuggaacuaguaagugauuauagaaagguugcaggauauaagguuaauauacaaaaguuaaucacuuuuccauauaccagcagucaacaaauagaauuuggaauuaaaaauacaauaccauuuauaguaguacucucaaaauucaauuauuuagguauaaauuuaauaaaaugugugaaaggucuauauaaggaaaacuacagaacucuaaggaaugaaaucaaagaagaauuaaauaaauggagagcuauugaguuucauggauaggaagacucaguauugucaaaaugucaguuccucggaguaugauuuauagauugauaugauccaagucaaaaucccaggaaguuauuuuguggauauugacaaacugauuccaaaguuuauauagagaggcaugccaggcaccauggcucaagccuguaaucccagcacuuugggaggccaaggcaggcagaucaccugaggccaggaguuugagaccagccuggccaacauggcaaaacccugucucuacugaaaauacaaaaauuaguugggugugguggcgcacauccguaaucccagcuacucagaaggcuaaggcaugagagucacuugaacccaggaggcggagguugcagugagccaagagcacuucaugcacuccagccugggugacagagcgagacucugucucaaagaaacaaaacaaaauaaaguuuauauagagaagcaaaacauucagaauagccaacacaauauugaagucaaaaguuggacgacugaugcuacucgaccucgagacuuaauauuagagcuacaguaaucaagacaguaugguauuggucaacaaacagagaaauagaccaaugaaacagaacagagaguccagagauagacacacauaaauauagucaacuggucuuugacaaagaagcaaaggcaauacaaugggguagacaguauuuucaaaaaauggugcugacaacuagauuuuuaaaaaaugaaucuagacauagacguuauacccuccacaaaaauuaacucaaaauagaucauagaccuaaauagaaaaugcaaaaguauaaaacuagaagacaacaagagaaaaccuggauuaccuuggguauggcaaugacuuuuuggauacaacaccaaaguagcgauccaugaaagaaauaauugaugagcuggacuucauuaagauuuagaaacuucuggccgggcacgguggcucacgccuguaaugccagcacuuugggaggcugaggcaggcagaucacgaggucaggagaucgagaccauccuggcuaacauggugaaaccccaucgccacuaaaaauacaaaaaaauuagcugggcguggugccgggcgccucagcuacuagggaggcugaggcaggagaauggcgugaaccagggaggcggagguugcagugagcugagaucgcgccaaugcacuccagccugggugacagagcgagacucugucucaaaaaauaauaauaauaauaaagaaaaagauuuagaaacuucugugagugaaaaugucaagagaagacaagacugggagaaaaauuuuguaaaagacauaucugauaaaagaucuaugcaaaauauacaaagaacucuuaaaacuuaacaauuagaggccaggcgcaguggcucaugccuguaaucccagcacuuugggaggcugaggugggcggaucacgaguucaggagaucgagaccauccuggccaacacagugaaaccccgucucuacuaaaaauacaaaaaaauuagccaggcaugguggcaggcaccuguagucucagcuacuugggaggcugaggcaggagaauggguugaacccgggaggcagagcuugcagugagcugagauugcaccacugcacuccagccugggcaacagagcgagacuccgucucaaaaacaaacaaacaaacaaacaaacaagcaaaacacucugcaggauauuauccaggagaacuuccccaaucuggcaaggcaggccaacauucagauucaggaaauacagagaaugccacaaagauacuccucgagaagagcaacuccaagacacauaauugucagauucaccaaaguugaaaugaaggaaaaaauauuaagggcagccagagagaaaggucggguuacccacaaagggaagcccaucagacuaacagcggaucucucgggagaaacucgauaagccagaagagagugggggccaauauucaacauucuuaaagaaaagaauuuucaacccagaauuucauauccagccaaacuaagcuucauaagugaaggagaaauaaaauacuuuacagacaagcaaaugcugagagauuuugucaccaccaggccugcccuaaaagagcuccugaaggaagcacuaaacauggaaaggaacaaccacuaccagccgcugcaaaaucaugccaaaauguaaagaccaucaagacuaggaagaaacugcaucaacuaacgagcaaaauaaccagcuaacaucauaaugacagguucaaauucacacauaacaauauuaacuuuaaauguaaauggacuaaaugcuccaauuaaaagacacagacuggcaaauuggauaaagagucaagacccaucaguguguuguauucaggaaacccaucucacaugcagagacacacauaggcucaaaauagaagcauggagaaagaucuaccaagcaaauggaaaacaaaaaaaggcagggguugcaauccuagucucugauaaaacagacuuuaaaccaacaaagaucaaaagagacaaagaaggccauuacauaaugguaaagggaucgauucaacaagaagagcuaacuauccuaaauauauaugcacccaguacaggagcacccagauucauaaagcaaguccugagugaccuacaaagagacuuagacucccacacauuaauaaugggugacuuuaaugggugacugucaacauuagacagaucaacgagacagaaagucaacaaggauacccaggaauugaacucagcucugcaccaaguggaccuaauagacaucuacagaacucuccaccccaaaucaacagaauauacauuuuuuucagcaccacaccguaccuauuccaaaauugaccacauaguuggaaguaaagcucuccucagcaaauguaaaagaacagaaauuauaacaaacuaucucucagaccacagugcaaucaagcuagaacucaggauuaagaaacucacucaaaaccgcucaacuacauggaaacugaacaaccugcuccugaaugacuacuggguacauaaugaaaugaaggcagaaauaaagauguucuuugaaaccaacgagaacaaagacacaacauaccagaaucucugggacacauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaaaagagacacaaaaaacccuucaaaaaauuaaugaaucgagcugguuuuuugaaaagaucaacaagcuagaccgcuagcaagacuaauaaagaaaaaagagagaagaaucaaauagaugcaauaaaaaaugauaaaggggauaucaccaccgaucccacagaaauacaaacuaucaucagagaauacuacaaacaccucuaugcaaauaaacuagaaaaucuagaagaaauggauaaauuccucgacacauacacucucccaagacuaaaccaggaagaaguugaaucucugaauagaccaauaacaggagcugaaauuguggcaauaaucaauagcuuaccaacgaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccaggcagagacacaaccaaaaaagagaauuuuagaccaauauccuugcugaacaucgaugcaaaaauccucaaaauacuggcaaaccgaauccagcagcacaucaaaaagcuuauccgccaugaucaagugggcuucaucccugggaugcaaggcugguucaauauacgcaaaucaauaaauguaauccagcauauaaacagagccaaagacaaaaaccacgugauuaucucgauagaugcagaaaaggccuuugacaaaauucaacaacccuucaugcuaaaagcucucaauaaauuagguauugauggaacauaucucaaaauaauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaauuaggaaaagaggaagucaaauugucccuguuugcagacaacaugauuguauaucuagaaaaccccauugucucagcccaaaaucuccuuaagcugauaagcaacuucagcagucucaggauacaaaaucaauguacaaaaaucacaagcauucuuauacaccaauaacagacaaacagagagccaaaucaugagugaacucccauucacaauugcuucaaagagaauaaaauaccuaggaauccaacuuacaagggacgugaaggaccucuucaaggagaacuacaaaccacugcucaaugaaauaaaagaggauacaaagaaauggaagaacauuccaugcucauggguaggaagaaucgauaucaugaaaauggccauacugcccaagguaauuuauagauucaaugccauccccaucaaacuaccaaugacuuucuucacagaauuggaaaaaacuacuuuaaaguucauauggaaccaaaaaagagcccgcaucgccaagucaauccuaagccaaaagaacaaagcuagaggcaucaugcuaccugacuucaaacuauacugcaaggcuacaguaaccaaaacagcaugguacugauaccaaaacagagauagagaucaauggaacagaacagagcccucagaaauaacgccgcauaucuacagcuaucugaucuuugacaaaccugagaaaaacaagcaauggggaaaggauucccuauuuaauaaaugaugcugggaaaacuggcuagccauauguagaaagcugaagcuggaucccuuccuuacaccuuauacaaaaaucaauucaagauggauuaaagacuuaaacguuagaccuaaaaccauaaaaacccuagaagaaaaccuaggcauuaccauucaggacauaggcacgggcaaggacuucaugucuaaaacaccaaaagcaauggcaacaaaagccaaaauugacaaaugggaucuaguuaaacuaaagagcuucugcacagcaaaagaaacuaccaucagagugaacaggcaacccacaaaaugggaaaaaauuuuugcaaccugcucaucugacaaagggcuaauauccagaaucuacaaugaacucaaacaaauuuacaagaaaaaaacaaacaaccccaucaaaaagugggcgaaggacaugaacagacacuucucaaaagaagccauuuaugcagccaaaaaacacauggaaaaaugcucaccaucacuggccaucagagaaaugcaaaucaaaaccacaaugagauaucaucucacaccaguuagaauggcagucauuaagaagucaggaaacaacaggugcuggagaggauguggagaaauaggaacacuuuuacacuguuggugggacuguaaacuaguucaaccauuguggaagcaguguggcgauuccucagggaucuagaacuagaaauaccauuugacccagccaucccauuacuggguauauacccaaaggacuauaaaucaugcugcuauaaagacacaugcacacguauguuuauugcagcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaacuggaaauaaucauucucaguaaacuaucgcaagaacaaaaaaccaaacaccgcauauucucacucauaggugggaauugaacaaugagaacacauggacacaggaaggggaacaucacacucuggggacuguugugggguggggggagcggggagggauagcauugggagauauaccuaaugcuaguugacgaguuagugggugccgcgcaccagcaugucacauguauauguauguaacuaaccugcacauugugcacauguacccuaaaacuuaaaaguauaauaaaaauaaauaaauaaauaaaaacacacacuuaacacuuagaaaacaagcucgguaugguggcucacaucuguaaucucagcacuuugggaggcugaggcagguggauugcuugagccuaggaguuugagaccagccugggcaauaugacaaaaccccaucucuacccaaaauacaaaaaaauuggacagguguggccgggcgcgguggcucacgccuguaaucccagcacuuugggaggcugaggcaggagaauggcaugaacccgggaggcggagcuugcagugagccgagaucgcgccacugcacucuagccugggugacagcgcaagacuccaucucaaaaaaaaaacuggacaagugcgguggaccaugccuguguucccagcuacucggaaugcugaggugguaggauugcuugagcccagaaagcagagauugcagugagccaugauuacaccacugcacuccagccuggggaaaagagugagauccugucucaaaaaaaaaagaagagaaaagaaaacaacuugauuaaaaaauggacugaaaaccuaaacagacaccucaccaaagaaggcauaaaaauggcaaacauaugaaaagaugcuucauaucauguguuaucagggaaaucuacuacaguagauuuuggaccauucuaauaggccaaguuccagcacacugaaaacaccaaaugcuggcaaggacguggaacaaaagcaauuuuuauguguugcuggugagaaugcaaaauugucaacuacuugggaagguaguugggcaguuucuuacaaaauuaaacuuacuuugaccguaugauccugaaaucuuacuccuugguaucuaucaaaaagaguuaaaaacuuguauccacacaguagccugcacauaaauguuuauagaagcuuuauucguaauugccaaaacuugaaaacaaccaagauauucuucaguaggugaguggauaaacugugguaccuuuggacaauggaauauuauuuaccacugaaaggaaaugagauauuaagacaugaaaagacuuggagaaagcugggugugguaauucacaccugcagucccagcacauugggaggccaaaguugacagaucgcuugagcccaggaguucaagaucagccuuggcaacacagugaaaccccaucucuacagagaauacaaaaauuagcugggugugguggugugugacuguaaucucagcuacccaggacgcugaggugagauaaucaccugagccugggaaguugaggcugcagugagcugugacugcacuccagccuggacaauggaguaagaaccugugucaaaaacaaaaaagacuugaaaaaaauuaaaugcauauuacuaaaugaaaaaagccaaucugaaaaggcuacauacuguauaauuacaacuauagauauuccggaauaggaaaaacuguggagacacuaaaaugcaauuaaaaaauuaguaguugcaaggggaugggguagagagagagaggaugaauaggcagagcacagaggauuuuuagggcagugaaaugcucugauacuauaauggggagacaugucauuauacauuuguccaaacccauagaauguacaacaccaagaaugaacccuaauguaaacuagggaccuugggugauuacagugugccaguguaaguucaucaguuuuaacaaauguaccacuuugguaggggauguuaauaaucggggaggcuauccauggccauguaugggagcaggagauauuugggauauuuuucuaucuuccugucaguuuuguugugaacuuaaaacugcucuaagucuuggccgagcgcgguggcucacgccuguaaucccagcacuuugggaggccgagguggguggaucacgaggucaggagaucgcgaccacccuggcuaacacagugaaaccccaucucuaguaaaaauacaaaaaauuagcugggcgugguggcgggcgccuguagucccagcuacuugggagacugaggcaggagaauggcgugaacccaggaggcggagcuugcagugagcagagaucacgccgcugcacuccagccugggcaacagagcgagacuccgucucaaaaaaaaaaaaaaaaaacaaaacaaacaaaccacaaaacugcucuaagucuuaaaaaacaauuaaagagaggccaggcucauaccuguaaucccagcaguuugggaggcuaaggcaggaggaucgcuugaguccaggaguuugagaccagucuggacaacauaauaugagacagaaaaauaccacaauuagccaugcaugguggcauacgccuguagucccagcuacuugggaggcugaagugggaggaucacuugagcacaggggauugaggcugcagugaaccaugaugacgccauugcacuccaacuuggucaacagaacgcgacccugucucaaaaauaaaaauuaaaauuaaagagaaguaauuacagugaugugugagaggaggaaaaaagauaggaagauuaugucuuaaggccaggugcaguggcucacgccuguaauccgaacaguuugggaugccgaggugggaguauugcuugaggccaggaauucaagguuacaguucacuauaaucaugcuacccguacuccauucugggcaacagaacaagacccugucaaagaaaaaaacaaaaacguuauguuuuaaggaagcauugugguuaauaauuuauauuuuugguagagauuauuuuucuaaaagcacucucagaggaaaaaauuaagcuauaaaaauuuaaaaauccuaacaaauugccagucuugauauuaaaauuauaauuaaaaauuuuucuuagauaucuuauaaaacagacauuggcaaacuaccagguggccauuuguuuuaauaaauaaaauuuuacugaaacauagacauacucauuuguuuauauauugccuaugguugcuuuucugcuagaacagcagaauugaguaaggcccacagccugaaacacuuacugucuggcccuuuuuuuuuuuuuuuuucugucuggcccuuuaagaaaaaguuuuuagaucccuguuuuaaaggacacaaauuugaauccuuccuauagauuaaaauuucuacuuugauuaucauuucccuucagccugaagaacuuccuuuagcauuucuugaagugcaggucuucuagcagugaauuuuucaacuuuuaucugaaaguaucuuuauuuuauucucauuuuugaagguuauuuuugccagauauagaaaucugggcugauacguugagggcauucauuuagcauguuaaaagaugcaguuccggcggggcgcaguggcucaugccuguaaucccagcacuuugggaggcugagguggguggaucaugaggucaagagauccaagaccauccuggccaacauggugaaaccccaucucuacuaaaaauacaaaaauuaguugggccugguggcgugggccugcagucccagcuacucgugaggcuugggcaggagaauugcuugaacccaggagguggagguugcagugagccgagaccacgccacugcaugccagccuggcgacggagacucugucucaaaaaaaaaaaaaaaagaugcaguuccaacugucuucuggccuucauuguuucuaagucagccaucuuucuuuuguuguucucuuuuauuguguguuuuuucucuagaugcuuuuaagauuuucccuuuaucuuuaauuguuaucaauuugaccaagauaugccuuaguaugggguuuuauuuuguauuuauccugcuuaggguucucugagguucuuagauuuguggguugauguuuuucaccaaauuuggggaaauuucagcauuuauucagaucaaauaugcaaauuuuacaaugcuaucuuuuuuuaauccuucuaggacucaaguuucauacauuuuuaaaauuuauuuauuuauuuauuuaagauggagucucgcuuugucacccaggcuggagugcaguggcaugauaucggcucauugcaaccuucaccucccggguucagucgauccucccaccuaaaacucccaaguagcugggauuacaggcaugcaccaccacgcccagcuauuuuuuuuuuuuuuuuuuuuguacuuuuauuagagacgggguuucaccauguuggucaggcuggucuugaacuccuaaccucaagugagccaccaugcucggccgaguuacauacauuucagacugcuugauauuaucccaaacaucacugaaguuuuguuuagauuuuuguaauaccuuuucuccuucaguuuguuuaaugucuuugauuuaccuucaaguucauugaccccuuuuuuucuguaauguuuagucugcuguuaagcccagucagcauauauuucacuuuagaugucguacuuucaauuccagaauuuccauuugguucuuuuuuacuccccauucuuuaccagauguucccacauuuuccuuuaaauccuugaacauauauauacgcacacacauauauauacacauauacacacauauauauacauauacauauacauauauauauaaacaguuguuuauaaguucuugucugcuaauuuucacaaguggaucaccucuccguuuguuucuguugauuccuuuuuuucuugauugugggucauucucugcuuuuuuguaugucuaguaauuuuauuguauacuuuaugaguauuacauugaggaguuuggauuuuguugccuucuuuuaaagugugucuucuuuuaaaggguguugaauuuuguucuggcagacaaauuacuggaggagccugcguuaggguucccuagagguacagaacuaauaggagauauauacauauaauaggauauauuauauauauauauauauauauauauauauauauauauauauauauauauacccggcuaccacacccggccaccucuguuauuucuguucagcucucagcccuauaucauuuuagauauguguguguauauauauauauauguguguguguguguguguguguguguguuuguauguguguauauauauguauauauguacauauacauucuuagauuuguggauugauguuuuucaccaaaugauucuuccucaaaaaugccuccccugaccaaacuaucuaaaauagagccucccaccacucucuaucacaucucccuguuuuaauuuauacacagcacucugacauuuauauuauguucuauaacuuuuguuuauuuauuguuaucuccccaacaagaauguaagcuucguaggacaauaacuuggucuguuuuguucacugcugaaucuccagcuguuuaaaacaguucuuggcagggcacaguggcucacgccuguaaucccagcacuuuggaaggccaaggcgggcggaucgagagaucaggaguuugagaccagccuguauguauauauauacauauacagccuguauauguauauauauacacacauauauauaugcauacacacacacacacacacacacacacacacauauauauauaaaggggaguuuauuaaguauuaauaaagccuggaugacaaagcaagacuccaucuuaaauaaauaaauaaaauuuaaaauguguguaacuugaguccuagaaggauaaaaaaagauagaauuuuaaaauuugaauaauauaugaucugaauaaaggggaguuuauuaaguauuaacucauacgaucacaaggucccacauuagguugucugcgagcuugaggagcaaggagagccaguccaagucucaaaacuaaagaauuuggagucugauguuugagggcaggaagcauccagcacgagagaaagauguaggcuguuaagcuaggccagucucaccuuuucucguuuuucugccuguuuuauauucgcugguaguugauuagaauuugcccaucagauuaagggugggucugccuuccccagcccacugacucaaauguuaaucuccuuuggcaacacccucacagacauauccaggaucaauacuuaaaguaucuuucaguccagugaaguugacacucaauacuaaccaucacagagccuguugauucugucaggcuuguuuaugcuuugguuuuuugcuucauuagagcaaguuaguuuuuauuuuguuuuuagucucagagcauggccuuuaacucuagaguguggccuaaaaaugauaauaaucauaaguaauuagucuaguguggugaugugcuccuauagucccaacuacucagaagggugaggugggaggaucauuugagcucaggagauugagacugcagugagcuaugaucaugccacagcacuucagccugggcacuagaacaaaccccaacucuaagagcguggucccuacucuuaaacuauggccuuguagcaacucaucugaauaccgaagaugguuggugcuccaugaccucuguuauuuccuuuauuuuuuauuuuuaauagggaagacggggagaauuuuagccuuuuuuguguaugugugcaguggugugauuguagcucacugaagcaucuacuucuugggcucaagcucuccucccaccuuugccucugaguaucugggacuacaagugugugccagcaugcccaccuaauuuuuuuaauuuuuaguagacacgaagucucacuauguuuuacaggcuggucucaaauuccugagcucaagugaucucccaccuuggccucccaaagcacugggauugcagggaugagcuaccacacccaaccaccucuguuauuucuguucagcucucagcccuauaggaggagcugucuguuagaccccaugaagucucacccugugcauacacaaccuggggcuuggccaaagaccuaagaggaaauccccauauagauuucugcucuccguuucaucccccacagguuccuccucuguaauauccuuuccugcaaauucuagccaccucagcaggccaaacucugaugaucucugucuccucugcucacaaagacugccuauucauauauaucccuucuuuuaaggaccauggucuugugcugaugguuguacagugcuuacaaacagcugccucauguauuuuuccugccuuuauaauuguuuaggguagaggaaacccaauacugguuaguaugucauugcuagcaguggaaguucauguuguccuuuuuaaauuaaauaaauccaucucuaaguuuaaaggaaacucauuacucacagaccaugucucaggagccauaugagaacauaauuuuaaguaguacauguagacauuuaccuauauuucauggagggcugagauagucccacuaaccaguauuugagcaaauuucaaguguguuguaucuguucauauacacaaagcaaagaaagaauguuauaucguuguuuuguauuuaauguuuauguuucagaaugauuaauauuacuucaucucuuucuaggaguuuuuauggucaauugcugaucugaguuucaguaacuuuccaaaacauuacuauaaguaaauauucaucaggacucugaagugcaagucaacuauauaaucaggaggcucagaaaauugaucacagccggucaauaaauugauuaguuuuacauguaaauuguaaaacuaaucagauuuucucaaucuaaaucuuagauucucuuucauucuaaggauaaauacauuacuuugacaacucuaaauacuccaguauguauuaaucaccaacuauuugcuaggcuugucucauaauccagaggaaaauauucucacuuaguccccacauugaucaugcaggguaaauggcaucaucuuuauuuuauagaugaggguugaggcuuagaaaaauuaggaacuaauccaaagucaugcaguuaauaaauuacagagccaugauuugacucucuaaaagagaaaaucuggucuaacuccaaagcucauguauuuuauucuuuuauucucuuggcugugcaguagaaccaccuuuggagcuuucaguaaauauagaaacccaugccccauucccauguucaguacgucugugguagugucuguaauauuagaaugcagccagaguugaggaccacugcuuaucagugccauacuccuucucuauagccauaggcacuggaucaugaaguccuguuagucaggaaauuggaagucuagacaguuuugagauuauagcccugcuguuagaguaagaaaaugggaggaaaaggcaggaucaguucuuuuuuugccucucagaguaggggcugcaacugaagccuaaaagagaaguagaggacgauuaauccuaaaccaccugucaucuuuguaagcaucuuaccaguuucuuuagaaauguuuacucugaauuuuuaagucaagugagagguaugucuuaucucuacugucaugagcuuuuuguuuccucaccuuugaaaaagggauaucuaucuaauuuagagguaagggugacaugagacuagugccugguuauugccuccuuaggagcuaccagauacagucccagcccccaguuaccucugccaccuagccaccuauucuuaaaguuuuuacuauugugucucuaauauggccccuucuuuccugucucccucauuucuaacacuuuuuccucacuccuuagcuucuccucaaauaugcugcgcaugcuccugucucaaggccuuuguacuugcucgucuuuguuugaauguucuuccuccaaguuucauucauaccucugcucaaaugauuccuccucaaaaaugccuccccugaccaaacuaucuaaaauagagccucccaccacucucuaucacaucucccuguuuuaauuuauacacagaacucugacauuuauauuauguucuauaacuuuuguuuauuuauucuuaucuccccaacaagaauguaagcuucauaggacaauaacuuggucuauuuuguucacugcugaaucuccagcuguuuaaaacaguucugggcggccgggcacgguggcucacgccuguaaucccagcacuuugggaggccgaggcgggcgaaucacgaggucaggagauggagaccauccuggcuaacacggugaaaccccgucucuacuaaaaauacaaaaaauuagccgggcgcaguggcgggcgccuguagucccagcuacucgggaggcugaggcaggagaauggcgugaacccgggaggcggagcuugcagugagccgaguucgugccacugcacuccagccugggcgacagagcgagacuccgucucaaaaaaaaaacaguuuuggcagggcacaguggcucgcaccuguaaucccagcacuuuggaaggccgaggcaggcgaaucaagagaucaggaguuugagaccagccuagccaacauggugaaacccugucucuacuaaaaauacaaaaauuagccgggcgcgguggcgggcgccuguaauuccagcuucucaggagguuaaggcaagagaauugcuugaacccaggagguggagguugcagugagccgagaucgugccacugcacuccaaccuggcugacacagcaagacuccaucuugaaaaaacaaaacaaaacaaaaaaacagaucuuggcauauaguagauacuaaauauuauccaauuggcugggugcgauggcucacaccuauaaucccagcacuuugggaggcuaagaugggcgaaucacuugaggucaggaauucgagaccagccuggccaacauggugaaacccuguuucuacuaaaaaugcaaaaauuagcugggcaugguggugcacaccuguaaucccagcuacuugggaggcugaggcacaagaauugcuugaacccacggggcugagguugcagggagcugagaucacgucacuucauucuagccugggcaacagagcaagacucagucucaaaaauaaauaaauaaauauauaaauaaauauugucaaaugauuaaauuucuacacugauaacucugcuuuauaaauaauacaaaaaucagugauaggauaaaaacuauaugcucuaauggcuuugguggccuguauuuucucuuugugauaaauacauuuuauuauuuuaucuuugauacuuuuccuuaauaauggcuuuaucaaugauauauguuuuagcagcuguaguggucggaucuugcauugcuauaaagaauuaccugaggccaggcacgaugguucacgccuguaaucccagcacuuuccaaggucaaggugggaggaucacuugagcucaagaguucaagaccagccugggcaauauagugagaccccaucuuuguuuuuguuuuaaauguuuaaaagaaaaaaaaaauuaccagagacuggguaauuuauaaagaaagagguuuaaucagcucaugguucugcgggcuguacaggcaucugcuucugaggaggccucaggacacuugcaaucauggcauaaggcgaaggggaagcaagcacaucuucacauggccggagaaggaggaagaaagcaaaggggaaggugccauacacuuuuaaacaacuagauccugugagaacucuaucacgagacagcacuauggggauggugcuaaaccauuagaaaccaccuccaugauccagucaccucucaccaggccccaccuccgacacuggggauuacaauucagcaugagauuuggguggggauacagagcuaaaccauaucagcagccuagcuauuaaugguauuuucugauagcagcaugauauucccuguugacuuguauauuuuuccccuggcucucuggucuucaaugaagaggaccggguuaaaauauaaagagagcugcuuuauuuauuuauauuuauuuauuuauuuuugagacagagucucccuccauugcccaggcuagagugcaguggugcuaucucggcucacugcaaccuccuccaccuccuggguucaagcgauucuccugccucagccuccugaauagcugggauuacaggcacacaccauuauacccggcuaauuuuuguauuguuaguagagacgggguuucgccauguuggccaggcugguuucaaacuccugaccucgugauccgcccaccucagccucccaaagugcugagauuacacgcaugagccaccccaccugaccgagaguugcuuugauaucaaucauugucaugauauuguuugcagucuacucugcaucuaauuuuccccaaacuuucauuguuuuuaagcucacauuuguuacagguuuuuucuuaauuuguuugagaaguauucuuaauuuguuugacuuaguacuuucuuaucugaagauuuauaggcugggcacaguggcucaugccuauaaucccagcacuuugggaggccaggacaggaagauggcuggagccugggaguuccaagaccagucuggacaacauagugagaccuccucucuacaaaaaaaaauuuuuuaauuagccagguguaguguugcaugccuguagucccagcuagucaggagguugaggugggaggacugcuugagccccggaggucggggcuccagucagcugugaucacacuggugcacuccagccugaguaacacagcaagacuucucaaaaaaauuaaaaaaaugaaugcuuaucauaaaugguuuauaaugauaaauuaaaaaccauggaaaucuuauagggaggguucauuaaauuuguuauauccauaaaaguguaauauguagccacuaaaaaggaugaugcugagcuauauuuauuggcauacaaagauauauauguugggccggaugugguggcucacgccuguaaucccagcacuuugggaggccgaggugggcggaucaccugaggucaggaguucgagaccagucugacccacauggagaaaccccaucucuacuaaaaauacaaaauuagcugggcuuggcgcaugccuauaaucccagcuacuugggacggcugaggcaggagaaucgcuugaaccggggaggcggagguuguggugagccgagaucgcgccauugcacuccagccugggcaacaagagcaaaacuccgucucaaaaaacaaaacaaaacaaaacaaaaaacaaagauaccuauguuguuucuuguuuuuaagacaguguuucccucugucacccaggcuggagugcagugguggcucacugcagcccuagccuccugggcucaagugauccucccaucucagccuccugaguagcuggauuacagaugugugccaccccacccagcuaauuguauuuacuuuuaguagagacagagucuugcuagguaccccugggcucaaaugaucuuccugccuuggccuccuaaaauauugggauuacagacaugagacacugugcucaaucuguaucugugauuuuuuaaauuaaaaagaaaacagguuacaagaaaacaaguauaacauaaucucauuuuuguggaggaaaaaaauagauacuuguauauguauacacaaguaucuccuauacaaaauuggaggguaagguuagcacucuuaauugucuccaagucagcuagcauuuuucuagaucaucguuuguuucaguacgacuaacuauaauaauuaccucuuuuuuuaauuuuuaauuuuuuagguauauaguagguguggggcuuauaacuauuacuucuggccucugggaagcccucuaacuauucuauccuagguauaaauaaauaccuuucuccuuaguucaacaaaaccaaggcugggguuuucuaaaaggaauuuuucaagaaaacaaaaaaaggaaaguaaacaaaaggcaaaauaaaagcauagaaaucaaaguguuuacaggauacacacugcuuuuucuuaugucaguaaaagucuauccaccaacuaguuaaguuguuacaguuuauggggcucuaaaguuuuugggagcugggcaugauggcucacgucuauaaucccagcaguuugggaggccaaggugggacaauugcuugaggccaggaguuugagaccagcccggaccacauaguaagaccucgucucuacaaaaaauaaaauauuagccaaguguaguagugcaagccuguggucccagcuacuugggaggcugagcugggaggaucacuugagcccaggaaguugaaguugcagugagugaugauuuugccauugccuuccagcuugggcaacagaacaaaacccugucucagaaaauaaaaaauaaaaauaauccuugugacucugcaacccaggcuggagugcagugccgcggccuuggcucauugcaaccuccaccucccagguucuagcaauucuggugccucaggcccccaaguagcugggguuacaggcgugugccaccacgccaggcugaauuuuuuguauuuuuuaguagagaugggguuuugcuguuuuggccaggcuggucucaaacuucuggccacaagugacucacaugccucggucuuucaaagugcuggaauuacaggcgugagccaccuuuccuggccccuuguggcaauuuuuuacccagaucucucuagccaaaacuauaaaauugagaguuuugauucagcacuaucauuugguaauaauguagagaaaaauggaaugacguggaaaauauguguaaaauacaaauaaaaaagauuauaagauaguauauaugauauaacccuaauuuuaagguauacaguauaauguacagaaauaaaaaaaaacccaccagagagauacucuucagaugauaacagugguuaucuuuaaguuguaguacuacaguuaaaguuuaauuucuuugugcuuuucuauuuuuccaaguuuucuauaggaacauguuauuaagaaguauauauauauauuuuuuaaauuauuuauuuauuuauuuauuuauuuauuuuuuugagacggagucuugcucugucacccaggcuggagugcaguggugugaccucggcucacugcaagcucugcgucccggguucacgccauucuccugccucagccucccaaguagcugggacuacaggugcccgccaccacgcccggcuaauuuuuauuuuuuuguauuuuuaauagagacgggguuucacgauguuagccagguugguuucgauuuccugaccucgugagccgcccgccucggcugcccaaagugcuggaauuauaggcgugagccaccgcgccaggacuuuuuuuuuuuuuuuuuuugagauagaguuuucacucuuaucgcccaggccgcagugcaguggccugaucucagcucacugcaaccuccaccucccagguucaagagauucuucugucucagccuccuaaguagcugggauuacagacacgcaccaccaugcccggcuaauuuuuuguauuuuuaguagagaugggguuucaccuuguuggccaagcugggcgacagagcaagacucugucucaaaauaaguaaauaaaagaaaagaaaagaaaauuugagcaacuaaaaauaacauauucuuaauaccuuaccuaacuugugucaauuuuuauuugugcuaugcauauaaaaaggucucacuguugaagaucacuguaucugaagagauucauuuuauuuauuuauuuauuugagaugaagucucugucacccagguugcagugcaauggcgcgaucucagcucacugcaacuuccgccucccagauucaagugauucuccuaucucagccuccuaaguagcugggauuauagacacgcaccaccacgcccggcuaauuuuuuguauuuuuaguagagaugggguuucaccuuguuggccaagcugaucuugaacuccugaccuugugaucugcccaccucaacuucccaaagugcugggauuacaggcgugagccacugcgcccaguccauuuuauuaauucaucaaaucuuuguugaacuucucuuacaugcuaggcauguucuagauguuggggauauaguggugacgaagacaguuuguacugucauggagcuuauauucugggcagauuuauuggucaaaaaaaucugugauggggccgggcgcggcggcucacaccuauaaucccagcacuuugggaggcugagggaagcagaucaccugagauccaggguucgagaccagccuggccaacauggcgaaaccccaucucuacugaaaauaaaaaacuuacccgggcgugguggcgagcgccuauaauccuagcuauuacggaggcugaggcagggagaaucgcuggaacgcgggaggcagagguugcagugaguugagaucaugccauugcacuccagccugggagacagggcaagacucuguccccccaccaaaaaaaaaaauucugugaugaaugguacaguguaucaauuaguaacuguaaauaaauuagcauaccaacuauaaggauuacaaaauuagaauaaacaucauagaauuagugcaauguaaauugauucacggugguuuuuuuuuuuuuuuuuuuuagaaaucauaguaucaaugggaauaauauggauuuauuuuuuuucuucuagcuuuaaggaagccuccuauuucaguuucucaacaugaaagucaucaagcaaucucccaucuuccaacuggacaaccucucuccccaaauaugccuccagguaugaaggcuuaugcuuauaauuccauuugaaaccaacuuacuagucauguacaguuauauaguguauaaaauauaucacuuagcaguauagugaaauagcauuuauucuuugagguaauguuauuuuuuuuuagacuaguaaaagcagagagaaauaauaaucugaaacuccacuuuaucugguggauuguuagucuuuuucuuaagaacagaagaauuauuuauuaugccacucugagcuacauucccuuuccucucugccugcuauacagguuuagcuucuucaaaauguguucaaauuuaucucauagaggccuucuauaaauuacagugcccaccuauauuaaaaucuucguacuuaugaauguauuuguuuauuuucuaaacacucauuccauuuuauagaacauuucccugaaaugagaguagauaugauugaagagaccugcuuaagggagaugauggaaaggaaaaaggucagaguggaauaggauguuuugggauccaaaauuaaagucauugaugaggauaaaaagggagguggggaaagagaggugguauccaguagauaaugcuaagaaagaaucaagagucaacacuugugagucacuguauagugaagaugacuuagagaguagaaauuucaaaagccuuacuggauuuuggagauuucugauagugauauggaauuuggagggaggaaaagauaugaguaucauugcuauauuaaucuauggauuucuacuguauaucuuuuuggugaauaaguuuauggccauuaguggagauacucaccugggaaugaucaguaaacuucccacagcuaaaaucacauugguuauaauacuugauuaaagaaaugagaauaaaccuuuaaaaaaaaaaaaaaaagcuuuguggcuacccaauguuaaacaauagugugucuuagcuuucuaaagcagaucuugugaaauucaucuuuaaaagauuaaauuaaauuauauucuuuuaauuugauguuuuuaugccacagauucacacauaaaccacaauggaaaccccgguacuucaaaacagaauccuuccaguccucuucagcguuuaauuccaggcucaaacuuggacagugaacccagaauucaaacagauauacuaaagcaggcuaccaaggacagagucagugauuuccauaaauugaagcaaaguaagaaucaauugaugaauauuaugcuaaaaauauuucuuuaaauguaauaugaauuaaggucuucauuauucugcucucuaauaaauguauagugaaguuauauauauuuaaagagaagguaugaaagugucaaaauuuaaaggaaauacagguuuuaaauggauagauacgauuuuaaagaaaacuuuaaaaagguucucauguucuccauuguuaaauaauaaauuucaggugaguugacuuuuuuuaaaaauacaauuaguucuuaugaauauaaacuuuuuuggagaaaugagaaaaauauauuuugauaggcuuacaaaugaaaacuuugauuagggaggagagaaaauaaauaguuuugaaaaauggaacauucugggagaaacauacacucugggggauugccuuaguagauugcucaauacugcuuccuccuccauucccugcaauugcauuuuccucauuuagauguuagaaguauaagaaaaaauucuaguaguagaauuugaggcaggagagugucccuuagaucagcuuccuuaaacugugcuuuucacugguucugcuuuucauggcaucuucuuaccuucaauucugaauagacagaaucucuaaaagcuucaguuugucuuugguuuauuuauuuauuuuuaauuuuuaucagucaccaggaguaagaucaagucuuugguuuuuaugauggcuucugucuauggcagcaacugugcagagcacugguuaggcaguuauuuguacaaagauugcguguaagcuaauaauugaacaauguuauauuugugaauuuauucaagguauuuuauuuuauuucuuuauuuuuauuuauuuauuuuuagagacgggggucucgcuuuguugcccaggcuggucuugaacuccugggcugaagugauccucccgccuuagccucacaaagugcugggauuacaggcgugauucacugugcccagccuauucaagguauuuuuguugaucuuguaacaguuauucaaauuuauucauauaugugaauguauaguuugcauuaauuuaauuggcuuuccuuucuuuuuucuuuuuuucuguuuucuucaaauaggaaauuccuugauauuuuaaagcauaucuguguaucuugaccaaaguauugugugaaaaacauuuuuauuacaaagauuuagcuaacauuuuaaauauaaugaaaaaauauuuccucaaaauuggguugggggauuggccugaaaacuuacaucucaacaagaagagguguacaguaagagcauaacaaauaaaauaucuuaauuugaucacuuaagauuuucuucuuuuuuuuuuaaauuuuuuuugagauggagucucacucugucacccaggccaggagugcaguggcaggcaggagugcaguggugcaaucucagcucacugcaaccuccgccucccagguucaagcgauucuucugccucaucuuccugagcagcugggauuacagguccacaucaccaugccuggcuaauuuuuguauuuuuaguagagauaggguuucaccguguuggccaggcuagucucgaucuucugaccucaggugauccgcccgccucggccucccaaagugcugggauuacagucaugaacuacugcucccggccaagauuuucuucuaaacuuauauuuauucuauacauuuuuuuaauuguugccuuaccuguauauauuuuuuuaacugauauuuggguaaagaaggugguuggaaauaauugcucggaaauuauuacucucuacaauaauuuugaaaagagccuaggcauggugguacacaacuguagucccagcuacuugagaggcugaggcaggagaaucacuugaacccgggaggcgaaguuugcagugagccaagauugugccacugcacuccagccugggcaacagagcgagacucugucaaaaaaaaaaaaaaaaaagaaaagagccuauugaguuuuaaacccucacuccauauuauuuuccauuuaucauuaauguauauggagaguugaaaucaaugcaugcacaauuuugugauuuacuuugacauuauuucuuacauuccuuuuuacuuaauuuaaauuuuuauuaauauauacacauauauucuguauauauuauauacauauacagaauauauguauacauauacauauauucuauugugcuuaggcaauaauaacaguuuacuuaggucuccucucauuguuuagaucauuucguauuuucucauuguagcugucaugauuguuacuaucauuuuuuuucuccaguuauuuccuguucuuccuacuuugcguguuccuuuaaaaguauaguccucagaacgaaauuacugggucaaagcacuugacuagcuuuauagcacuuguuaaauagugucagauuguucucuagaacaguuuuaaagugucacuggaguuauuuaaguuuagggguuucucuguggccuggccacauugauuuuuaucguuuuuauaagguauuuagaauauaacguuuccuuaaaaauguuuuaauaaucauuuauucugguggccuauauuuaugugaguaauuuuauuauaauuauuucuugguauauaaucugugcaucaguuuugaccacuuagccugaaaacuuuguagauuuguucuauuuauuuguaucaacucuuuucuuuuucuuuuuuucuuuuuuuuuuuuuuuuuugagacaacgucucacucuaucacccaggcuuggagugcaguggugcaguuguggcucacugcagccuugacuuccuggguucaaaugauccucccuucucaccuuccucaguagcugagaccacaggcaugugccaucacaccuggcuaauuuuuaaaauuuuuaaacaaaaaugaggucucguucuguuguccagacugguauugaacuccugugcucaugugauccucccaucucagccucccaaaaugcugggauuacaagcgugagccaccauugcccagccccguaucaaaucuuuauagauaauucagauuuaucacaguuuuccucuuauauugucguuccugauauaagacuuucuuaugcuuuaucaugcaaaaguuuuuuuaauuaaaaauaauuuuuuguuuugguaaguuacacguaaaauucaccaaaauguacaauucaguggcauuuagugcauucacaaaguuguacaaacuaucaccacucuaguuccagaauauuuucaucacccugaaacaaaacucuguacucuccuacccucagcaccuggcaaccgcuaauuugcuuuuuucucucugucuauggagucaccaauucuggauauuucauauaaaaggaaucauacggccaggcgcgguggcucaugccuguaaucucaguacuuuggaaggcugagguggguggaucacaaggucaggagaucgagaccauccuggccaacauggugaaaucccaucucuacuaaaaguacaaaaauuaggccgggcacggugacucaagccuguaaucccagcacuuugggaggcugaggcgggcagaucacgaggucaggaguuugagaccauccuggcuaacauacugaaacccugucucuacuaaaaauacaaaaaaauuagccgggcgugguggcgggcgccuguagucccagcuacuugggaggcugaggcaggagaauggugugaacccaggaggcagagcuugcagugagccaagaucgcgccacugcacuccagccugggcgacagagcgagacuccaucucaaaaaaaaaaaaauuagcugggcgugguggcgcaugccuguaauccaagcuacuugggagggugaggcaggagaaucacuugaaccagggaguuggagguugcagugagcugaggucacgccacugcacuccagccuggcaacagagcgagacugcaucuuaaaaaaaaaaaaaaaaaucauacaguaugugaccuuuugugucuggcuucuuuuauuuagcauaauuuuucugaaguucgaccaugcuguagcauguagcaucuaucaguauuuuauuucuuuuuauggcuggauaauauucaguuguauggauacauuuuguuuauucaucuguugauguauauauggguuguuucuauauuuuggcuaucgaauagugcuucuaugaacauuuauguacaaguuuuuuugaacaucuguuuuuaauucuuuggguauguaccuagaugugaaacugcugagucauaugauaguucuauguuuagcuuuuugaggaacugccaaaccauuuuccacaauagcuguaccauuuuacauucccaccagcaacguauaagaguuccaauuucuccacauccccucccucccucccuuccucccucccucccucccuuccucccuuccuuccuuccccccgccacuuucauucauuccuucuaccauguaguacauaugaagugauguuuccuugugguuuuuauuugcauuucacuaaugacauugagcaccuuuucuguguacuuucuggccauuuguauaucaucuuuggagaauuguucuuucaagaccuuuguccuuuuuuaaaauuuacuuuuagagacagaaucuagcuuugucacccaggccagagugcaguggcacagucauagcucacugcagccucaaacuccuaggcucaaguaauccuccugccucagccucaguaguagcuauggcuacaggcauacccuaccaugucuggcuaguguauguauuuauuuuuuagcuuuuguggagauggggucuugcugucuugcccuggcuggucuccaacuccuggccucaaacaauccucccaucuuggccucccaaaagcacugggauuauagguaugagccacugggccuggcccuuugcccauuuuuauguuggguuauuugucuugguuguugaguuuuaagagguuuuugaaaagguauucugguuacuagacccuaaucagguguaugauuugcaaauauuuuugcacagucuauggguugucuuuucauucuugauaguguccuuucaugcacgaaaguuuuuaauuuugaugagguccaauuuaucuauuuuuuguuuuuguucauacuuugaguaucauaucuaagaaaccagugccaaaaucaugguaaugaagauuucccccuguguuuucuucuaagacuuucauagguuuagcuguuauauuuaggucuuucauccauuuaaaguuaguuuuuguauaugguuugagguaaggucuaacauaauccuuuuguguguggauaccaguugucccagcaacauuuauugaaaagacucuucauuucccauugaacaaucuugguauccuugucaaaaaucuauugaccacagauauauggguuuauuucugaauuauaaguucuguuacauuuaucuauaugucucuccuuaugccaguaucauacuguuuucauugcuauaacuuuguaguaaguuuugaaauugugaauuaugaguccuucaacuuuguucaucuuuaagauuauuuuagcucuucaugaucccuuguaauuuuauuguaggaucugcuuuuccauuucuacuaaaaaggcagcgauauuuuaaaaggaauuguggcuaggcacaguagcucacaccuauaauuccagcauuuuguggggccaaggcaggaggaucacaugaggccaggaguucaagaccagccugggcaacguagcaagacccuaucucuaaaaaaaauuuaaaaauuagccaggcaugguggcacaagccuguagccucugcuacuguggaugcugaggugggaggauugcuugagcccaggaguucaagguuauggugagcuaugauuguuccacugcacuccagcuugggugacaaagugagcccugucucugaaaaaauaaaauuaaaaaauuggccgagugcgguggcucaugccuguaaucccagcacuuugggaggccgaggcaggcagaucacuggagcccaggaguuugauaccagccugggcaacauggcaaaacccugucucuacaaaaaauacaaaaacuacccacauaugguggcaugcaccuguaguccccguuacuugggaagcugaggugggaggaucacuugagcccaggaggcagaggcugcagggagcugagauucugagauugugccauugcauuccagauugggcagcagagcaagaccuugucuggaaaaaaaaaaaaaaaaaaaaaggaauugcacugaaucuguagaucacuuuggagagcacugccaucuuaacaauaugaggucuuucaauccauaaauaugggaugucuuuccauuuauuuaggucaucuuuaauuccuuucagcaauguuuuguagcuuuuagugcacaagucuugugcugccuugguuaaauuuauuccuaagcauuuuauuguuuugaugucauuguaaaucgaacuguuuucuuaauuuuccuuuuagacuucuugcuagugcauauaaauaugacugauuuuuggccuggccugauggcucaugccuguaaucccagcauuuucggagaccgagguggguggaucaucugaggucaggaguucgacaccagccuggccaacauggugaaaccccaucucuacuaaaauacaaaaauuagccgggugcaguggcaaaugccuguaaucccagcuacuugggaggcugagacaugaaaaucgcuugcaccaggagguggagguugcagugagccaagaucgcgauacuguacuccagccugggugacagaaugagacacucucucaaggaaaaaaaaaaaaagaaauaagacugauuuuuguguguguugaucuuguaucaugcagcuuuauacaacuugacacaaaaggucuuuauuuguauauauucaagcauauugaucuagacucuuaugaugauuuucauuucucuuauagaagaucauuucuuuuauaaaaaucauuucuuuuauucuaucuggacauaaauauacuguucuuuuuuuuguuuuugagacggagucuugcucuguuggccaggcuggagugcaguggcgcaaucucagcugacuagaaccucugccuccuggguucaagugauucucccaccuggccaauaugguaaaaccccaucucuacuaaaaauacaaaaauuagcugggcuuguuggugcaugccuguaauuccagcuacucgggaggcugaggcacaauaaucuugaaccugggaggcggagguugcaguaagccaagauugcgccacuguacuccagccugggcaacagagcaagacccugucucaaaaaaaaaaaaaaaaaaaucguuaguauucuuguguuuauucagcuuugcuuuccauagaguaaaaacuauuuaguuauaagaaaaauuuauuuuauuuuaguuauuuaagagacagguggccuggcacaguggcccaugccuguaauccuaacacugggaggccgaggcagauggaucacuugagcccaggaguucaagaccagccuaggcaacauggugaaaccccgucucuacaaaagauacaaaaauuagcugggcauggaggcgugcuccuguagccccaccuccuuggguggcugaguuagcaggauucuuuaagcccaggaguuagaggcugcaguaagccaugaucgugccacugcacuccagccugggcaacaaagcaagaccuugucucaaaagaaaaaaagagagagggagagagacagggucuugcugugcugccgggcuggauucaaacuccugggcucaaaucauccuccugccuuagccucuugaguagcugggauuuauaggcaugcaucacugagcccaaugaaaauucauuuuuuuuuuuuuagacggagucucggucugucgcccgugcuggagugcaguggcgugaucuuggcucacugcaagcuccgccucccggguucacgccauucuccugccucagccucccaaguagcugggacuacagacgccugccaccacgcccggcuaauuuuuuguauuuuuuuaguagagacgggguuucacuauguuagccaggauagucuugaucuccugaccucgugaucugccugccucggccucccaaaaugcugagauuacaggcgugagccaccacguccagcuugaaaauucauuuuuaaguacaguuuugcuuuauaguuuucuucuuuuuugacuuacaauuuuuuucuuucauuuaacacuugucaaaucauuauuuguaucuaaaucauuauucucaaaaauuucauuguggccgggcacaguggcacacgccuguaaucccagcacuuuuggaggcugaggcagguggaucacuugaggccaggaguucgagagcagccuggccaacauggcagaacccugucucuacugaaaauacaaaauuacccagguguggugguacacgccugcagucucagcuacucaggaggcugagugggaggauugcuucaaucugggaagcagagguugcagugagccaugaucacgccacugcacuccagcuuagacaacagagugagacccugucucaaauaaauaaauaaguaaauaaaaaauaaaagcacuugauacucuguagguacaaaauaacaugcuguuagaaaaaaguugaaaauuuuauugaaaacacuauuagaaaaggaggggaaguccuuagacuuuauauaguuaucaccacaauuuuuguuuuguuuuguuuuuugagacagggucucacucucucacccagguuguacugcauuagcacguucauagcucacuacaaccuugaccuccuugggcucaagggaucauccuaccucagccuccugaauagcugggacuacaggugugugccaccaugccuggcuaauuuuuguauuuuugcagagacaguuucaccauguugcucaggcugguuucaaacuccugagcucaagcaguccucccaccucagugucccaaagugcugggacuacaggcaugagccaccauuccugaccucacuacaaauuuuuuggcagcuuuaacuuuaguauuuuuguuuuauagcuuaauauaucauacuuauauugauauauuuauaaagagcugcauauuuuuguaaauuuaauuuuguauuaccacaucaugcaaaaguggcuagaacauuuugggguauauuucaccauauuuggaagauguauuuggguuaguuuaauuuaaacuuuagaauguaggcuauguggugacacaaaauauaguuuagggauacuucaaagaaacagacaucuuccaaaauaguugaaacugaaaauccaggcgaggccuacauguuugccagcuaggagggacauaccauuuguauuuagaugcuuugaauagagauaagaauuuacuucaaaugucagcucccauauggaaagucaugagggugguuacuccaaacaguagggagugauuguugaucaaauugcuucucauauuggcuuuucuguauagcagcaggguuucauuuauuuaacagugguuauuaaucauucucccaaggaacacuggagaggcaagcuaguguaucacagaauaccugaucuuccuuuacauauagaauuuuuuuuuuuuuuuuugagauggaguuucacucuuguugcccaggcuggagugcaauggcacgaucucggcucacccaccgcaaccuccaccucccagguucaagugauucuccugccucagccucccaaguaacugggauuacaggcaugcaccaccacgcccggcuaauguuauauuuuuaguagagacgggguuucuccauguuggucgggcuggucucguacuccuaaccucaggugauccgcccgccucagccucccaaagugcugggauuacaggcaugagccaccaugcucagcccccuuuucuaaggucccucaucccauuuauaagaguggagcccuaauggccuaaucaccucccaaaggccccaucucuuaauaucaccacaguagggauuaagcugcaacaugaauuuuggagaggacacauucaaacuguggcaauuauuaguuaccuaaauuggcucaugaagauuugaaaacuugaauaaaccaauaaucauuaaauaaguugaauagguaucaaaaguuccccccuucccucaaaagagacugguaaaaguuaaugagaguuuagcuugauuacuaauucagggucacuguaugaaaucaagcaaaccaaaaacugguucuuugaaaaggcaagugaaauuggaaagaccagccaggugugguggcucacaccuguaaucccagcacuuugggaggcugaggcgggcagaucacgaggucgggagaucgagaccauccuggcuaacacggugaagccccgucucuacuaaaaaaaauacaaaaaauuagccggucgugguggcgggcgccuguagucccagcuacuugggaggcugaggcaggagaauggcgugaacccgggagguggagguugcagugagccaagauugcgccacuguacuccagccugggcgacaaagugagacuccaucucaaaaaaaaaaaaagaaauuggaaagaucgucagcacacauuaagacaggaagagaugacacaaauucucaauaacaaaaaugaaaaaaaaagaacaucaauauagauccuacaaauaauauuaaaggacacaugauaagagguauuauuaauuuaaugccaaaacauuugcaaaguuagaugaaauggccaauguccuagaaaaacacuucuauacaaaacugacagaaaaagauagggaaaaucugaauaguuccaugucuauuaacauauugaaucuguaaguuaauauuuugguaccuaaaugguuucauugaugaauucuuuauuuuuuauuuauuuauuuauuuuugagauggaguuuugcucuuguugcccaggcuggagugcaauggcacaaucucagcucaccgcaaccucugccucccagguucaagcuauucuccugccucagccucccgaguagcugggauuacaggcacgugccaccaugcccugcuaauuuuguauuuuuaguagagacaggguuucuccauguuggucaggcuggucuugaacucccaaccucaggugaugcuccuggcuuggccucccaaagugcugggauuacaggugugagccaccgcacccagcuggugaauucuuucaaacaugaaagaauacaaccaauguaacauaaacuuucagagaauugaaaaggaaaaaaacacuccccaacccauuuuaugagaccagcauaaguuggacagcaaaacuaagaauauuaugagaaagaaaaauuauagcaguuucucuuauuaauauagauauaaaaauccuaaacaaggccaggcacguagcucacgccuguaaaucccagcacuuugggaggccaaggcagguggaucaccugaggucaggaguuugagaccagccuggucaacauggugaaacccugucucuacuaaaaauacaaaaauuagcugggugcgguggugcgcacauauaguaccagcuacuuaggaggcugaggcuggagaaucgcuugaacccgggaggcggagguugcagugagccaagauugugccacugcacuccagccuggugacaaagcgagacucggucucaaaaaaaaaaaaaaaaauucugaacaaaacauuagcaagucaaauccagagauagauaaaaauuauauacaugaugaccauguuggauuuaaucugaaaauucaagauuguuuaauauuugaaaagcgaucuauguaauuuaccacauuaacaaaauauaugaggaaaaucaucucaaaagauguaaagugagcauuugaggaaauucaugcauuuaugauaaaacaaccaauuuuaagcaaaguaggguuagaaaguaauuuccuuaacucgauagaguauuuuaagcauccuaugacaaauaucaaauuuaaugauuaauucucaaaaaccuucccuugagaucuagaaaaggauacccaccaucaucacuucuauuccgcuuuucacuguagauucuaaucaaugaaauaaagcacagaaaaggaaauaaagaguauagagauuggaaaggaagaaauauaacugauaagcugauauuauuuguagacaauaugauuuuauauguagaaaacucaaaacaauuuauaaacaaauguauuuagcaaaguuauuacaugcaagauuuauauacaaauuauauuucuguauauagcagcaguaaacauagugaaacuuuuaaaaagaaacuuuuuaauagcauaaaaagacaucagauaccuugaaaaguucuuacaaagauuuacaagaaccucuauaagcuacaaaauauuguucacagaaauuaauuaauauauaaauaaauccauauccauggauuggaaugcucaauguuguaauuaugucaauuccucccauauuaaucuagaacuucauugccaucccaauuauaaucccagcagaguuuggggguuuuggguggaaucugauaagcugacucuaaaauguguauggaaacugcaaaggaauaagaauagccaagacaauuuauaaaaggaauaaaguguaaagacuuccacuaucagauaugaagauuuauuauaaugcucuuuuuuuguuuguuuguuuguuuguuuugagacacagucucgcuguauugccuaagcuggaaugcaguggcgugaucucagcucacugcagccucugccucccacauucaagcguuugucgcccaggcuggagugcaguggcgcaaucuuggcucacugcaaucuccaccucacagguucaaaugauucuccucccucagccuccugaguagcugagauuacaggugcaugccacaacacccagcuaguuuuuguauuuuuaguuagagaugagguuucacuauguuggccaggcuggucucaaacuccugaccucaagugauccacccgccucagccucccaaagugcuaggauuacaggcaugagccaccgugcccgaccuacugugcuauuuuauacaagggacuuuaacaucuguggauuuugguaucugcugggguccuggaacaaguucucaguggauacugagggaggaacaacucuauucaccauaaaucacuuuguaggauaaauugaccucaucagacugguacauaauggcucaggccucaggcauacaaaaacauuuauaaagcagaauauuucaugggcucagagguuaucucucagaauccagccaagggccaguccugaaaacaaagcuuucuuuggaauguacaggguuugagcaaccacggaauacauugcaucacaacaggggauacauucugagaaaggugguuuuuaguugauuucaucauugcgaacaucauagaguguaucuacacaaaucuagauaguauagguuugccuuggaaacggggagaugguaagguuguucagaugcuguuugccauaaauucuagcuaccaugcuucuuucauuuccuuuauuucucuuuaccuuccacaaguccaguccaucagugaauagauugcuuccugugccuacuauaugcagggccuauaucccuugagauagaaauguggucuuuuugcccuaauauguuccugauaaugaaaucaauucaaaagccagucaauaguuuuccuacaauuguuuugugaagaaagccugcaguaacauuuuuguuacaguuuguacaccccaaccucccaccucucaugauuauaacucauaucucaacagauuauaagucaucacgugucauuuaccuucaggguacuugaaauagucacaacucuagguauuaaauugaauaaugcaagaucaguugaauguguuaacuaccaaaugaauaaaugaaagugaauacugccaauagaugaaggcuagaaaaaagaggcugccuuccuuaaacuuuccuuuucauucucucuagguuuauuguaacuagcucuaauaguuucauuuugcuuacaauagugguaauauauuacauuaaugacauaaaaauauaaacuuuuuuuuuuuuuugagacggagucucgcucuguugcccaggccagagugcaguggugcaaucuuggcucacugcaaccuccaccucccagguucacgccauucuucugccucagccucuccaaggagcugggacuacaggcgcccgccaccacgcccggcuaauuuuuuuuuuuuuuuucuguuuuuaguagagacaggguuucacuguggucucgauuuccugaccucgugauccgcccgccucagccucccaaagugcugguauuacaagcgugagccacugcgcccggccaaaauauaaacuuuuaaaaauaaaauaguugagaaauugaaacccguaaacgaacaucagacuaaugcagcaaaagugacucaucuugguguuuccuuugacuuauaguacagaauuaaaauauacggccuaguuuuucuugauugaaauacccucuugugauuaagaaauguuauucucuuauuuucuacugguuuuuuuuuuugaacguguuucuauuuuauuuuaccaacaauuuaaaacuaucuuuagggccgggugcgguggcuaaugccuguaauucuagcacuuugggaggccaaggcgggcgaaucacaaggucaaaagaucaagaccauccuggccaacaugaugaaaccccgucucuccuaaaaaugcaaaaaucagcuggguguggugguacgcgccuguagucccaccuacucaggaggcugaggcaggagaaucgcuugaacccaggaggcagaaguugcagugagcugagaucacgcuacugcacuccagccuggcgauagaacaagacuccgucucaaaaauauaauaaaauaaaauaaaaaauaaagcuaucuuuauuuaccaaagauugccaaauucauaugaacuugaaaagcaugcaggcuaguuauuuaauuuauaaguguucauuuauuuauaggucagugauaccauguagacaauauacaaacauacauguauaccuguacacauaauacagacagacaaaaguaaagacuuuauaacuuuauuuuaaaauuuuagccaugaggccaggugugguggcucaugacuguaaucccagcacuuugggaggccgaggugggcagaucauuugaagucaggaguucgagaccagccuggccaacauggcgaaaccccgucucuacuaaaaaugcaaaaaaaauuacauggguguugugguaaaccccuguaaucccagcuacuggagaggcugaggcagaagaaucacuugaacccaggaaauggagguuguggugagccgagauugcaacacugcacuccagccugggcaacagagugagacuccaucaaaaaaaaaaauuuuuuuuuaauaaaacauaaaauuuuagccacgagaaauggcuacauuugcuuucucauuuaacauuugcuuucucauaccuucccaauaaaacucacuaguuuaaaaggauaguuguauucaaacuaugccuuuguaaauggaaaagguuaaaguuuaucuauuccacaugaccaaagcccuuacucauuuuuuucucuacuaguuucugaaguuuguagucugauauuugagaugucuuacagaaugucuagcauucuguuugaaguuuuauuguguuguuuagcgugaauugaaaagcgcguuaaaugccuaauuaggugauguggagcauaugaaguuagaccaugugguauaugaauuaaaguaaaauguaugaaaaauuacuucauauacaugccauacaugcuuauuacauauuuaauagacuuuagcucacuuagcccagaaaaggaauuuaaauauggaaaauaaucuguuacaauuuuucaaacuugauacaacucaaagacuuucaauagcuaguggguguguuguuucuuuguguucucauguuuaaacuauugggaugaagcuauauuguugcugauaaucaaaucauuuucagcuggccaccagagugaaaauaauauucaagcgcacaauugaauuuugcaacaauauaaggaaaucuaggauccaaaguaaauauaauuacuuuauuacuccccuagcugggcacagauuuaacaguuuuguuacggagcagcagaacuguauuaaagguuguaaaaaguugaaaugccucagagaugaagucuacuauuuaauuccuguuaauacacaucauaggccaggugugguggcucaccccuggaaucccagcacuuugggaggccgaggcaggccgaucacgaggucaggagaucaagaucauccuggcuaacacggugaaaccccaucucuacuaaaaauacaaaaaauuagccgggcuugguggugggcgccuguagucccagcuacucaggaggcugaggcaggagaauggcaugaaccugggaggcggagcuugcagugagcugagaucgcaccacugcacuccagccugggugacagagcgagacuccgucucaaaaaaaaaaaaaaaaaaaaaaaacaaaaccacacacacacacacacacacacaucauagauuuauaccaucaaaugauaacuuugcccucauuacuucuuuuuucucuucuuaaauauugucauuccccaagaucacuucuuugacuuauagcuguuuucuguaaauauuuauuuccuaaaauuauauucugauaguuuaaccaaucaccuugaaauuuaugaguuuuaaaucuacauguuuagcccucacuuugcaccuacauucuagauccauauagcuaugugucuauaaaacauuuucaucuggaugucauacuguaguuccaaauucaguuuaucuaaagcaacauuugcuuucucauaccuucccaauuugggauauagguagcauuaauuauaguuuccaggcuaggauuuggaaucauccuuugacucuuucugcuccauuaugacauauauucauuuugucauuuucaaauguaucugauucaucaguuucuaacauuuccucugucuuccuaguguaaguccucauagcuucuuaccuaaauagauacuggagauacuguagggcauaaggcagaucagauuucaguucucagggagcuuaaaagaaaucuugacuacugguuauugccuccuacauaauguucaaacucacucuaucaaaaggaagccaacugaagccauguucaguugucuccauguucagauguuacuuucuagagcagugugcaauagcacacguacuaucacuuccuaauuuguuuacuuaucuguuuuccuuacuaaguuauaggagaugaagauaggauguuauuuuugcuuucuguuuuuauuuuugaggcagagucucauccugucacccaggcuggaaugcagugguaugaucauagcuuacugcagccuuaaacuccuaggcugaagccuccugaguagcugagacuacaggugugugccaccaugcccaacuguagauuuaugauuuauuuuuguaucacagugcauagugcaauaccuaucacauacaucagugaaccauggauggaugaaagcauuguagauacuuccauuauacuuugucauuggauuuaaacagugaccacaagugaauauaggagauucuauauacuuugucauuggauuuaaacaaugaacacaagugaauauaggagccuuuuuuuuuuuuuuuuuuuuuuuugagacaagaguuucacucuuguugcccaggcuggagugcaaauagagcaaucucagcucacugcaaccuccaccucccggguucaagcgauucuccugccacagccucccaaguagcugggauuacagccacccaccaccacagccagcuaauuuuuuguauuuuuaauaaagaugggguuucuccauguuggccaggcuggucucaaacuccuuaccucuggugauccacccaccucggccucccaaaauucugggauuacaggcgugagccaccaugccuggccccguaauuaucuguaauuugcuuguucaaacuuacucuaacuuucucauauaaauccagucaaauuaaucucuuuacuaucuucuaaauaccccaucuuuguucuuaccuguucuuucagugcuucuuucuuucccugucauagucuaauauaauugucuucuuuuugaacuuucccuuuucucacauugacauguggcucuuaaauguugaauaauuuagcagucccuuauauugaucaguauuaugcauuuuugucuguaccguuauauucauucaauguuuaaugcaaaguuugucugaucuccuuaacuugauuggcaacucuguguaaguugguucuguguuuuucaacuuuuguugucugugaaauguuggaagcccaguauuaaagguuagcuauaaauauuucuccaaacgugauaauucuguauauauaauagcacagaucacuguuuaacaaagggcaauugugucauuauucauucuuguugauauuuuuauuaucugaguaucuauguaauuauaguauuaaaauuuugacuuaauuuaggcuagucagaucaucaaacaccuaaaaaaaggaaauuuuaaauuguucuguuggaauauuauaacagguacaagugggacauuucuuuauuccaugucugacaauauuaguaaaugauauauauuuuuuaguaccuugucuuagccuaauguuuugagucuucuguauuucauaacucugauuuaaaaaugaaggccgagcguggugucucacgccuguaaucccagcacuuugggaggccgaggcgggcggaucaccugaggucaggaguucaagaccagccuggccaacauggugaaaucccgucuguacuaaaaacacaaaaauuagccgggcauggugguaggcgccuguaaucccagcuacucaggaggcugaagcaggagaauugcuugaacccaggagguggagguugcagugagcugauaucaggccacugcacuccagccacucagucucaaaaagaaaaaaaaaaaaagaaaauauagauuucuguaaaucucuuuuuacugccuauauugacaucauuuauuuuauuauucaaaaagaaagauaauaaagcccaucaaaaugcuugauuuauaauuaggagacacuguuuucuuacaaauagccuaccuauucucuuguauguuucuuuucucuaacucuauuucaucaacuuuucuauuuauuuauuuauuuauauauuguacauauccaagcuuauacuagaauaguuuuaagaugaauucaugcucuuuuucuuggccccaguuacuccaguuacuucagucuccuguuguccccacacccucccuucuuuuuuuuuucuuugagacagaguuuggcuuuuguugcccaggcuggagugcaauggugcaaucucagugagccgcaaccuccgccucccggguuccagugauucuccugccucagccucccaaguagcuggauuacaggcaugcgccaccaugccugccuaauuuuguauuuuuaguagacacaggguuucuccauguuggucaggcuggucuugaacucccaaccucaggccaucugcccgccuugccgccuuuuuuuuuuuuuuuuuuuuuuuuuuuagucuugcucugucacccaggcuggaguacaguggcgcaaucucagcucccugcaagcucugccuccuggguucacaccauucuccugccucagccucccgaguagcugggacuacaggcgccugccaccacaccgggcuaauuuuuuguauuuuuaguagagaugggguuucaccauguuagccaggauggucuugaucuccugaccuucugaucgcccgccuuggccucccaaagugcugggauuacgggcgugagccaccacgccuggccacacccgcccuucuuuaaaagccucuguaagugcaauuuguucuuuaacgauuuuuccugauggacucuuuacccaacaauuagaaauacauuggcuugaugaugugaugaaccaucuguagaauugaccaguacccccagaauucuauuuguacuuaaccuuucuuuccaagcaaaggaagcuguuuauuuuuuuuccugaguguuccauugcaauguaaauuuuauuuauuuauuuaucuauguauuuaucuucagagauagagucuugcuguugcguaggcuggggugcaguggcacaaucuuagcucacuauaaccucaaacuccugaccucaaaugauccuccugcauuagccucccaaguagaugagacuacagaccccuggcuaauuuuuuuuuuuuuuaagagacgaggucucacucugucacccaggcugaaguacaguggcaauauccuaacucacuguagccuuggacuccugggcuuaagcaauccuucuaccucagccuccugaguaucugagacuauagguguggaccaccauacccagcuaauuuuuguauuuuuuguagagauguuacccaggcuggucucaaacuccugggcguaagcaguccucccaccuuggccucccaaaguacugcuaugacaggcauaugccacugcacccagccugcaauauaaauuuuugaaauauauuuuuaaaaauuuagaccuaucacagaaaguuguuaaauuucuaagucuuaaagucuugcauuauuaggaaguuaauuuuauggauuaaaauaaaucuacuuuuaugcuaaguuaaacuuaaugucuaaauauaguuuuaguuguauugcauuucuaaaucagauccuagugugccuaacauuuuuauuuucaaugucuaauuguugaauaguuuucuacaguagguauuaugucuauuuaucuucuugauuucuuuuuuuuuuuuuuuuugagauggagucucacuuuugucacucaggcuggagugcaauggugugaucucggaucacuacaaccucugccucccgggcucaagcaauucuccugccucagccuccuguguagcugggauuacaggcaucugccaccacgccuggcuaauuucuguauuuuuaauagagaugggguuucaccauguuugccgggcuggucucgaacuacugaccucaggugaucugcccaccucggccucccaaagugcugggauuacaggugugagccacugcaccaggccugucuucuucauuucuaaugguuaugaauguguauaauauacuggccuguuauaggucaguuuucuuaagauuccauugucuuuuuaaaaaucugucuuaggaaaugagaagagauacaccagaauuacuugggauuuuuuuuuuuuaaaccacuagggauucugauggcuuaccuucuuugucaucccuuuuuggaaauccaaaaugcacaccaccauacccaguuaauuuuuguauuuuuuguagagaaaggguuuuaccauguuucccaggcuggucucaaacucuugagcucaagcaauccaccuaccucagccucccaaaguucugggauuacaagugugggccacugcaccaggccuagauuuucaaauuuuaaauauguaucauaucuaguaauaaaauaauuuauucuccuaaaguguuaauuuagucauacuuauauuagagaagucauugguuauuaggaaaacauuccuaaaaauggugcccauuucuuuaagaaaucauucaaauuuuaaguggcaagcacuaaaauuaacacaaaagagaaauucuuaauaaaaauuacauauuuucagagucuucccucuuauauacuuuugucuuggauaaccuucacaaaauguauccuuuuauauccaguaccccaaaaguugccagcuuucacuuguuuacuuucuggucugccuuccguauagauuccuucuuuucuucucucuuuacucuugaauuaauccucuaccuacuucacaggccgauucuuugaugaaaaugaauccccuguugauccgcagcauggcucuaaacuggcggauuauaauggggaugaugguaacguaggugaguaugaggcagacaagcaggcugagcuggcuuacaaugaggaagaagauggugaugguggagaggaagacguccaaggugagcgugggccuggccuccaugcuauaaccaugaaacccaccucuaaguuuuuugguugaauuuguguagaauuucccccacuuauuaguggcaguguaaccuaaauuuuuuguuuuuucuuugugacggaauuucgcuuuuguugcccaggcuggaguccaauggugcgaucuuggcucaccgcaaccuccaccucccggguucaagcgauucuccugccucagccucccaaguagcugggauuacaggcaugcaccaccacgccuggcuaauuuuguauauuuaguagagacgggguuucuccauguuggucaggcuggucucaaacucccgaccucaggugaucugcucaccucaggcucccaaagugcugggauuacaggcaugagccacugcgcccagccaaccucaguauuaauacaaagagguucuguggaguuuuucaguuuuauuuugaaaacuuuuauaauaguggaauuuguaaaucuguaaauuauuuuaauuuuuaaaaauuuugguuaucuuauguguauuauugauacagcuaugauuuaaaacuuagaaucuucagaaauuuuagaauuaaauuguuuaaaaugacucuagacuuuaccuaaggcaaaugcuucuagaaaauacacuuuuccaauuucucaucuaaaaacauuuuguuauuucagguacaaauauugcccagguagcuuuuucguuauaaggaaagccacaaagggaaugguuuucuccacacugaagauaagauuauuucaccacugacauagcagaggaaggcuauuuuugaauuuuuucugagaggcuuaaaauuuauauuuaacaaucaauaugugaagaguuuuuuuuauauuuauuacacagauucaacauauuuuucuuauucacuguguuacuucugcugagcauuuaacuuagugaaaguucagaaucuaccugugugcaugcagcccuacccaugcaugcauaucagaguguuuuacucuauuacaaguuuuuaggcuaguuuucugccugcuuauauuguuuaguaguauuuguggagcuauuucucuuuucuauaaaaguugauugugaccuuagugugugauacauuacauuuuuaugugauacauggaaauuuuucaucauaacaugcuuugauuucuuccuuagcuguuuuuaaaguaauuaaauuuuuauuuaggcucaugacaagcauuguuuuuauaaaacccagaagaaaauguaguuguucuagaaaauuauaugguuuguagaaaaaagggaaacuagagacugacuuuuaccuaggcacuguuuucauaguucauuuuaguuuaggaaaauuaugauuauuggggauagaaaagagauucauaugugcuaggaguuauauaagguuauauuuauaagaauuuuucaaacacuuuuugguaauauugauauugauauaaauauaaccuuacaauauuauguacuuuuucuauaaucucauccuuuuuucauaaauuuuaucauuuuuucucauugcuuuugugauuuguuuggauuauauuuauuugcaauuauuuauaacguuuuaaggcuuuuucaugcauguauaucauaucaccaauuagauuguaagcucuuggagggcaggaauuuuuauuuauuuugccuuccauuuuguuuguauccuuuucuaccuuuauacccaccccccacaguacuuugcacaucacccacccgccacaguacuuugcacauugucuuuaacugauaauugcaugcuuuucucguugagcauuuauucuuauaacugugacuaggguaauaacucuuuaacuucugguauuacaagguugcuugguuuacacuuucaauauucucuaauuuuuguaagggcuuuuucaucucauuggauaauuuugagguuuuuauuauagugguuuaucucaaucuuuguugucaaucauuucuuauaucuuaaaggugauaauugucagaaaauuuugauuuaauauuuguauggauuucaaucuauuguaaguagauuuauuuucagugccuucucucucccuuucuuguacucuucuccuucuuccuccccugguucuuacugccaccuucuacuucaaguccccaagacccucauguugcccucccauuccuuucacaagaaaauaaauucaccgauacuaaggaauauaaggaaaugacaaaagaugauguccucagugaaguagagaaggggcuguuacauuuuuggauuucccuauuugcaaguuaaucuuacgugagcugaguguugccauuuaacauuucuugucucauucuggcauucucuagaugauaguggcaggauagggcaccuacaaaggggaccaagaacaaaaagaugcaggaacaucagcuccaacaaauaaagagggauaaguuugggugaacugacuaaaaaggaauacugaggagaccuaaauaauuguuaacauguuuccagggauccuuuuuuuuaauugagacagagucuugcucugucacccaggcugaagcugaaucuuccuguuguagaguugauuuuuguguguuuuuuugcuuuuuuuuuugagacggagucucacucugucucacccaggcuagagugcaguggugcgaucucagcucacugcaaccucugcuuccuagguucaagcgauucuccugccucagccuccugaguagcugagacuacagccgugcaccaccacguccagcuaaguuuuguauuuuuaguagagauggggguuucaccauguuggucaggcuggccucgaacuccugaccucaagugauccacccgccucagccucccaaagugcugggauuacaggcaugagccaccacaccuggccauccagggauucuuuagguauauuauuaacuguccaaaaaguagggagagguaauuauggcuguucccuaauuuaucaacaaguuggauuccaaauguucauuacugugccaauguggaaguaaugguuggguucccaguaugguuugcacuuguagccaaagcaggcagaacauagaguagaaaaaaacauuagucagccaggcgcaguggcucacaccuguaaucccagaacuuugggaggccaaggcaggcggaucaccugaggucaggauuucgagaccagccuggccaaccucucuacuaaaaaauacaaaaauuagcugggugugguggcaggcgccuguagucccagcuacuugggaggcugaggcaggagaauugcuugaacccgggaggcagacgugugguaagccgagauugcaccauugcacuccagccuagguagcagaacgagacucugucucaaaaaaagaaagaaaaaaagaaaaaaacauuagucuagaaucaagagauagucuguguauugcuuuucaagucacuuaaacucucugggccacaauuucuucaucuguaugaagacugcugaauuagaauaaaugaucuuucucaguuuuaaaauucuguggccacauucaaguuggaaucauuauauauaacacaaguauuaugagaaaauauguuucagauuucaggaugucugaaacagaucuauucccaaauccaugaaagaaaguagaaacuuuauugccacuauugugacucuacagugaaagauaacaaaaaaugaagcacacacuuaaugcucaaucaauaggggcucuucucugcucucuaguaguaggaguaguuucuuaaguugugaggucccuaggauuagagauuccagcugcaggauaagauucuggcuucaccuaaauauacuuuggcuuuggucuccaaaauuguguauuaugaauugaggcuuuggcagcauaucugccaguagggagcugaagcauuccagccuuuuaucugauaccuguucauuucauauuaaucauuggggucagcacuacuuguagaguguuuuguagaauugaggccuauuuuuccuguguuuacaauuauuuauauauguaaguauauauauaaauuauauauaaacaauauauaaaauauauucuauuuuaauaaaaauguuugcauauuuauaauauauuuauauagauauauaaaugguuauauauuuauaauauauuucuauuauauauuuauaacauauuucuauuauauauauuuauauuuauauuauauauuuaauauauuuauauuauaauuuaugauauauuuauauuauauauuuauauauauauauuuuuuggagacagggugucccucugucacccaggcuggagugcaguggcaugaucauggcuuacugcagccucgaccuccuggggucaagugauccucccaccucagccuccugaguaucugggacuacaggcaugcaccaccacggcuggcuaguuuuuuguauuuuuuguaguggcaggauuuagccauguuucccauguuucccaggcuggucuuaaacuccuggacucaagcaaucaggccaccucggucucccaaaguguucggauuauaggcaugagccgcugcaccuggcuccucacuggcuuuuugccccgaauucuugcuuuuuuuuuaaauuuuuuuuauuuucuaagauggggucuugcuauauugcccaggcugguuucaaacuccugagcucaagcuauccacuucccucagccucccaaaguguugggaucacaggcgugagccacugcacccaggcgauagagcuuucuuucuuuuaucuuuuuuuuuuuuuuuugucgcccaggcuggaguacaauggcguaaucucagcucacugcaaccucccccucccagguucaagcaauucucuugccucagcuuccugaguagcugggauuacaggcguccaccaucacguccagcugauuuuuguauuuuuacaagagacaggguuucaccauguuggccaggcuggucuugaacuccugaccucaugaucugcccgccucagccucccaaagugcugggauuacggcgugagcaaccacacccagccaugguagcgcuuucuuuaauggagguggccuuucuugacuucagagggaauuuaggaauuauuuaauaaacuauggauaucuuuaaaauauuccuuuaauauucauuuuaccuugaugaacuauuuaaaauuuugcugcuuccuaaaaggaacuaaaauauuaguucuuauaauuauauuuagugguuaucuguuauucuacauuagauuugguuaggugauuucauaaucauguacuacugcuuuacagauaaaugcaaagagguuguugguagaaacuugaauucuggguagaauagcuacacugaauaugaacuccaguuaauuuaaaaguccuaugaaauucugaaaacaaugugaagauaccauauuaaaacuuugcuaacagguauaaauuaacaaaaaaauacuucauauuuauugaggacauugcaaguaaugacugccuucauguauauuauuuugagguaggaaacacaguuguuaucucuauuuuccugagaagauaauuacagguccaaauaauuuuaggaacuagaucauguuuguuaaguacgugagcugggaguacauuuguuuuucuguuccuagacauuugcucuuauccugauuucgcuuuuuauuuguucacuuaaaaauuccaaaaagggccaggcgcggugguucacuccuguaaucccagcauuuugggaggccaaggagggcagaucacacccuccuggcuaagauggugaaaccccgucucuacuaaaaauacaaaaaaaauucagcccggaguggcggcgggagccuguagucccagcuacuggggagccugaggcaggagaauggugugaaccuaggaggcggagcuugcagugagccgagaucgccuacugcacuccagccugggcaacagagcgagacuacgucucaaaacaaacaagcaaacaaacaaaucccaaaaaggacgggcacgguggcucaugccuguaaucccagcacuuugggaggcugaggcagcuggaucacgaggucaggagaucgagaccaucuuggcuaacaaggugaaaccccaucucuacucucuacuaaaaauacaaaaaauuagccgggcgugauggcgggcacccguagucccagcuacucgggaggcugaggcaggagaauggcgugaacccgggaggcagagcuugcagugagccaagaucgcgccacugcacuccagcuugagcgacagagcaagacuccgucucaaaaaaaaaaagcccaaaaaguggcugggcgcggugggucaugccuguaaucuagcacuuugggaggccgaggcggguggaucgccugaggucaggaguucgagaccagucuggccaacauggggaaaaccuguuucuacuaaaaauacaaaaaaauuagcugggcgugauggcgggccccuguaaucucagcaacucgggaggcugcggcaggagaauugcuggaaccugggaggcggagguugcagugagccgagaucucgccauugcacuaacaggcucggcuacaacagcaagacccucucucucaaaaaaaaaaaaaaaaaaaaaaaaaaaaaaaaaaugcugggcgcugugccucacgccuguaauaccagcacuuugggaggccgagccagguguaucacgaggucaggaguucgagaccagccuaaccaacaugguaaaaccccgucucuacuaaaaaaaaaaaaaauacaaaaauuauccgggcaugguggcgcacgccuguaaucccagcuacucaagaggcugaggcaggagaaucgcuugaacccgggaggcggagguugcaaugagccgaauucgugccacugcacuccagccugggcaacagagcaagacuucgucuaaaaaaaaaaaaaaaaaaucccaaaaaguaaagacaccuuuuccuuucaauaacuuuccuauuaaauuucuagaaaauuauccacugcuacaugaugauuaagucuuaucuuaauuuaaucauuauauuaaaguccuaaaagauguguuuauagccauaaggugagguucuauaauguggauccuaaggagagcuuucuggagagguacccgugauuauuuucccuuuuaaaaacaaagauaggcugggcgcggugucucaugccuguaaucccagcacuuugggaggccgaggcgggcggauuacgaggucagaaguucgagaccauccuggcuaacacggugaaaccccgucucuacuaaaaaaauacaaaaaaauuagcugggcgugguggcgggcgccuguacucgggaggcugaggcaggagaauggcgcgaaccugggaggcggagcuugcagugagcugagaucgcgccacugcgcuccagccugggcgacccagugagacuccgucucaaaaauauauacauaauuuuuuuuaaguaaagaguucauugauaauugauuagcauguauauaaaguaaaagugugaaauggauauaauuucaggcuuuaacacauauuaagacagauuugggauuaucauaccuaguggauuauacuauuuaaagauagaucauuuguuaagaauaugggguaggcugggugcaguggucacagcuguaauuccagcacuucgggaggcuaaggugggcagaucgcuugaacccaggaguuaaaggccagccugggcaacauggugaaacccugucucuacaaaaaaaaaaaaaaggaaaaauuagcugggcauguggugugugccuguaguccuagcuacucagaaaguugaagugggaggaucccuugagcccugggaaguugaggcugcagugagccgagauugugccacuguacuccaaccugagugaugggacugagacccuguaucaaaaaaaaaaaaaaaaaaaaggugcaaaaugguuaccugaaauucuagaaaugaaaauuucuguaaguuuaacaggaaaguuguugaaaaagaaaguugguuuguuugacuuuuuuuuuuuuuuuuuuuuuuuuuugagauaggguuuaacucuguuacccaggcuggagugcaguggugugaucucugcuuacugcaaccuccaccucccaggcucaagcaauccuccuaccucagccuccugaguagcugggacuacagguacacacaaccaugccuggcuaaauuuuguauuuuuaguagagacuggguuucagcauguugcccaggcuggucucaaacuccugagcucaagugaucugccugccucugccucccaaagugcugggauugcaagcuuggacaaccaugccuggccuguuuugcauuuuugaaagaagaaaguuuuagaguguuaaaaccucucauaccuaaaguaauaguuuuuagaaaacuauaguauacauaugaauuuagauuccaauguaugacuuucuuuaaauuauauuaacaaaaauuaagcuauuggguaauaguaugugacccagaauguaagaaaagugauuuuuuaagucugcagagaagccaaaagauaucauaaaaauccauguacucuacgccaggcgcgguggcuuaugccuguaaucccaguacuuuggguggcugaggcagguagaucacaaggccaggaguuugagaccggccuggccaacauggugaaacuaaaaauacaaaaauuagcugggugcgguggcaagcgccuuuagucccagccacucaggaggcugaggcaggagauucccuugaacccaggagacagagguugcauugagcugagaucaugcaacugcacuccagccugggcgacagaaugagacugcaucucaaaaaaaaaaaaaaaaaaaauccauguacuccaaagggacucuccaaggcucucaucaaaauacuuuucauucuuguucuaauauaauuuuaauacucuuggcugaggccgguggaucacuugagcccaggaguuccagacuagccugggcaaauggcaaaacccugucuuuacaaaaaauacaaaauguagccuggugugguggcgugcaccuguggucccagcuaccugggagguugaggugggaggauuacuugaggccgggagguugagacugcaagugagccaugauaauaccacuacacuugagccuggccaacagagcaagauucugucucagaaaaacaaacaaacaaacaaacaaaaaaaccucuucagcagucucauuucaaaaccuguaauuugcagcaaaauuagaaaagaaggauugcuauuggcagguaaauugacaagaaggcaaagugaucacaacucauagccaagaaagagccagaaaaaucuguaauagccaaauaaaucaaacuccauagcacuauuuggaguaauuuaauacagccacucaaagaggcuuugaggauuuuaguaacaguaaucuuuuuuuucuguuuaguuaagaaaagguuaaacuuugguuguuauaccccauuuaggaagccaagaggaagcuacuuuugcagagacguaaagaaauucacuaaaauguuaaauguugggauuaugagugacuuuuauuuuucugucuuuuauaauuuuaaaaauacuaauauuggauacuuuuauaauuuagaaaaaaaaauugauguuuaaaagccugaaaauguguacagaaauguuucuaccaaagcuuuaauuuaaaggacuaaauaucaucuauauagaaauaauauauuuaggcugggcacuguggcucacgccuguaaucccagcacuuuaggaggccgaggugggcagaucaccugaggugaagaguuugagaccagccuggccaacaugguaaaaccccgucucuacuaaaaauacagaaauuagccaggcauggugacaggugccuguagugccagcuacuugggaggcugagguaggagaaucgcuugauccugggagacagagguugcagugagccaagaucgcaccacugcacuccagccuaggcaacggagugagagucggucucaaaaaaaaaaaaaagacuacauuuauauaaaaauauuaacuccucaauauuugugcguuccuaaaguuuuacuaguuaugucuaucuggcucuauuucuguuugucugucaucuaugucuauuuucuaaagauuuguuaaaauuaaucuugcaaaauaguuccacauacuuuucacucuuuagccaagcaacuaagaaauagaacacuauuuguacuagguguaaaauaacaagcaggaaacuaccuuaaggcuaugaaaaacugagacauuaauuggauuucugcagugauuuaaaaaauaauauguugauacaaaauuauuuuacuuacagaugaugaagaacgagagcuucaaauggauccugcagacuauggaaagcaacauuucaaugauguccuuuaaguccuaaaggaaugcuucagaaaaccuaaagugcuguaaaaugaaaucauucuacuuuguccuuucugacuuuuguuguaaagacgaauuguaucaguuguaaagauacauugagauagaauuaaggaaaaacuuuaaugaaggaauguacccauguacauaugugaacuuuuucauauuguauuaucaagguauagacuuuuuugguuaugauacaguuaagccaaaaacagcuaaucuuugcaucuaaagcaaacuaauguauauuucacauuuuauugagccgacuuauuuccacaaauagauaaacaggacaaaauaguuguacagguuauauguggcauagcauaaccacaguaagaacagaacagauauucagcagaaaacuuuuuauacucuaauucuuuuuuuuuuuuuuuuugagacagaguuuuagucuuguuucccaggcuggagugcaauggcacaaucuuggcucacugcaaccuccgccuccuggguucaggcaauuuuccugccucagccucccaaguagcugggauuacaggcacccaccaccaugcccagcuaauuuuuguauuuuuaauagagagcuaauaauuguauauuuaauaaagacggguuucaccauguuggccaggcuggucuugaacuccugaccucaggugauccuccugcauuggccucccaaagugcuggaauuccaggcaugagccacugcgcccagucuacacacuaauucuuguuagcccaacagcuguucuguucuaucuaccccucauuucacgcucaaggagucauaccuagaauaguuacacacaagagggaaacuggaagccaaacacuguacaguauuguguagaaagucaccucccuacuccuuuuauuuuacaugagugcugauguguuuuggcagaugagcuuucagcugaggccugauggaaauugagauaaccugcaaagacauaacaguauuuaugaguuauaucuuaguucuugaaauuguggaaugcaugauugacaauauauuuuuaauuuuuauuuuuucaaguaauaccaguacuguuuaacuauagccagaacuggcuaaaauuuuuauauuuucagaguugaaguuggugaagacauucaugauuuaaacaccagauccugaaagggguuaaaucuacuuugaaaugaaucugcaaucaguauuucaaagcuuuucugguaauuuuagugaucuuauuugauuagacuuuuucagaaguacuaaauaaggaauuuuaacagguuuuuauuaaugcacagauaaauagaaguacagugaggucuauagccauuuuauuaaaauagcuuaaaaguuuguaaaaaaaugaaucuuuguaauuacuuaauauguuaguuaagaacccgucaagcuuauauuugcuagacuuacaaauuauuuuaaaugcauuuaucuuuuuugacacuauucaguggaauguguaagcuagcuaauucuuguuuucugauuuaaagcacuuuuaaaucuuauccugcccccuaaaaacaaaagguuuugaucacaaggggaaauuuaagauuguuaacccuguuuuucagaagggcuacuguuaauugcacauaaacaugaaauguguuuuccccuguguacuaacacauucuaggcaaaauucaaacuuauagugguaaagaaacagguuguucacuugcugaggugcaaaaauucuuaagacuucuguuugaaauugcucaaugacuaggaaaagauguaguaguuuacuaaaauuguuuuucuaccauaucaaauuaaacaauucaugccuuuauagggucaggccuacaaugaauagguauggugguuucacagaauuuuaaaauagaguuaaagggaagugauguacauuucgggggcauuaggguagggagaugaaucaaaaaauaccccuaguaaugcuuuauauuuuaauacugcaaaagcuuuacaaauggaaaccaugcaauuaccugccuuaguucuuuugucauaaaaacaaucacuugguugguuguauuguagcuauuacuuauacagcaacauuucuucaauuagcagucuagacauuuuauaaacagaaaucuuggaccaauugauaauauuucugacuguauuaauauuuuagugcuauaaaauacuaugugaaucucuuaaaaaucugacauuuuacagucuguauuagacauacuguuuuuauaauguuuuacuucugccuuaagauuuagguuuuuuaaauguauuuuugcccugaauuaaguguuaauuugauggaaacucugcuuuuaaaaucaucauuuacuggguucuaauaaauuaaaaauuaaacuuguuuc

SEQ ID NO: 191231 - RNA, 99851 nt, Homo sapiens
cuuaaucgacccaguacuaaggccuuguguucaguuuuucuccaggauucagacuagagaguuucuuccggcguaaggaacuucaacgcucuucacggaaguaaaaguguuuuuuugguuguuguugccguuguggcugcccgcauuccuucccucccaccucgcggaauuguggcgggagggggaggaggaagucagggcgccugcgcggagaggccgcuuuccauccgggucccuguccgugcggugcagcaggucgguaggcgggaaauggcgacuggcugaaggagcugguucuguugcugcugcgggguaagcgggaaagacaccacacauugcgcagucgggaccaucgccggagccugaggacacuucucugucgucacaguuagguaauccccuucguccagacgccgccgcugcuuccaaucucaguccuccuccucuuccagggccgucugccgggaucuccuccccuucuaaaccugguccuccagcggcucuggcgccuugguaggcaugcacucuuuggcgccucguacguccacugugcggagccgcuccugucuggacuuuccccugggaacagaaagggagcucacuucccgccagcuucaccucuuagguugcggccugcguugugauuucugggguuagauuucacuuugcuacccacccccacuccgaucucaaguuccuaguccccaaccucuggguaauuaaguuagaaguuuagcuuuuuuuaaccuuuuuggcccaccucauguuuucagcauuucauucuuuggaguagggugcuuuuaggggggcguugcucuuaucucaguucuuauaaacaccuuuucagaaucuggaagaagggauuugacuaaguucuguuuaucuuuuguacuguuaaaaucucgaguugacauuguuacuuuuucaaaucgggagugguaguaaagaacaguccauguggaaggcgucugguuuccacaguggucaguuaaagagugaaccuuauuauccuuaauauucucugcuuucuuuggauuuuaaaugucuguauggguguuuacuuuugcauucuugaccagaguucugugguaaauaauugcauaaguaaaucuuguuuauuuacuucucacccuagugguggcuggaugugugaaugauguuaaacacuucagcguaccuuagggaaaccuaaagagaucuaagagcucguaaacuuaccugagauccugaaaugaaacguacucaguagauguuccuccgaggcagggauuuaucuuccuaaugcugguaacgcaguaccaagaugaauuucuucaguggguauacaaauuagugacuugaaaugauggauuuaucuguguaauuuucaaauuguagauugcuuugucuccccauucuucgcccaguuuuaaauuuucguuccugguccauuuuuuauucuuagaaaagggaaauggcguguuaaagcuaguuuuacuauauuucuuuacuuuuucuuuccuuuuuuuuaaauuacauugcagaccaauuguucauaaagagaaguaauaaggaggcuguugguguuuucggaauuuauuaaucauguugaauuugggaucuuuguagguuuuuuuguuuucacuaaucaaauuaaaauuuuaaaaacuguucacauugaauaucaguugauauuuauaacucagguuuucaguucuggauagguccaguuuagagaauuucacuauuguuugcacgauguuaugguuaauuuucaauaauaaacaggaacacacaaacauuauuauaauccucauuugguagacuuugcccaaggucauaaagaaagucaaggcaaaagguagcucuuaugugaaggaguuuuuuaggauuaaguugagcuucauacuuuccuaaggcgaauagaauaguggagguacaggcacguuaacuacuugccgagucaguuuauuuaaaaaauggagccaaauaugcaacuuaaagggaucuuaaaucauuggucuaguguguagguuuugucuguauuuuaaugaccuuuuuggguaguuaauagcguuaauguuuuuaauaaaaauuaguuugcagcuagcugagugagcauuguagaccuuguuuucaagaguucuccuaaauuguuuaguacuacgugcauucaguacuugcacucuuuuaaugcuuucucagaguugaaagaacguauaagcuggcugggugggguggcucacgccuguaaucccagcacuuugggaggccaaggcaggcggaucacaagaucaggaguucgagaacagccuggccaacauagugaaacuccaucucuacuaaaaauacaaaaauuagccgggcaugguggugcacaccuguagucccagcuacucgggaggcugagacaggagaaucgcuugaacccaggaggcggaggcugcagugagcugaagaccaccccacuguacuccagccuggugacagagcgagacuccgucucaaaaaaaaagaauguaaaagcuauaaaugauguaguccuuaaccuuuguggacuuguagcuauauagaaaaucuaaauaggauugcauaggaaugucaggguuuguauguuucacaagauuccauucuacauagugucucuugugcauuuaacuugagcugguaauguuacuguuuucccacuguuaagaaauuaagaauuggggaagucuuuucuuuucagauucaucuagcugaucucaaguuugugauuucugcuuaagugguuuuucaugagauuauuauauaacagaguccaucuaauucugguuaaagaaacuuggaccuguuguucaccaaggauguacuagauucuggauuuguagcuauagauuuuauugucaguugaguaaaauggcauuuauuuuuauuuuuauuuuuuagagaugggggucucucuuuguggcccagguuggagugcaguagugaaccccugggccuaugcaguccuccugcuucagccucccaaguagcugggacugcaggcacaugcuaccacaccuggcuaauuuuuuuaguuuuuuguagagauggggucucccuauguugcccaggcugcuuugcaacuccuggcuacaagcaaucguccugccucagccucccaaagugcugggaagacggguauuugccaccaagccgaguccaaaauaguauuaauuuauccuagucauaggagacugugcuuuagauugaugagauaaugaauaaaaugguuugccagaauuuggaaaaagcaauaucuaauuguaacuuaccagguugugaaagcauaaaguagaaaagacacuuuaagucacaaauaucaagugugcugagaguuuauuuguguugugcucuaaguaauuuuucugguuaaaaguaagcuaaaaaguaccugauuguuuuaaguaaauuggcuacagggggucauuugcuacuuuuuuuuuuguuuuuuugagacggaguuucgcucuuauugcccaggcuggaguggaauggugugaucuuggcucagugcagacuccaccuccuggguucaaguaauuauccugccucagccuccugaguagcugggacuacaggcacgcgccaccacaccuggcuaauuuuugcauuuuuaguagagaugggguuucucuauguuggccaggcuggucuugaacuccugaccucaguugauccacccaccucggccucccaaagugcugggauuacagaugugagccaccgcaucuggcccacuuuuuuuuuuuuuuuuaauggagacggggucucgcugugucacccagacuggucucaaacuccuaggcucaagugauucucccuccuuaagccucccaaagugcugggcuuaccggcaugagccacugcacccggcucaugaugaggagccuugacagauauggaacccauguuaaaaccguuuaauugcagcuuuaguuuucacuuacuuggcauuugccaggaggcauauaucuaagccagacauauauucacuaguguuuguaugacuacauuaauuuuuuaauuugaacuauauuaaauuguaauuggacgugcauuacaaauagguagacuagguaguugacugugugguauaauuugagaauugccaaugccuaacuuuauuuauaucucuccaguguuuuucuaaauguccuguuuaaaaaucacaaauucucugaaagaggaaacuuuaaaaauugucuuuuguugacaauauuagcacagauugacuaucaaauaagcuuauugguaccacacacagguugaggguucagagauaaggaaacauaggagaguuaaguuuuuuguuuguuuguuuguuuguuuguuuuuuuuuuuuuuuuuuugagacagaguuucgcucuuguuccccagccuggagugcaguggugcgaucucagcuuacuggaaccucugccuccugggucaagccauucuccugccucagccucccaagcagcugggauuacaggcgcccaccacgacggccggcuaacuuuguauuuuuuuucuuuaguagagaugagguuucaccauguuggucaggcuggucacgagcuccugaccugaagugauccacccgccucagccucccaaagugcugggauuacaggugugagccaccgcgccuggccaggagaguuaaguuuuuaugcacuggcugugauuagaagggguguagaauauaggagcauugucucggaaagaugacaggcaugguggggauagaauuguggugggaagcuuuggcugcuuggaguccuuugggauccugacaguaaggaauagugagacugaguguggccccaagaagaauuguaagaccuuaaagacaaauauuuuaaugaaggucacaauaggccaguugacuguacuagggacuauguauuuugugauauccauauguuccuauauuauuauuuuauuauuauuauuauuauuauuauuugagaugaagucuugcucugucgcccaggcuggagugcaguggggcaaucuuggcucaaugcaaccuccgccucccggguucaagcaauucucccgcuucagccucccagguagcuaggauuauaggcacacgccaccaugcucggcuaauuuuuguauuuuuuuaguagacaugggguuucaccauguuggccaggcuguucucgaacuccugaccuugugauccgcccacuuuggcgucccaaagugcugggauuagaggcgugagccacugugcccggccuauuauuauuauuuuuuugaaacagagucucgcucugucucccaggcugcagugcaguggcgccaucucagcucagugcaaccucugccucccagauucaagugauucuccugucucagucccccgaauagcuggcauuacaggugcccgcuaucacgccuggcuaauuuuuuauauuuuuaguagagauaggguuucaccauguuggccaggcuggucucgaacugcugaccucaggaugauccaccugccucggucucccaaagugcugggauuacaggugugagccaccgcaccuggccgauuccuguguuagauugaagaaaaaagagaaagucuauauugaacaugaaugaucaacaugggauucuagcauggaaauguguuuguggauuugauuaaaacaacacaacaggcugggcuugguggcucaugauuguaaucccagcacuugggaggcugaggcaggcggauccccugagcuuaggaguucgagaccagccugggcaacauggcgaaacccugucucuaccuaaaauacaaaaauuagcugggcauggugacucacaucuauagucccagccacuagcggggcugaguagggggaauugcuugagcccaggagguugaggcugcagugagccgugagggugccauccauugcacuccagucuuccagccuggguaacagagcaagacccugucucaaagaaaaaaaaaaaaaaaaaaaggacaaaaaacagccgaaacaguguacuaguagaacauacuugggauuacaagugugagccacugcgcucagccuaaguagggauuuaaauguuuuauauacauauauauacacacacacacacacacacacacacacuuuuuuuucucuugagauggacucucacucuguugcccgggcuggagugcaguggcacgaucucagcucacugcaaccuccgccucccugguucaagugauuguccugccucagccuccugaguagcuaggacuacagguguuugccaccacgccuggcuaauuuuuguauuuuuucuguuuguuuuuguuuuuguuuuuugagacggagucucgcucugucacccaggcuggagugcaguggcaugaguugaggaguucgagaccagccugaccaacaugguaaaaccccgucucuacuaaaaauacaaaaaaaauuagcugggcauggugguguaugccuguaaucccaucuacuugggaggcuaaggcaggagaaucgcuugaacccaggagauggagguugcagugaaucgagauugcgccacugcacuccagccugggcaacagagcaagacucucgucucaaaaaaaaaaaaaaucaguguauauuuuaagaguguguuuuagucaucaguaaucuaacaacccauauauugcuucucuagagaaaacagauugauaaugguuuuagaaaaaucauuguuauuuauuuauuuauuuauuuauuuuuuucuuaagagauagggucuugacugggcgugguggcucacgcuuguaaucccagcacuuugggaggccaagaugggcagaucaugagguccagagaucgagaucauccuggccaacauggcgaaaccccaucucuacuaaaaauacaaaaauuagcugggcaugguggcgcaugccuguagucccagcuacucaggaggcugaagcaggagaauugcuugaaccugggaggaggagguugcagugagcugagaucgugccacugcacugcagccugacggcagagcaagacucagucucaagaaaaaaaaagaagacagagucuuacucucucaccuaggcuggaguacaauggcacagucacaguuuacugcagccuucaccuccugggcucaagcgauccuccugccgcagccucccaaguaguuggaacuacaggugugcaccaccacgccuggccaaguuuuaaaauuuuuaaauaaaggcagggucucacuguugccuaggcuggucuugaacucuuagucucaagugaccucuuccuaggugggccuuccaaagugcugagauuacaggugugagugagucacugugcccggccaaaaacacauucuuuucuuucuuauuuauugaagaaaacuuuaagucagagaaaacccuauaauuuuaucagccuaacucaguuguuuuauuuuuuguauaguucuguauuuugccaaauguuuuugauaaguuuauuauauuuaguaguuuuuaaauaauuuuauaauauuagcuaaauggaaaagcagagaagaccauauaucagaaauauugaugauccagaaagaccaccugucuuuaucacacacuuuguugugaauaggauuaaaauaaccuucgaccagacacaguggcgcacgccuguaaucccagcacuuucggaggccaaggcaggcggauuacaaggucaggaguuugagaccagccugaccaacauggugaaacccugucucuacuaaaaauacaaaaauuagcugggcgcgguggugugcaccuguaaucccagccacgggggcugaggcaggagaauugcaugaacccgggaggcagagguuacagugagccgagaucacgccacugugcccuagccugggcgacagagugagacuccgucucaaaaaaaaaaaaaaaaaaaaagaauccuucuaacugugcgcaauggcucacgcguguaaucccaccacucugggaggccaaggcagguggaucaccuuaggucaggaguucaagaccagcuuggccaacauggcgaaaccccgucucuaccaaaaauacaaaaauuaggcgggcaugguagcgcaugccuguaaucccagcuacucgggaggcugagacagggaauugcuugaacccuggaggcggagguugcagugagcugagaucgcgccaucgcaguccagccugggcaaggagagaaacucugucucaaaaccaaaaaaaaaaagagaaucuuccuguuguagaguuguuuuuuuuuuuuuuuugaggcggagucucgcucugucacccaaucuggagcgcaguggcgcaaucugagcucacugcaaccucugccucccggguucaagcgauucuccugccucagccucuugaguagcugggauuacaggugugcaccaccacgccuggcuaauuuuugugcuuuuaguagagacgggguuucgccauguuggccaggcuggucucgaacuccagaccucaagugguccacccgccucggccucccaaagugcugggauuacaggugugagccaucgcaccuggccaaguugauauuuuauauaaugcuccuauacuuaguccuucuucccuaguugucuugauuuuuuuucuuaggugacggagaaaucuguuuuuuccccaaguccuccuccuccuuuuauaaugaaggcuuauggaaguaguggagaguaaagguggacaguuguaauaccugaaacuugauuucagauuagucaggcuagaaauguagacuaaguggaaacaugcugcuacuuuugaaaaugucauuuggugucaaagagggcaaugacuuuagcuuuuucuuucaugaauauaguaaguuaauguaaauuuaguaaucauaccauuuguaagguagaguauaaauuaacagacccagagaauuuuagagcuggaggagaccaaagaggucaucuaguccaauaacauuuguguuuuauugugaugaaucauucugaagacuccuuaacauguagugaauguuugucuuaaugagguugcugcaggaugaguuguauaugauggaaggaugaagacagcucugauuaauuaaugacucaucucccauuuugacagcucuuuguuuguuuauuuuuuagguaaaauuuacaugugaaaugccagaucugauguccaauaauuucuuuugcuguugaggaaacaaagugcuagaaugauugcaugacuuaagcagugucucacagcuaacuaaugauagauuaaggacuggaaacugaguguguccaccucuuagucuggaggucauuccuuuaguaacuccuucaggagucuacucuagaaccuugcaugcauguauuauuuuuuauauagccaacuguaaauauacauaaaguuuuacagcaaaucuugacuuuguugccuuuaauguuugauuugugaucuuuuuguaauuuucuuuauuuauauguguuaucuacucuuguuucucucuuaaugcaugacacaucagaacagguugaguaucccucauccaaaaugcuugguaucagaaguguuuuggauuucagauuuuuuuggauuuuggaauauuugcauauacauaaugagguaucuuggaaaggacccaaguuuaaacaugaaauucauuuauguuucauaaguaccuuacacacauagucugaagguaauuuuaaacaauauuuuuaauaguuuugugcaugaaacaguuuugacugcauuuugacugacucgucacauuaagucgggguggaauuuuccacuugugacauuauguauguuggugcucaaaaacuuggauuuuggggcauuucggauuuucagauuuuuguauuucagauuuuccuaguagggaugcucaagcuguauaccacuucucauucaauuagcaaauacauuuguaaagagggcacauaaguaaguucuaauuuguugagaauucuucauauacaaugugcuauuuucucuuaauguuguuuagguagaaaugugugcauucaagaccuugggagcagauuaucaacugaauuuaugcuuuuaucauuauuguaaucauauuguuaauacaaggcaauuugaaaccauaauugucugccucaaaaauugcuugguaucauggauuuugugaaggggaaggaaaucuuaugaggaagaaacuuuuaguuuuauuuauaagcccauuuuuguaggcaagaauuaaguauugaugugaagauuguuuauguuucagugauacggucuccuucaccccaauuauauggccuuuuugagagagauuagaaaaauuguggcuuaguucaacaaagauugaguuaacucgugugccagguuacuagaauuauggauccagcaucuaccuucaagacucuuacagucuagugcaauuaaagagaaagaaacagauuauuuaauacaauuuaagagcuaaauuagagauaaucacaggguuuacacagguuugaggcuauagaggugguuacuuauacaugauacuugggcugaguuuuaaacaaugaagauaauaguuaauugaaagaaugagguaaaaagagcagaagcauguauagagcacagugugggcaggaaacuauuaguacugcagugcuaagaauguggcagcuggcugggugcaguggcucacgccuguaaucccagcacuuugggaggccgaggcagguggaucacgaggucaggagauuaagaccauccuggcuaacauggugaaaccccaucucuacuaaaaauacaaaaaauuagccaggcgugguggugggcgccuguagucccagcuacucggaaggcuggggcaggagaauggcgugaacccgggagguggagcuugcagugagcugagaucgcgccacugcgcuccagccugggugacagagcgagacuccgucucaaaaaaaaaaaaaaagaauguggcagcaaauagcaaugaaaacagacugggaaguaguuauuguggguuucauaugcaaugcuagaguuuagucuuuauuuugaaggcaguugaugggaaaccugggugagaggaacaggcaaguuugugcagugcccaggaucgauuuaaaggggacaagaagaagaaauauuucagagguaaaaucaucaggauuugaugauugacuauauaagauaagggagaggaauaauaacugugauguuuaggauggcuucuaaguuucuggcuuggcuaguuagguagaugguaguagcauuacuugugaugaagaauauauuaggaaaaauacgguaggaagagcugguuuugguaugggggugguaugggaaaagugaauucaguuuugggugaguugaauuugagguaccaaguaaaaguguugagaacgugguugagugugagucugaaauuuagaggcaguagagauucaagcagaauuaaugaugcaguuuauaaugaacauuugaaagaggcucauucuccaacuccaacccacuaccucuuuaauccuuuuaccugggcugcaggcaaguagaaaggaaauuuuauugcccaguuuugaauugcugggcaauuaacuuuuuguauuccugaaaggagaucuugaaccagaucacaaccaguguugugaacaaguagggcuguuuuacauuauauacuuuuuucuuccaaugucaugaauucuuaggcuaaaauauugcccuuauugcuauguuuguuuugugaugaugccuaaauuguaucauuuucauucacagauuucuuuccuaagcauacucauuuucccaagcuuuauauuauuauuauuauuauuauuguuauuuauuuauuuauuuuuuuaagauagagucucgcucugucgcccaggcuggagugcaguggcgugaucucgucucacuacaaccucugccuccuggguucacaccauucuccugccucagacucccgaguagcugggacuacaggcacccaccaccaugcccgucuaauuuuuguauuuuuaguagagacgggguuucaccauauugaccaggccggucucgaacuccugaccuugugaucugccugcccccccauccccagccggccucccaagugcugggauuacaggcuugagccaccgcgccuuauuuguuccauuuuuuacugauacagguugaguaucccuuaucugaaauaccugagaccgaaagucucuguauuuuuauguuuuuuuugggggggggggaauauuugcauuauacugguugagcauuuucuuugagugucaugucagcacucagguuucuggauuauggagcauuucagguuuuguauuuucaaauuagggauacucaaccuguaauuuaucuaguaauggaacgcuaaagaacugaaaggguaugguaaauccugacauaaguaguagcauuaccaacgugaggcuguauaugucuguuuaaaacuguuuccuuuauauuuuaaauuuaauaaaaucagguuguugcugauguuauauaagcaauuccuaaccuguacugggccaaauuaauauuguauuauguuuguuugguuuuguuaucaagguaauguuggucucauaaaaugaguugggaaguguucccuucuauuuucuggaagaguuuauguagauuugguauuguuucuuuuuagaugauugguaggauucuccagugaagccauuugggccuggaguuuucuguguuggagguuuuuuacuacaguuucaauuuuagaaauuaauggauauggggcuaauuagguuaucuaaugugugagcuuuggugguccauauguuuugaggaauuugauuuucaucuaaauuauugaguguacaggcauaaaguuguuuuuuuguuuguuuguuuuuguguuuuuuuuuuuuuugagauggagucuugcucuguugcccaggcuggagugcaguggugugaucucugcucacuacaaccucugccucccagguuuaagcgauuuuccugccucagccuccggaguagcugggauuacaggugcgcaccaccaugccugacuaauuuuuguaauuuuaguagagauggggcuucacucuguugcccaggcuggucucgaacuccugaccucaggugaucugccugccuuggccuccaaaagugcugggauuacaggcaugagccacugcgccugguccuguugguaauacucuguaaauucuccuuaaaaguauauaggaucuauagugauguucacuuuuuccuuccuaauaaugguuauuugcgucuuuuuuuccucaaacugcugaagguuuaucaauuuacucaucuuugcaaaaaauuuaauuucugguuuuuaaauuuuuuuuuuaauucaucuugauuucuggucuguugaaugcuuugccucuugagguuguaauuuauuccuuuuuugugugucuugcaauauuuuacugaaugcuggauauugugaauaggguaguaaagacugaguaaauaauauuuauaccuggaacauugcauucguggacuuuuaggguagggaguugagucaguguacucaggaguuaagcugaguuucuguuuuguuguugcagaggguaccuuaagugcgccauuggcuucaaauuucucucguguuacuuugugcuuagauugguaguuggcaugugggaagguguuucugaauuuuccugaucaguucucagcguuuggcuuaugugccuuggccucaugagugggacucuaucaguaaucuugcuccucuaggccagacugcaauuuuuaucuuugucgguguuaucuggaaaagaguuucucugcucuugccucagugguauuagagacauuaguaagaucucuaaugucuuugguauaagacccuggguccaacacuguuuccuuccccuacagugguagaguuuuuuuuucuuucacucccccgcauucacuugugccuugcggguaacugggcuugcuguuccuccacuagucccuuccaguuuuuguucccuagaagagaaggaucugguuggggcuucguauuuuucccauuguagaagcugcucccuuccuccagcacugcaccacagaggagggcucucuucagucccauguucgcauauugugagccuuugguggaggucuguggaagaucuugcaaaugguuucaauugcccuuguuaucugugucucucaggaauaauacauucucaugcuaauccacacuuugccuucagcaguuuguuaacaauuuuagaugaauucuuuuuaccugguuuuauggaaccauuguuucuucccguggucuaccucaggugagcccgugcuugcuuucugucucuccuaggaagggguuguauuuucuuggauuugagguuuccugguugccugaguccucagcucucggauggguuuuuaaaagguucaauuuuguaguuuauucauguuuuuuuguuguuaggcuggugguggcauucuuucuggcuuucuguagccuaggcagaacccaguuaauuuagaagaaugaaucucuaggaaaaacuccagugggucauagaagugcucuucucuuucuggggcuguagcuuguaauuccccgacuucuuugcccucagguugccuuuucuuuaguuuagaccaaaggaaaggguuugaauugguuagaucgauugauaguggaaagagagacuccccaauuagcgcuggauugcuuuuucuucuucccuaagugcugguucccucaaaacugucuuguggucagcuccuccucuguaacuuuugucaucuuuucccagucuccucucaaccuugcuuauucuucuauuuccuguuacgaaauuccuagggggaaaaaacauauauuguggccaggugcgguggcucaugccuguaaucccagcacuuugggaggccgaggcgggcagaucaccugaggucacgaguucgagaccagcauggccaacauggugaaacccuuucucuacuaaaauuacaaaaaguaggcgugguggugcacgccuguaaucccagcuacucgggaugcugaggcaggagaauugcuugaaucugggaggcagagguugcagugagcugagaucaugccacugcacuccagccugggugacagagcaagacucugucucaaaaaaaaaaaaaaaaagauagauaauuuuaaagucuggaauuaagaugaaguauuuuagcacuugguguaccugacaauuugccauuuuuugucuacagguuauuuugucauuuuuaaaaguaaguaaauauuaaaaaggcgggguaggaggcaaauuuuacuuggucccuuuuucuguccuuuucuucuguccccauuauuuucuaccccuuguucacaguaguugguuagcaaaaaaaaaauagggccaggcaugguagcucacgccuguaaucacagcacuucaagaggccaagaugggcggaucacuugagcccaggaguuugagaccacccugggcaauauagugguaccccagcucuacaaaagauuaaaaaauuagcugggcguaguagugcaugccuguagucccagcuacucuguaggcugaggugcgaagaucgcuugagccugggacguugaggcugcaaguaaguggugaaccugccgcugcacuccagccugggugacagggugagaccgugucucaaaaaaaaaaaagagauuuuguuuuccaauuccagaguccuuaucucuuacucuuuuggaaaccuuuggauuagaugaagaucuauaguuuuguuaaaaacuguguuaaaccauuuuaaccauuuguaaguacacaguucagugguauuaaguacauucaccuuguugucuaccaucugucuccagaacuuuuucaucuucucaaacggaaacucuguguucauuaaacagucuucaacguucauaauauauaucagaauuuccuuccuuuuuaaggcugaauacuacuuaauuguguguacguaccacauuuuguuuauccauucuuccauugguggacacuucgauugcauccaccuuuuagcuauugugaaaaaugcugcuaugaauauggauguacugugugagacccuacugucaguucuuuuggaugcauaccuggaaguagaauuguuggaucauauggcaauucuauauuuaauuuuuuugaggaacugccaugccacuuuccacagcagcuuuacuauuuuacauucucuacaguaaagcgcaaggauucuaauuucuccacauucuugccggcaauuuuuauuuuuuauuuuuauuuuuuugauacuagucaucuaaaugagugugaagcuguuuuuuauugugguuuuaauuagcauuuccgugauaauuagauaauuagugaugucaaguguguuuucaugugcuuauugucuauuuguauauccucuuuggagaaaagccuauucaaguccuuugcacauuuuugaaucugguuguuuuuuucuuucugauuguaaugcuuuauguauucuagauaagaacuucuuaagagacacaugauuugcaaguauuuucugccauuccaugguuugucuuuucacucuguugauaguguacuuugauacacaaaaauuaaaaacaaaauuuuuuaagagguaggaucuuacugugucacccaggcuggaguguaguggugcacuuguagcucgcugcacucuugaacuccugaguucaagggauccucccaccucagcuucccaaguaguagcuaguacuguaggugugcaccaucaugccuggcuaauuuuuuuaguuuuuuagggauggggucucaccuuguugcucagacuggucaaaacgguccuucugccucagccucccaaguaggugggauuauaggugugagccauggcaccuggcucaaaaauuuuggguuuugacacccaauuuaucuguuuuucuuuuuguuauguguguuuuuguugucaugaccaagaaaccauugccaaauccaauguuaugagcuuuucccauacacacacacacacacacacacacacacacacacacacagacacagagacacauuuuuuugagaagggaccuuacucugucacccagguuggagugcaguggugcaaucucagcucacugcaaccucugccucccaggcucaagugauccugccaccucagccucccaaguagcugagaccacaggcacacaucacuacaccuggcuaauuuuuuguauuuuugguagagacgaaguuucaccauguuguccaggcuggucuugaacuccugagcucaggcgaucuacccuccuuggccucccaaaguacugagauuacuggugugagccaccacacccagccuauauuuucuucuaagagucuuagcucuaauguuuagguauuugaucaauuuugaguuaauuuucuauguaguauaagguaaguaguuuuuuuuuuuuuuuuggcguuuagauauauaguuuucccaguaccagauaucuauaacuuuaguagggguacagauaggccugguguugagauauggaauguaguuuuuuuuuuuuuuuuuuuuuuuuuuuuuuagacggagucucccucuguugcccaggcuggagugcaguggcgcgaucucagcucacugcaagcuccaccucccggguucacaccauucuccugccucagccucccgaguagcugggacuacaggcgcacaccuggcuaauuuuuuuuauauuuuuaguagagacgacaggguuucaccguguuagcuaggauggucucgaucuccagaccuugugauccgcccgccucggccucccagagugcugggauuacaggugugagccaccccgcccggcuguaguuuuucauauuauuuguauaauagguuagguuccagauuuuuuuuuuucuuuuugagacagagucucacuccggcuguugcccugucugcagugcagugacgcagucacagcuuacugcagcuucgacuucccaggcucaggugauccucccaccucagccucccaaguaguugggacuauaggcaugcaccaucacaccuagcaaauuuuuuuguauuuuuaguagauacaggguuucaucauguugcccaggcuggucucgaacuccugggcucaaguggucuaccugacuuggccucccaaagugcuggcauuacaggugugagccacuguaccuggccuagguucuagauuuuugaauucaguuauauuauggguuaacuauguacauaggagcugcccuggaacucuacucuguauuuguaacauuguuucuaucagaaguuuaauuuugagcucauaccagccaauuugaaaacacagcuuuuuuuuugcuuuuuuuuuuuugagauggagucucgcacugucgccugggcuggagugcaguggcacgaucuuggcuuacugcagcuuccgucuuccagguucaagcuguucuccugccucagccucccgaguagcugggauuacaggcgcccaccaccaugcccagcuaauuuuuuguauuuuuaguagagacaggguuucacuuuguuggccaggcuggucucgaaugccugacuucaugauccaccugccucggccugucaaacugcugggauuacaggcgugagccacugugccuggccuuuuuuuuuuuuuuuuucucgcuuugucacccagacuggagugcaguggcgcgaucuaggcucacugcagccuccaccucccgggugcaagcgauucuucugccucagccucccaaguagcugggacuacaggagcccaccaccacgccugguuaauuuuuguauuuuuaguggagacaggguuucaccauauugaccaggcaguucucgaacuccugaccucgugauccacccaccucgaccucccaaagugcugggauuacagguaugaaccaccaugcccugccauaaacuuacagcuuuuacagguuaauuuuaucuuaagguuuuguucagccagggguucagcugaaaaauuacccauuccaauggaccauucagacaaaaggcagaaguaaaaaacaaaccuggcugggugcgguggcucacgccuguaaucccagcacuuugggaggccaagacaggcagaucacuugaggucagguguucgaaaccgcccuggccaacauggcaaaaccccgucucuacuaaaaauagaaaacaaguagccgggugugguggcaugcgccuguaaucccagcuacuugggaggccaaggcaggagaacugcuuaaaccugggagguagagguugcagugagcugagauagaaccacugcacuccagccugggugacagagcaaggcucuaucucaaacaaucaaacaaacaaacaaacaaaaaaccuuagagaaaaaugggaaauugcuggcucagaagagggaacaggcaaaaaaaaaaaagagagaaagagaaagggaaauuggaaucuuggggaacuuuuuuuuuuuuuuuuuuugagacggagucucagucuguugcccaggcuggagugcaguggugugaucucagcucacugcaaccucugcucucggauucaagugauucuccugccucagccucccaaguugcuggaauuacaggugccugccacuaugcccagcuaauuuuuguauuuuuaguagagacagaguuucaccauguuggccaggcuggucucgaacuccagaccucgugagccacugcacccagccugguaacuuuuuaaucaguuaaaauguuuuguugguuauaaauauauuauuuucacauugcaaguuauuuauauugaaauuauguggaaauuuuuacuuaaaacacuucugcugucuucuccccuuauacuuuuucuuucauaaaauggaaauaacagacacuacuuuaugugguugagaagguuaagugaaauaacaugagaaagcauuuaucacagugccuugcacauaggaaccuuuucauguucagguaaauauaguauuuuagaacuuuuuuggaaaagaauagauugagaauugguuuucuuuuuuuauuuuuccagcaacugguauuuauuaucaaaguuauguuugaugucagcaaguugccacaacuacaaaaaaauuugcauauuacaaucucaaugcaaacguucaaauagaaccccaguccuuaaaaaguaaaaaaguaauucagauuucaucaaaaagcaacagaauuuuuaaaacaucuuuauauauccagccaacaaguuaaaauaguuaacaagaaaaaaauacaaaauauugauguuuaaaaaaggcauauuucuaucgauuugcccaucaaucucuuggccacucggcuucgugccagucaucaucugacaggcucucagccaccucuggcaacucaagcuuaaccaaaccacaucccuuggacuucacauucuucaucuugauguuggguuauagcacauggccguauuugucaauuugaucauguaaaaucaaaugggagauuucucacaaauaccugguaggcuuuccuggccaccgccaggagcauggccuccagccucaccaaaggacccugccaaacuuccuccagaguuuaagugggcgcagucaaagcugacauggccaccaccauccauggcuaggcccauacacccagucucagcacccagugucuggcccaugacgggacccaugcacucaaggcuguuaaugcccauccucuccagacuguuggcacccguccaccccaguuccauccggauguuccagguuguuggcaccuaugugcuccaggccaguggccaugugauccaucauggggcucaugugcuccaggccagcccccauaccugcaggaaccaugcacuccacaccagagcccaugugcucaaugguuugguccacauggucaaugggagcagcugugcacuugaggcugaagcccaugccggcacccaugugcuccaggccggagccacugcgcuccgugaccuugccugugugcuggaugcuagaggccauuuggucaaggcccagcaggcccaugcgcucccugugggagccuuugugcuccacaaagcccaugcgguccaugaccagacccaugugcugcaucuuggaacccacacgauccacaccauggcccaggccuggacucaugcauuccaugcuggcacccccaguguagucagcgcuugggccucauccucucgauuuuggggaugcugccuccaccuucacuuccucucugcuuuguagugaucuucccuauccuaaguguauuacuaagauuuccuuuauucugcccauguucaucccagagccaaauugacccacauuuuccauaccgccaccaugggggucccuccuccauuucucccauuuuauucuaaauccaugcccuccauucuaauuucugcaggcccuguuucccauuccagugccuuuauucaggugauuggcaucgauagucugcccuccugguccuaacccuguuccaauaccaccaaggccauagggaagcugcggacgcuuaggagggaaaaaaaaauccuuugguaaggcggucucauccgucuuuaccugcguuggucuaucacacagcaguuggccauugaauguagauauagcuugcacagcuucaguggacuguucaaaaguaacagugcccaauccaugauuuuuuucaucuuuauccucaagaaugugcucagaacaccacaucagccauacuaaaauauuuccuugaguuucuuccagccaacuuuguaauccugauuugcuacaaauauugugcuuccaagucuuucugucuguaauacauggauaauuucauuugggauguuaggauuauuuaagauacuaggugggauaguaaucauuucugggccacuuggucucauaucuguuccaccagugguagccaucacguuuugcauugcucuccuggcauguucacuaucaggaucuuucacuuucaguggucuuccacucagacuaugcuugucuagcaccugaauagcuuuuuuuauguuuucuuccaucuugaauucaauaacagcacauccccugacuuuccuucagugccuguugcccaggcuguauugcaguggcaugaucucggcucacugcaacuuuugccucccugccucccggguucaagugauucuugagccucagccucccagguagcugggauuacaggugggcaccaccaugccuggcuaauuuuuuuguauuguuaguagagacaggguuucaccauguuggccaggcuggucuugaaauccugagcucaggcaguccgcccaccucggcuucccaaaguguugugauuagaggugugagccaccacgccuggccucaguucaguauaaggaaguuuuuugauuagaacucguuuaaggcgaaacaccauuucuacuaaaaguacaaaaaguagccaggcgugguggcacuagccuguaaucccagcacuuugggaggcugagaaggaugaaucacuuugaggucaggaguucaagaccagccuggccaacauggcaaaaccucgucucuacuaaaaauacgaaaauuugccaggcauggugguacaugccucuaaucccagcuacuugggagggugaggcaggagaauugcuugaacccaggagguggagguugcagugagcugagauuacguugcugcacucuugccugggugacagagcgagucugucucaaaaaaaaaaaaaauuaauauuuuuuuacguuugcauuaugaaauaaugauccuuaugucuccuuaagcauuccguuagauucuacauuacuuuucuucaggaaugcuaccugagguguuuuugcugugguuggagagguugaauuaagagcauuuuucaauuuuaguguuuuagauuuuuagaaaaaagagggaauuggagguaaccuauaaauauaauuuaaauuacuuaguuuuacuguuuuuuuaacuuaaaauuaggaaacauuuaaauauuaaaaauaaauucuaauuuggaagauuuagucauauagacacuccuuauacacugcuaguucaaaccacuuuuccagaaagcaguuuguuaguauuucuagagauacuaccaaauguuaacaaucuuugaacuuguaaguucacuucuaagaaacugucuuaaggaaagaaucagaaauguagacugaaauuuaugugguuauuucauuugaggugauguuaguaauuaugaaacaguuuauuuuccaacaagucagugaucaaauaaugaaacguuuaucuguauauuggaauaugacaugaccauuaaaaguuauauucuuaauuuuuuuuuuuuuuuuuuuuuuuuugagacugagucucacuuugucacgcagauuggaguauagcggugcaaccuuggcucacugcaaccuccgccucugggguucaggugauucuccugccucagccuccaaguagcugagauuacaggcgccugccaccauguccggcuaauuuuuguauuuuuuguagagaaggggcguuucaccauguuggccaggcuggucucgaacuccugaccugagaugaucugccugccuuggccucccaaagugcugggauuacaggcgugagccacugcaucuggccaauauucucaaauuuuuaaaacaacauugguaaaauauaguauaaaaggggaaaaaaacagguaauacguguaguauaauuauaaauauugauuaaaauacuuauacauguuaaaacaagcagacuaauauacccacauuaucagucauuucugaguuaaggaauuaugggagauuuuauuucauguuuuacugucuuucuguuucuuguuuuuuguuuuggagacagagucucagucuguuucccaggcuggagugcaguggugugcuauggcucacugcagccucagcuucucaggcucaagugaucuucucucucucagccuuccaaguagcugagacuagaggugugcaccaccaugcccauauaauuuuuuuguuuuuauuuuuuguagagacuggggagucucccuguguugcccaagcuggucuagaauuccugggcucaagcaauccucccgccucagccucccaaagcccugggauuacaggugugagccaccacgcucagccuaaaguucuaaaaugauguguauuuuauaaucagagaaaagggucaauauguccaccaaaaauaagaauuuuuccaacucuuaagggaucaagagugaauuuuguuuuauguaaauaauuacauauaucucucacuggauuguuguaagccuggcacaugauuaauauguuuucacugcaguuuuucccccugaguuugggucauacuuuacuguuucuaucaugucuuauaauuuuuuguugaaaacuggccauuuuagauaauauuguagccacucugauucuugauuuuucucccgucaaaaguuguugguuguuuagcaguaacuuccaugggcagaaaaaaaucuaugaaauuuaucucccugcaguaugcaaacacugaugucucugcuuaauuauuauuuuuucuuuuuaaauauuuuugcuuuuacuuuuaagcuuggcuuacuaaagcauaccucccuauauauuugcauagccuaguggucaacuaaugaucggaccaaucaugagcccaaacaccuugaacacagaucucagcuguaaaauuuuuaaacuaguaaauucacuucuaagaaacugucuuaaggaaagaaucagaaauguagacugaaauuuaugugguuauuucauuugaggugauguuaguaaucaugaaacaguuuauuuuccaacaaaucagugaucaaauaaauuaugagacauuuauauugaaauauugaaauauuacaugaccauuacaaauuauauucuguaaaauuuugacaaaaagauacuccuauaacauuagagggcguuucauuucuccaaggcaaaaucuguuuugcuuuuuuucucuauagauuauuuguguccccgauaaaaauucuuuuuaaugauguuauuaaauauguauuauuuugugucugccauuguuuagcaugucuaugagauuauuucauguuuguuuaugauagaaguuccuuugugaugcugauuaguauucacuuacaugaaaacaccacaguauucaucuuucuguuuuggggcauuuuuguuguuuccaguuugggacuagaaacagccuuauugugaauaaggcugucaggaauauuuuuguaaaaauauauugugaacguguuuacauuucucuuggauaaaaauguagaagugaaaucagugagucaaagaguuugguguauauuuauuagaaauugcccaauuuuaucaaaaaacauacauccuuaacagcagcauauaguaacaugagaauaaagagacuucucuuuauucuccaucauuguuacuauuuaaauuugucauucuuuuuaauuuuugccauuuuaggaggugugaauuggcauaccuuugggguuuuaacuuaaaauucuuaugaauaauauugaguaucauuuuuuaugcuaucaccaguuaucuaauuuuuaugaaauauuuucucauauuuuugccuguuuuuucuauuggcuuguuuucuuauuguguuguaggacuuuauauauucuacauacaaggucuuugugauaugugcguuuugugaauauucgaccaguuugcuccuugccuucuuauuuuuccaauaaugucuuuugguagacggcaaguuuuuaauuuuuaugaagucaguuuauccaguuuuuucuuuaugauuauucuuuaaacaagacuaugucauuugcaaagagauaaguuucaccuuuuuuucuuuuuaauauggauuucuuuuauuuuucuagccuaauugccugcuuagaacuuccaguaaaauguugaauagaaguggugagaggggccguccuugucuuguuccugauguuagagggacagcauucagccuuuuaucauguaugauaggucauguggguuuuucauaaauaccuuuuuauuauguugaggaaguuccuguuuguucuucauuuauugauuauuuuuaauaugaaaggguguuggauuugaucaaaugcuuuuucugcauuaauugagaugaucauguggauuuuuuuuuuguuuuuuacuuaaauucuuuuuauuauacuuuaaguucuaggguacaugugcacaacgugcaggcuugcuacauauguauacaugugccauguuggugugcuguacccauuaacucguuauuuacacuagguauaucucccaaugcuaucccucccccaucccccccaccccacgacaggccccagugugugauauuccccuuccuguguccauguguucucauuguucaguucccaccuaugagugagaacaugcgguauuugguuuuuuguccuugugauaguuugcugagaaugaugguuuccaauuucauccaugucccuacaaaggacaugaacucauccuuuuuuauggcugcauaguauuccauaguguauauaugccacauuuucuuaauccagucuaucauugauggacauuuggguugguuccaagucuuugcuauugugaauagugccgcaguaaacauacgugugcaugugucuuuauagcagcaugauuuauaauccuuuggguauuuacccaguaaugggauagcugggucaaaugguauuucuaguucuagauccuugaggaauugccacacugucuuccacaauggucgaacuaguuuacagucccagcaacaguguaaaaguguuccuauuucuccacauccucuccagcaccuguuguuuccugacuuuuuaaugaucgccauucuaacugguguugagauggugguaucccauugugguuuugauuugcauuucucugauggccagugaugaugagcauuuuuucaugugucuguuggcuucauaaaugucuucuuuagaggagugucuguuaauauccuucacccacuuuuugauggaguuguuuuuuucuuguaaguuuguuugaguucuuuguagauuccagauauuagcccuuugucagaugaguagauugcaaaauuuuucucccauucuguagguugccuguuuacucugaugguaguuucuuuugcugugcagaagcucuuuaguuuaacuagaucccauuugucaauuuuggcuuuuguugccauugcuuuugguguuuuagacaugaaguccuugcccaugccuauguccugaaugguauugccuagguuuucuucuaggguuuuuaugguuuuagguuuaacauuuaagucuugaauccauuuugaauuaauuuuaguguaagguguaagcaagggauccaguuucagcuuucuacauauggcuagccaguuuucccaggaccguuuauuaaauagggaauccuuuccccauuucuuguuuuugucagauuucucaaagaucagaugguuguagaugugugguguuauuucugagggcucuguucagucccauuggucuauaucucuguuuugguaccaguaccaugcuguuuugguuacuguagccuuguaguauaguuugaagucagguagcguaaugccuccagcuuuguucuuuuggcuuaggauugucuuggcagugugggcucuuuuuugguuccauaugaacuuuaaaauaguuuuuuccaauucugugaagaaagucauugguagcuugauagggauggcauugaaucuauaaauuaccuugggcaguauggccauuuucacgauauugauucuuccuacccaugagcauggaguguucuuccauuuguuugugucuuuuauuucauugagcagugguuuguaguucuucuugaagagguccuucacaucccuuguaaguuggauuccuagguauuuuauucucuuugaagcaauugugaaugggaauucacucaugauuuggcucucugucuguuauugguguauaagaaagcuugugauuuuugcacauugauuuuguauccugagacuuugcugaaguugcuuaucagcuuaaggagauuuugggcugagaugaugggguuuccuaaauauacaaucaugucaucugcaaacagggacaguuugacuuccucuuuuccuaauugaauacccuuuauuucuuucuccugccuuauugcccuguccagaacuuccaacacuauguugaauaggaguggugagagagggcaucccugucuugugccaguuuucaaagggaaugcucccaguuuuugcccauucaguaugauauuggcuguggguuugucauaaauagcucuuauuauuuugagauacaucccaucaauaccuaauuuauugagaguuuuuggcaugaagggcuguugaauuuugucaaaggccuuuucuacaucuauugagauaaucaugugguuuuugucuuugguucuguuuauaugcuggauuacauuuauugauuugcguauguugaaccagccuugcaucccagggaugaagcucaguugaucaugguggauaagcuuuuugaugugcugcugcauucgguuugccaguauuuuauugaggauuuuuuuuuuuuuuuuuuuuuuuuuuuuuugagacggagucucgcugucgcccaggcuggagugcaguggcacaaucucggcucacugcaggcuccgcccccugggguucacgccauucuccugccucagccucccgaguagcugggacuacaggcgcccgccaccucgcccggcuaauuuuuuguauuuuuaguagagacgggguuucaccguguuagccaggauggucucgaucuccugaccucgugauccacccgccucggccucccaaagugcugggauuacaggcgugagccaccgcgcccggccuuuauugaggauuuuugcaucaauguucaucaaggauauuggucuaaaauucucuuuuuuuguugugucuccgccaggcuuuguaucaggaugaugcuggccucauaaaaugaguucgggaggauucccucuuuuucuauugauuguaauaguuucagaaggaaugguaccagcuccuacuuguaccucugguagaauuccgcugugaauccaucugguccuggacuuguuuuaguugguaggcuauuaauuauugccucaauuucagcuccuguuauuguucuauucagagauucaacuucuuccugguuuagucuugggaggguguguguguccaggaauuuauccauuucuucuagauuuucuaguuuauuugcauagagguguuuauaguauucucugaugguaguaguuuguauuucuguggaaucagugaugauauccccuuugucauuuuuuacugcgucuauuugauucuucucucuuuucuuauuagucuugcuagcguccugucaauuuuguuaaucuuuucaaaaaaccagcuccuggauucauugauuuuuuuuaaggguuuuuuugugucucuaucucccucaguucugcucugaucuuaguuacuucuuuucuucugcuagcuuuugaauuuguuugcucuugcuucucuaguuauuuuaauugugauguuagggugucaguuuuagaucuuuuuuuuuuuucuuuuuuuuuuuguuuuuuuuucuuuuuuuugaaacaggcucucacugucgcccaggcuggagugcaguggcgcgguauuggcuuacugcagccucaaccuccugggcuucagugauccuuccacuucagccucccagguagcugggacuacagacaugcaccaccauggccagcuaauuuuuguauuuuuuauagagaugggguuucaccauguugcccaggcuggucuugaacuccugggcucaagccaucuaccugccuuggccucccaaaaugcugggauuacaggcgugagccacugugcccagccugcuuugaagccaggcacugacuucucauagcugugaaaguccuagauggcaucuguuuccagcagaaagcuguuucgucuacuuagaaaaucuguuguuuuaguauagccaccuucaucaguggacauagugagaucuucuggauaacuugccuccacuuuuauaucagcaccugcugcuucaccucaccuugcacaucuauauuauggagacagcuucuuuccuuaaaccucaugaaccaaauagugcuagcuucaaacuuuucuuaugcagcuucuucaccucuggauuagcuuugguuuaagggaaugcuguggcugguuugauuuuauauccagacuaccaaaacucuccaugucagcaagaaggcugcuuugcuuuguuagccuuuguguguuuauugguguggcacuuuuuugguugggggggguggugcggggugggagaggguagugauggaaucucgcucuguugcccaagcuggagugcuauagugugaucucuccucaaugcaaccuccgccucccggguucaagcaguucuccugccucagccuucagaguagcugggauuacaggccccugccaccacgcccaccuaauuuuuguauuuuuaguagagacaggguuucuccauguuggccaggcuagucuggaacuccugacuucaggugagccaccugccuuggccuuccaaagugcugggauuacaggugugagccacugcgugcccagccuguaguuucuauuuuuuaaaaaguuucuuuuuuuucuaugauuguuuuguugaguuacuaaaaacaauuucugagacucuaaucuuugccaggaauuucuguacauuuagaguuuaaagugcuuaauuggaguuaguuuguucugugaguguauccacuauggugaauagcuuuauuguccuuugcacauuauagccuuuacuaguccuuuuuucauuuugagccucagaaugguaagguaaauauguuuuuuuauacaugugauaaaacauaacuaagugacuacagauuagccaugauuggaguaggauuaaaauucacaucucuuaauucuucguuuaguauucuuuguauuguguuucacagauucuaauucaguuaugucuuuaauucuaaguguugggacaguuuugccagcaauuaauugucuuaccuauaaaaugagagagcucaaauaaauagccucauauuuucuuucugaugugaaucguuuuaaaaguaucauuaaaugugguaagauaggacuuucucaaaaugauccacauucuguuguuacacuuauaugguuguugauuauuagaauugugcucauggaauucauucauucauuggcugacauuacuuuuccacuacccagugaguuacagaaaagcaaaaccuuuccuuaucuuguuuacuauuuacucaauucuuacuuggcccagugccuugaauguggcuauguaugcaauaaauauuugucgaacgaacgauuaaacgaauaguaguguuggcaggcaguauaguauuauguaaagagcaugcacacuccuugguguuacccuuacuuuagaucauaggauauauuauaauauuucagagguuguugggaagguuacuugggauaauauaaauaauguauaaagcauaaugccuuuuacuuaaaauguugguuucuuacugcagucuccuagagucuaggacuuuuguuuuuuuagccaagauauuuuuauuauauaagcugggcacauuuggguagagaagguugaauuuaauaacuuuuaauuuuuuauuacauuuauuauuuuucucuuuuaguuuuacauguggcacccauaaaagaugaggcugagaacacggaaagcuucucagcagucaaaucaaauccaaacacaacgcacugccagagcaaagaggaaauauucagagguugaugauagccugccuucaggaggagaaaaaccaucgaagaaugaaaccggcuuguugucuucaauuaaaaaauuuauuaaaggaagcacaccuaagguaaugauuuuaccauauacuuucauaucauuaaaagugaaaauuggccgggcacgguggcucacgccuguaaucccagcacuuugagagccccaggcagguggaucacgaggucaggagaucgagaccauccuggcuaacacggugaaaccccgucucuacuaaaaauacaaaaaauuagccgggcgagguggcgggcgccuguagucccagcuacucgggaggcugaggcaggagaauggcuugaacccuagggggcggagccuguagugagccgagaucgcaccacugcacuccaaccugggcgacagcgggacuccgucucaaaaaaaaauagugacaauuaugauauuuucucuaagcauguguagaugagaaaucugauagcgcaccaaaaacuacguuuugguguuaauuuuacuucuaagaguuuuacaugcagaauauuuaauggcaguuuaagaagaacauuauuccacugaacuaauccacguagccuucugcuuuuucaacauaguauuaugggaagcaaaauaaauuuuuccuuguucuuuuacuugaguuguuucuuuuacuuucauuuucuuucaaagaaaaaguuucuuguuaauauucacugucuagggaggugaugucucucaucuauucaaguucuaacauuuguaugaugaagauguauugcuucguuaaagagaaaagaacauaaagaaagaauggacacggaccaggagucuuguacuccagauucauauucuggaccaacuugagugaccuaaggagagagucauuuaccccccaagccucaggaagauaguaaauggcacugauaccaacugcuucgucuaucucagaguuguuuucagauuagaugguacaacagguagaaaagcaguuggaugaauuuuauuuuauuuuauuuauuuauuuuugaaacagagucuugcucugucuccaggcuggagugcaguggcgcauucuccgcucacugcaaccucugccucccgaguucaagugauucuccugccucagccucccgaguagcugggacuacaggcgcccgccaccacaccagcuaauuuuuguauuuuuaguagagacggguuuucacuauguuggccuggauggucuugaucuccugaccuugugauucguccgccucggccucccaaagugcugggauuauaggcaugagccaccgcgcccggccucaguuugaucaccuuuaaugcacucuaucaauguauaguauuauugauuguguguaguuuuuuuaugacuuuacuauuuuuguguucuuagaauaauuauuuauaugguaaauuuuucauuauaauggaaguguauuacuuucuuaagcagaaaaauaaauuacuggcugacuuguucauagggauagauuuuguuguaauagaauuaacaaagccuaauuacuguaagucacugggcaagauuuggaaguauucuugguuugcauaggguuuuaauuuuuguuuuggugguuuuauuuuuuguuuuuguuuguuucuaauacuauaauuucuuuguuaauuuucaguaauuagaaauuuuaaaaaguuucugaauuuauguaaacugagaaaauauucuaauguuaucauauaacaaagaugaaauaucuuccagaaaccugaauuuccaucucuauaaauuccuaauggguugucaucagccucuguugaugggaaccuugcuacguauuauuacuucauucuucugagcagcuuuaguugucauaaagugcguccucaucuuuugcuuucucauguuacuuuuuuguaguuuuuuccacuugaaaacagaucuguguuuccuuacaugugcaaguacaaaccuucagucauuauacagggcagcuauuucuaguuuuccuuauaugacauaugauauuuaucauuaucuuggucaccuuuaucuguuauucaugaaagauaaaaaccagaagugaagauagguuuuuguuaugucuucagaauucuauucauauuuauaguugacccuugaacaauguggaguuuagggaugcugacucucccaugugguugaaaauccacauacaacuuuugacucuccaaaaacuuaacacuaauaaccuccuguugaccagagcuuuaccaauaacauaaacaaucauucaacacauauuuuguauguuauguguauucuauacuguauucuaauuuuuuuuuagacaggaucuuacucuauugcccaggcuggagugcagugauacuaucauagcucacugcagccuugaacuccugagcugaguugauccucccaucucagcuuccugaauagcuaggacuacaggcauguaccaccaugcccagcuauuuuuaaaguuucucucccuuuuuuuuuuuuuuuuuuuuuuuuaaagagaugaggucucauuuauaucgcccaggcuggucuugaacuccugaccacaagcagucaucccaccuuggccugucaaaguguugguauuacacaccuggcuuuauauuguauucuuacaauaaaguaagcuagaaaaaaagaaaauguuauuaagaaaaucauaaggaagagaaaauauguuuacuauuuaaauggaaguagagcaucauaaaggucuuauccucauuaucuucuaggcugaggaagaggagggguuggucuuucugucacagagguagcagaaaauuuguguauuaauggaccaauacaguucaaacccagguuguucaaggaucagcguacuucuuuugacagugaauuguuucuuucauucccauugcccaggcuagagugcaguugugcagucacagcucacugcagccuugacuucccagcucaggugaugcucccacuucagcgucccaaguagcugggacuacaggcuuuugccacuaugucuggcuaauuacuugaauuuuuuaauagaggcaaggcuucaccguguugcucaggcuggucacaaacuccuggucucaagcuguuugccugccuggaccucucaaagugugagccacugagccuggcugaauuguuucuguuaaugugguuuuguguuaaauuauacuuuuuguccuucuuuaguagcuuaaucucuguuggucagcaaauuuuggcucaugucaacuggaacagcaguccccaaccguuuuggcacuagcagcugauuucagggaagacaauuuuuccagggaccaggucagccagggugggguuuaguuaaugguuuggggaugaaauugauccaccucagaucaucaggcaucagauucucauaaggagcacacaguguagaucccuuuauaugcacaauucacacuagaguucgugcuccuaugagaauuugcuacuauugaucugacaggagauagggcuuaggcaguaaugcuugcuggcucaccgcucaccuccuucucuguggccucauuccuaacaggccauggacugguaccguuccauggcccagaggcuggggacucuugaacuagaacacucaggacuuuuuuuuuuuuuuuuuuuuuuuugagacggagucuuggucuguugcccaggguggagugcaguggcacaaucucagcucacugcaaccucugccucuuggguucaagcgauccuuuuccucagcaucccaaguagcuggaacuauaggugugugccaccaugcccagcuaauuuuuguguuuuuguagagaugggguuucaccauguugcccaggcuggucuugaacuccuggccucaaguaaucugcccaccucagccucccaaaguguugggauuacaggcgugagccaucgugcccagccacucaggaggauuuuucuguagaaauuuuuguccaaguuucuuuuuuuguuuuagcuaaaucuaagaucuuucauuaaugccucauuacucaaagauguuacauaagaucgggcaaaaaucuguuuguaagcuaauguugauugauugauugauugagacgaaaucuugcucugucgcccagguuggaaugcaguggcacgaugucagcucacugcaaccuccgccucuuggguucaagugauucuccugccucagccucccgaguagcugggacuacaggcgccugccaccauaccuggcugauuuuuguauuuuuaguagagacgggguuuugccauguuggccaggcaggucuugaacuccugaccucaagugaucugcccaccucagccucccagagugcugggauuacagacaugagccacugugccgggcugucuuauuuauuaauuaacauuuuuggguaagguuuuucauacagcuacaaauucacuuuauugugcuguaacugaacucagauuuuaaaaaucauauucuauaagauuauuauugaaauuaauauuugaaugcuuuacuaaaaucggagugaaaucacaauuguauuuucccagacaacuaauccuguguuaggaguaaauaaugugguuaauuugucacauauuagucuuaaugagcuuauauggcuuuuaauuauuguugcuuucuuaucuacaaugucauaaaccauauucuuaaucacauauucuaaaauugcguugagugucuagacaaugcuugcuuacguauguaucuuaaauacagugucauugucuuuuucaaaauuuggguaggaguucacagcuaaaaccuauugaauauuaaccaucuuuugauguuuuauaggugagaacaacagacuuaaugaauuuagguaacuugcagugucaauaguaacaauaacaacaauaauuauaauaauaaccuacccagguuaaaaaauaacagugaagaccaauacgacagcuuuuacuuuuuuucuuuugagaugcaguuucacucuuguugcccaggcuggagugcaauggcaugaucucugcucacugcaaccuccaccuccuggguucaagcgauucuccugucucagcuucccgaguagcugggacuacaggcauguaccacuacgcccgcaacagcucuuacuuaugguuaguaagcaguuacuauuugccaagcacuguccucaguguuuaaaguguaauaauuuaagccuuacaaaccauaugagauagguguuacuuuuauauuacaaaugaggaagcugaggcacagggagguuaaauaauaacuugcgcaaaguuacuuaguuuuaaguggcaaagcuggagccuaguuuaccuggcuccagagccuacacuccuaaccacuguauacuacugcaucuccaauaaguggugcugcuaggauuuaaacucauauguauuuaacugauaccuguauuauuucuccuuuauuauugucugucaaaguggcuggacgcugucuagaaguccaagaacaagaugcuggccaacaugcuuccuucuuagaucucuguucuugacuuauagauggcugccccucacaccccucacauggucagucuucggucuguguauggucugugucugcaucuuuacagacacuggucauacuucuuuaggggccaccugaagaaauccuccuuuuuuugugcguguaugugagacagagucucucucugucgcccaggcuggaaugcaguggcgcugucucagcucauugcaaccugucuccuggauucaagcgauuucucgugccucagccuccuggauagcuggaauuacaggugugugccaccacaccuggcuacuuuuuguauuuuuaauagagaugggguuucuccauguugcccaggcuggucuugaacuccugaccuuaagugaucugccugccucggccucccaaagugcugggauuacaggcgugagccaccacaccuggccaagaaaacccuuuuaauuacuuuuuuaaaggcccuaucuucaaauacggucacguucugaaguauucagguuagggcuucaacauaaacuuugggguaacacuauucagugugaaugaaaucuuuggucucucaaauacagauuuugugauucaaagacuucagauuuaugaaauuaucagcaagauuauucaggaauuguucgugugcagccuuucugcuuuuuagcacaaugagauuucuaauauguaauugaaggccucacaacuaaaauauauuuguuuucuaccaugaaucucuguauuuuuccaaauauggcauuuccagaguuuucuucauaacaaaaugaccuuuuccucuauucuuaacuaaaugauguuacaguuaaggaucauaaauuuccauaugaaugcaguuuuaaugaaauaccuguuuuuagaccuuuuaacuguggucuacaaaaagaaacacauggcuaauacuuucaugugaaacaaaaaucacccuuaauuuaugugaugugcucugauuuuucuguuuuguuucuucuucuaaaggugauuguauuaauuuaaauugauuugauaauacauuaauggguuaaauuucuuaguuugaaaaacaugauuagaugaacauuuuuguucaaaaucuuuaacucugauuugccaaacuuuguaguuuuauuugggaauuuuccuccuccucuuuuuuuuuuuuuuuuuuuuggauggagucuugcucugucgcccaggcuggagugcagugguacaaucugggcucacugcaaccuccaucugcugguuuuaagcgauucuccugccucagcuuccugaguaacugggauuacaggcaugugccaccaugccuggcuaauuuuuuguauuuuuaguagagacaggguuucaccauauuggccaggcuggucuugaacucuuuuuuuuuuuuuaaagacggagucucacucucacccaggcuggagugcagugggaccauguuggcucacugcaaccuccaucuccuugguccaagcaauucuccugccucagcuuccugaguagaugggauuacaggcacccacuaccgugccuggcuaauuuuuuuauauuuuuaguagagacgggguuucaccauguuggccacgcuggucucgaacuccugaccucagaugauccacccgccucagccucccaaagugcugggauuacaggcgugagccaccgcgccuggccagaacucuugaccucaagugauucacccgccuuggccucccguaaugggauuacaggcaugagccaccacaccuggccuuauuaaguuucuuuaacuacuugauuaauugaaguaauuugccacuuacuauggaaugaaaaaaaaucagcucagacuaacugguggaauuuauggaggaaacgacaguuuaagauucauucauauucauucauucucuucccaccaccacacacacaagcauguauuuauauuuagucaugugucacuugacaaucugaaaugcacuaauuggcaauuuugucaucaugugaacaucauaguacuuaugugaaucuagaugguguauucuacuacuuaucuaggcuaugugguauagcuuuuugcuccuaggcuacaaaccuguacagaauguuacuguacugauuggccgggcgcgguggcucaugccuauaaucccagcacuuugggaggccgaggcgggcggaucaugaggucaggagaucgagaccacagugaaaccccgucucuacuaaaaauacaaaaaaaaaaaaauuagcugggcaugguggcgggcgccuguagucccagcuacucaggaggcugaggcaggagaauggcgugaaccugggagauggagcuugcagugagcugagauugcaccacugcacuccagccugggugacacagcgcgacuccgucucaaaaaacaaaacaaaacaaaacauaauguuacuguacugauuaucaugggcaguuguaacacaauguuaaguauuuauguuucucagcauagcuaaacauagaaaagaaacaguaaaaauagaguauuauaaucuuacgagaccacuguucuauauguggucugcuguugacugaaacauuguauggcacaugauucuauugccuugcucugucugcugaacugugugcacauagcacccagaucuugguuucuaaauacuguucuccacuaaaggaacuaggguucugucuuguuuuaugcauauauaauuaugucauaugccaaauaaugagaguuuugcuuacccuuugucaucacugggacuuauuuuuuucuucacuuauuacauugguuaggaucuguauuaccauguucaguagcaguggugagaacaacacccuugccuuguccuuaggggaagagaauuuguuuuaccauuagguaugauguuagcuagauguuuuucuuaguuaucuuuuauuaguugguggaaguucuuuucuauuccuguuuguaaaauguuuuuauuuuguuguugaguuuucucaaaggcuuuuuggcuucagauuucucuuauucuuuucuuauuuauuuauuuauuuuauuuuuuuugagacggagucucacucucucgcccaggcuggaguacaguggugcgaucucagcucaccacaaccucugccuccuggguucaagcaauucuccugccuuagucucccaaguaacugggauuacaggcacgugacaccaugccuggcuaauucuuuguauuuuuaguagagaugggguuucaccauguuggccaggcuggucuugaacuccugaccucaagugaucuacucgccucggccucccgaagugcugggauuacaggcaugagccacuguggcaggccccucuuauucuuuuaauguagaguaguacauaaauuuuuuuuugaauggaaaucguaacuuggaguugauuugcuggggauuuuuuuuuaagaauuuuuguaucuguauucauggaggauuucuucuguaguuuugucuugauuuguaauguuuuuaaauuuugggauuaagauuaagcuggugccauaaaacaaguugaggacuguuccuccucuucugaaagagcuuguguucgauugguguuauuucauucuuaaauauuuggcagaauucacuguugaauucuggagugggauuucuaaaauguaacuggaauuuucuuugugggguaucuuuuacuguaauuuaguuucucuaauauagaugagauuauuuagcuuuucucuuucuuguuuuagucauacauguuuuuaaggaauuuaaguugauuuauuugacaucauauuuuguugguauuuauuaauuuaauacugucuauagaauuuguaauggugcuccucuuuucauuccugaucuagauaauuuauugaucuuuauuuugaugagucuugcuuggguuuaucaauuucauuauucguucaaagggauuuuuaauauuaacuguucauucuguuuaauugauuuccacuauuuucaguauuuucuguuuucaguuugauuuacuuuuacuuuuguagcuucuugaagugagagcuuaaaucagauaucaguaaacauuuucuauaaauauuucagguaagaaauauuuuaggcuuuguggacaauauugucucuguugcagcuacuauucaacugccacuguagacggcuacauaaaugaaugaacauggcuuuggacacggguacaguaguuccccccuaucuuugguuuuguguuccauaguuuuaguuaccugugguugccagggucugaaaauauuaaaugggaaauuucagaaauaauugguaaguuuuaaauuagucaccuuucugaguagcaugauaaaaucuuacaucauccugcuccaucacaacugggacauuaaucaucccuuugcccgaguauccauauguauaugcuguacuccuguuagucacuuaguagcuuucuuguuuaucauaucagcuguguagauaccacucuguuuguauucaauuaauccuuauuuuacuuaauaauggccccagaguacaagacuagugaugcugauaauuguucuauuuuauugguaaucucuuacugugucuaauuuauaauucaagguuuaucauagguguauauauauggaggaaaaaacaguauauguaguguuuggcacugucugugguuucagacaaccacuggaggguuuugaaaggugucacgugagcauaagggggaacuacuguauuugaauuucauauaguuuucaugugccaugaaauauuauuguucuuuugauguauuuaccuccaaccauuuauaaguacaaaaaauauuuuuacuuucuugcccauaugaaacaauuagugugcugaauuuugccuauggcuguagcuugcuacuuccuugauuagaacauuaauuuuacacuauuuuuuuuucuaauguagguauuuaaagguaugaauuuuaaaguauuccuuucucuauaugccauauauuuugauaccuuauuuuuuauuacuucauuuuucuugugauuuauuuugacccauggauuauucauuucgauucaagaauauuaauauacucuguauaauuugauuucuuugguauuuuuugguacuuacuagcacauauucuaucuuguugaauguucuauauguauuugggaauauaugugauauuucggaguuguucagugcaguauucuauaaauaucaauuauauccaaaugguugauaauauucuaauuuucuauaucuucuuuuaaagugaaagcaaguuuauuaaagaaguaaagaaacaaaagaaugguggccgggcgcgguggcucacgccuguaaucccagcacuuugggaggccgagguggguggaucacaaggucaggagaucgagaccuuccuggcuaacacagugaaacccugucucuacugaaaauacaaaaaaauuagccgggugugguggcaggcaccuguggucccagcuacuugggaggcugaggcaggagaauggcgugaaccugggaggcggagcuugcagugagccgagaucacgccacugcacuccagccugggcgacagagcgagacucugucucaaaaaaaaaaaaaaaaaaaaaaaauggcgacugcauagucagcuaucuuauuuuuucauguacuuguuuuauugguuauuaagagagggauguuaaaaucacuuauuuuugugcauuugucuacuucauuaucugucaauauuugcuucauguauguugaagcuucauguauuuauaagcguaugacuuguucuuguuaauauuaugauguaucucauuaucucaagugauauuauuuauuuugaaguuuauuuuaauauugauauagccauacaguuuucuuacuuacuauuugcaugauauauguuuuuccagccuuuauaaaaccuguguguauauauuuacauuggcuuuuuuuuuuuauuuuaaagacagagucucgcucugucacccuggcuggagugcagcugcgcaaucuuggcucacugcaaccuccaccuccuggauucgagcaguucuccuaccucagccucccgaguaagugggauuacaggcaccugccaccacucccagcuaauuuuuauauuuuuaguagagacaguguuuuaccauguuggccagccuggucuugaacuccugaccacagaugauacaccaaccuuggccuccuaaagugcugggauuacaggugugagccaccacgccuggccuacauuggcauauuuugucuauuuauauuuaauguaauuauuaauauguuugaguuuaaagucuucuaucuuacuauguauucuggauuugucccaucuuuuguuucucuuuuccuuuccugucauuugagugaacuagcuauuuuuuagaauuuuauuuauccuccuauauccuauauugacuucucaaaaaaaaaccuuaaacacaauaaaauacaccuguucaaaguguuuguuuucuugaauucugacagauuuaugcacaugaccaaaaaguauccuuauuuuauacccaacaucaccugagacaaccacugaucuuucugucauuauagaguuucauaggauuauaaucaguuuaucuugcuuccuucacacacacaacauacauuuuuugguuucuuccgcguuaccacauguaucuguaguugauuccuuccccuccccuccccgaguaguauuccugugugugagucuaccacaauuugucuauuuaaguuguuucuguuuuuuggcuauuauaaauaaaguuguuaggaauauuuggauaaauaagauugauauugcuggaucauaagauguaugcuuaacuucuuuguagcagcuuuauugagauauaauuuauauaccagaaaauucacccauuuuuuugaaguguagaagcuuuuauuuacuuauuauuuuuugauauaaaaagcuguacuuaauguauacagcucuaugaguuuggggauaaauauauuccugugaaaccaucaccaucaucaaggccaucaacguaucugucaccucccagaguuuacccugccccuuuauuaugaucuacuaucuuagaaaacuuuaaauauguaauauaguauaguuaaguauaggcacagcacuauguuguauaguaguaucguucauucauucauuuaaaguauaaauucaguagcuuuuaguacaugcacagaauugugcaaccauugccucaacuuuagaauauuuucaucacccucaaaagaaaccucuagcuccuaaauuuccccuuccucucuagcccuaagcagucacuaaucugcuuccugucucuauggauuuugcuauauuuuggacauuucauguaaaugaaaccauagucuauuaugucuggcuucuuucacuuagcauguuuucaaagugcauccauggugcauuuguucucaggaucuccuggggcuguguccugggaauugaauaaaaauuaaaaaaaaaaaaagagaaaaaacaaaguacauccauguuguggcauauauuauaucacuauuuccuuuuuauugccaaguaauauucuguuguauggauauaccacauuuugauuauccauuuaucaauuaaugaacauuuggauuguuuucauauuuugaccauaugaagaaugcugugaacauucauguauacauuuuuguauggacaucuguuuuccguugucuuggguaagagcuugaauugcuggguuauaugauaacuuuguguuuagcuuuuuaaggaacugccagacuguuuuccaaagugguugcaucauuuuacaguuccacuagcaaaauaugaggauuccaguugucuugaggacaaucaacacuuguaauugucugucuuuuuuauuauagccauccuagugagugugaagcaguaugucguaguuuugauuugcauuucccuaaugacugaugguauggagcaucuuuuuuaugugcuucuuggccauuuacauuuucuuuagagaaaugucugguauuuuaauuguauuauuuuuauuauugaauuguaagaggugguuuuuuuuuuuuuggcaugaucucgguucauugcaaccucugcuuccugggcucaagugauccuucaccucagccuccugaggagcugagacuacaggcaugugccacuaugcccagcuaauuucuuuccccacuuuuuggagacagagucucacuuugucacccgcuggagugcaguggcgcagucuccauucacugcaacuucuaccuccuguguucaagcaauuccccugccucagcccccugaguaccugggauuacaggcacaugccaccaaguccaacuaauuuuuuuuauuuuuaauggagacaggguuucaccggcccaggccgguuuugaauuccugaccucaggugacccgccugccuuggccuuccaaagugcugggauuacaggcuugagucacugcgccaggccuaauuuuuguauuuuuuguagagacaggguuucacuauguugcccaggcugauaucaaacuccugggcuuaagagaucauccuaccuuggccucccaaagugcugggauuacaggugugagccaccacacccagccaugaguucuugauauaaucuagauacaagucccuuuucagagauaugcaaauauuuucuucuaugcuguggacccuuucugaaacacagaacuuuuacauuuugaugaaguccacuuuguuuauuuuuuauuuuguugcuugugcuuuugguauauccaagaaacuauuggcaaaaucagggugacaaagauuuaucccuagauuuucuuuuuuuuugagauguaaucucgcucuaucgcccaggcuggagugcaguggcacgaucucagcucacugcaagcuccaccucccggguucacgccauucuccugccucagccucccuaguagcugggacuacaggcgcccgccaccacgcccagcuaauauuuuguauuuuuaguagagacgggguuucaccguguuagucagaauggucucgaucuccugaccuugugauccacccgccccggccucccaaagugcugggauuacaggcgugaaccacugcgcccagccguaucccuagauuuucuuauaugaguuuuauacuuuuagcucuuugauacauuugaguuaauuuuuauagauggugugagguaagaagucaucuucauuauuuugcauguucauuuucauuaagucccagcaccauuuguugaagacacuuuuuaacuuuugagaaacugcccagcuauuucaccgucuaacauuccauuuaacaauuucaagcaguuucccuugcucacauucuuaccaguauuugauauuguaagucuuuuuaacuuuagucuuucuacagggguagaguaucuuauuguuuuuaaccugcauuguuuuaacuuccauuuccgaggcucaggugauccucacgccucagcuagcugggacuacagguuugcaucaccacaccgggcuaauuuuuauauuuuauaagagaugggguuucgccguguugcccaggcuggucuccaacuucugggcucaggcagucuaccugccucgccuucccaaagugcaaggauuacaggagugagccaccacccacagaauguuaagacucauauauaaaggccgagauuuaacaguuuuacagcuucaucaagaacuuucuuggggccaggugcgguagcucacgccuguaacgccuguaauccuagcacuuuaggaggccgagaagggcagaggguggauugccugagcucaggaguucaagaccagcuugggcaacauggugaaacccuaucucuaauaaaguacaagaaauuagcugggcauggugguacacgccuguagucccugcuacucaggaggcugaggcgggagaucgcuugaacccaggaggcggagguugcagugaguggagaucgcaccacugcacuccagcuuggguaacaaagugagacucugucgucuuuguuuuaaaaaagaagaaagaacuuucuugagaggaacuggcucucccaacuugcuaaacguggcuauaaagaaugcaaugggccaggcuugguggcucacgccuguaauuccagcacuuugggaggcugaggcaggcggaucaccugaggucaagaguucgagaccagccuggccaacauagugaaacuccaucucuacuaaaaauauaaaaauuaaccgggcauggugacacaugccugucaucccagcuacucgggaggcugaggcaggagaauugcuugaacccgggaggcagagguugcagugagccaaaaucacuccauugcacucuagccugggugacuccaucucaaaagaaaagaauacaaugacuguuggguuucagugcguugauuugucuuaagguaccaguuacuauauacaccguugcucuugcauagcuagcacaaauguuaacacaaguuguucuagaauggacugaaagacaauaaauaaauaauaaauaaauaaauggauucaccacuuuuguuuguuaccaugcauucacaguaacaaaacucuuugcuaauuaguuggugcugguaucaaauaaauacauguaggcaaaauaccaaguccggccacauuaauaaggcacagaaguacaauucucuacauacuagauauuacuucuuuuuuuauguuugcagauaaaucuuucauucagugauuuaacuuagcauuggaaagugggagggcaugcuucuuuuacugacuuuuuaucuagcagacuuucagcacuaucuacuaugcaaagauuuaucucucugauauuguuuaccccuuuucaaccaaugcagugugauaacuuuaagauucuucaggccgggcgugguggcucacgccuauaaucccagcacucugggaggccgaggcagguggaucaccugaggucaggaguucgaaaccagucuggccaauauggugaaaccccaucucuacuaaaaauacaaaaauuagcugggugugguggugggcaccuguaaucccagcuacucgggaggcugaggcaggagaaucgcuugaacgugggagguggaguuugcagugagcugagaucaugccacugcacuccagccugggcaacagaacaagacuucgucucaaaaaaaaaaaaaaaagauucuucagacgcuuuuucauuuuuaguuugaaaaacuaaccacuuuuugcuuuuaaagaacucauuauguauauauuuaaaguauuaaauuccuuuuuaaaaaacucauucucaaaugacaguauacuaaauugucaccauuuaaauaugucucaucuauuuaaguauguucuauuacauaagauguaguaagacaaccuuaugcagccaaagggaagauaucuuuaucaugcuuucauuugcuauugacaauugcaucaagagucucuggaauagauuuacugcuuugugagucagagaauccugauaugucaguuucuuauuuuucagcagugcaccaauggauugaaaucacagcucuucuuaccucccuguuguaaccuaaugauucauuauuaaguauuaaaaaguuacauuuuuuuuuauuuugagauggagucuucgcucugucgcccaggcuggagugcaguggcacgaucucggcucacugccagcuccaccucccggguucaugccauucuccugccucauccuccugaauagcugggacuacaggcgcccaccaccacgcuggcuaauuuuuuguauuuuuuaguagagaugggguuucacuguuagccaggauggucucgaucuccugaccucaugauccgcccgcccuggccucccaaagugcugggauuacagucgcgagccacugcacccggccacaaauuuuauuuuaaaauauuacuaaauucugaaauaacuuuuauguaaaacuuaaaauuuagaaguaaauguauuuuaaaugaauauauuauugcaaagcaaaagcagaagaguacucuugcuguguuuucacauaaauauauauauacagucaggugccagguaaugauguuuaggucagcauggaccaccuuaugguccaauaagguuauaauaccauauuuuuacuguacuuuuuucuguguuuagguacaugaguacuuaacauuuuguuauaauugccuacaguauucaguauaguaguuugccgaacagguggguugccuagagcgauaggugugugguagauaauaucaucuugguuuguguaaauacgcuguaugauuguacagugauggaauugcuaaagaugcuuuucucaaaacauaucccaguuguuaugugaugcauuacuuuauauagaaaaauuuugaaauugcaaaauaauaauuuacuaaaucauaaugaaguuacagagauuauagcagguacaacuagauaauuaguaagagcacaguagaagugcacaacacaagguugggcaccauggcuuaugccuuuaauccuaggacuuuggaaggcuguggugaaaggaucgcuugagcccaggauuucgagaccaaccugugcaacauaguaagaccucgucuuuucaaaaacuuuuaaaaacgaauuagucaagcguggugcugcacaccuguagucccagcuacuucagaggcugaggugggaggaucacuugaucccaggagacaaaggcugcagugaggugagauugugccacugcacucuagccugagugacagagcaagacccugucuuuaauaaaaaggggagaaaagggggccaggcucaguggcuuauaccugugaucccagcacuuugggaggccaagguggguggaucccuugaucucaggaguuccagaccagccugggcaacauagcaaaaccccgucucuacaaaaaaauuuuguuuucaauuugcuggacuuggugugugccuguagucccagcuacuugggaggcugagguggaaggaugacuugagccugggaggucagggcugcaguuagcuaagaucgugccauugcacuccagccuuggugacagggcaagacccugucuuuuuaaaaaaaaaaaaguacuugccaggcacgguggcucaugccuguaaucccaccacuuugggaggccaaggugggcagaucaccugaggucgggaguucaagaccagccugaccaacauggagaaacccugucucuacuaaaaauacaaaaaauuagcugggcaugguggcgcaugccuguaaucccagcuacuugggaggcugaggcaggagaaucacuugaaccugggaggcagagguuguggugagccaagaucgugccauugcacuccauccugggcagcaagagcgaaacguagucucaaaaaaaaaaaaauacuuaacacaaagauauuuuauauguauucacauauuuuccauuauguuauucacccaacgcauuuaggauuuuaucugguacuauuuaucugaugccugcagaacuuuauuuaguauguguuucucaccaauuuucuuaguuuuaugucuacauuuuuugagcacauacucauuacaugcuauccuuuauucaaauuuggcuuaguucuacagguucuccaucuguuugaugugcuugauguuuaugauuagucuuagcaucauugucugaagcucauuuuuguagugaauuccuuggaaaagauugguggggcugagcaugguggcugaugccuguuaucccagcacuuuugggaggcugaggcaggcauaucaccugaggucaggagcuugagaccagccuggccaauauggugaaaccgucucuacuaaaaaagaaaauacaaaaauuuccucagcgugguggcaggcaccuguaaucccagcuucucgggaggcugaggcaggaaaaucgcuugaacccgggagguggagguugcagugagcugagauugcaccacugcacuucagccugggcaagaagagcaagacucugucucaaaaaaaaaaaaaaaaaaaaaaaaaaaaaaagacucaugagaagcauauucugagcuuuugcauguugauaacagugcccucuaugcuugaaaaucaguuuugcuggauauaaaauccuuaacucacauuuuuucuugguuauuuuaaauguuauucuauuuucuuccaacaugaaaagcguuucugucaaacguuugauaauauaauuuuuuuuaaguugcuaaauuagaacaugucuuggauugaccuggggcuugguggcucaggccuguaaucccagcacuuugggaggccaaggcaggcagaucacuucaggucaggaguucaagaccagccugaccaacauggugaaacccugucucuacuaauaauacaaaaauuagcugggcgugguggcaggcaccuguaaucccagcuacuugggaggcugaggcagaauugcuugaacccaggaggcggagccacugacugcacuuuagccugggugacggcugucuagccugucucaaaaacaaauaaaaaauaauaaaacgugucuugaauugacaugccacuccuggcuuuuacauuuucuucauuuguuuuuaugucugucuucauuucuuuaaaaaaaaacaaacaaacaaaaaaaaaaaaacaaguuuucucccuugccaggugugcuggccaucagcuauaguccuggcuauucaggagguugaagcaggaggauugcuugaaccugggaauuugagaccaguuugggcaacuuagugaaacccuggcucucaaaagaacaaaauuguucauuuuacccucuuucuuauaagguauaaucuuuuguuuacucucuugggccccuuguaguauagucuuuauuucugaaaugauuuguaaaaauuuuugaauuuuuuuguucuguuucuuaguuucugaguuuuucuuccucugcuguaugucucauauuuucuuuccuuuuuuuuuuuuuuuuuuuuuugagacaggaucuugcucuguugcccagguugcaguggcauggucauggcucacugcagucucaaacuccugugcucaggugauccucuugccucagccucuuugaguugcagggacuauaggcacaugccaccaugauuggcuaauuuuuaaauuuuuguguagaaaugggaucuugcuguguugcccaagcugaucucaaacuccuggccucaagugaggcuccugccucgaccucccaacgugcuagaauuacaggccuccacaccagccucauauuuucuuauuuugccugauuuugaaauagaagauuauaauuuuuaucuuuucccuaugcaucuuuuucugacacguguucuuuaucuauagagguauuguucugcuccacguguguuucauuauaguaguuuugugugggauuugauaucuauacuuucuugcucauuuuuaugugaaauuaguuuuucugaauuuucagaaaguuauguaguucaggguaucucuuugaacaaauuuuguuuuuauguaguguuuuuaaauauuggugaugcuuuuugaguuuugucuuuuauuucuaccauguguuuauuuggaauuucucugucuuuucucucugugccugcccuacucacauuugauuccacucccaauacuuccuccuaaguauggaaacuuguucuagaagggcgccauaguuggucaguuucaagaguucauaggagcagacuguuccugucauuucaauucuagccauagacccccuaugcuauuggauuggacagcaacuccccaacuccccucccccuuauuucauuugcuguucucaaauuggccugccgugguuuccagugacuaccuaccuguuagguauuuggggcuucuuuucucaggugugccaccucacuuguugcuuauuucuguuuuccuuugcacugguauauauggacauuuaguuauugugccuguugguuuguucucaucugcuugcauuuuugagugugggggauaccuugucuucugguuucguuguaaauguugcccauggguuuuucuugccuuuucaguucucuguauuuacauggggauucauauauuuaagaacaccuucccaucauuuuccccuuaauuaccuaucuuagagacaacuuugaaaaauacaaauuuugcacugagguggaaggauagcuugaggcuaggaguuugagaccagccugggcaacauagcgagacccugucucuacaaaaaauaaaaacauuaacagggcgugauguuaugugucuguauuccuagcugcuugggaggcugaggcaggaagaaugcuugagcuuacgaguuugaggcuguagugagccaugacugugcuacuacacuccaguaugggcgacagagacccugccuccaugaaaaaaagaaaaaagaaaaauacagauuuuagagaagacauuguaggauuacuguauuuagugaaacagcuuauauaguaauguagaaacugugucuuuccuaguucgucuuccucuucuaaaaaauccuaccauguucaaaguauacccaaauuuuacaguugaauguucacagaagacuaggauugggugacaaauugucauucagaauuggaucaucaggcugggcaccauggcucaugccuguaaucccagcacuuugggaggcugaggcaggaggauugcuuggggcugggaguucaagaccagucuggacaacauagcaagacccugucucuacuggggggaaauaaaaggauuggaucauuaggcauuucaaugaauuauucugaagaguaugauuuuacugucaaugacugcagaauuuuagucuugaccuuaauagcuuccucuuccguuuuuguaaccugaaguauuugaauguguucuaaagugaccgccuuauagucuguucugcaacaauauguggugccccuacaauaauauuauuuagcuuacucacuauugguaaacaggggaguaguaucaauaacauaguaggggggagggguuuguagaugauuuucuucuaaaccagacaacaaacugaauaauuagaguugaauuugauauucucuucaucaggaaaguaaaaagccuccaguucagcugcuacauaggcacaaguccuuucaccuguauuuuuauuuuuauuuuuugagauggaguuucacucuuguugccuaggcugaagugcaauagcaugaucucagcucaccacaaccuccaccucccggguucaagcgauucuucugccucagccucccaaguagcugggauuacagauauguaccaccaugccuggcuaauuuuguauuuuuaguagagacagaauuucucuauguuggucaggcuggucccgaacucccaaccucaggugauccgccugccucggccucccaaagugcugggauuacaggcuucagccacagcgcccggccuauuuuuauuuuuaauuaaaacugauaaucugcagcagauauucucucuccagagaggugcacccuggucuagcagggacucuucacauguggcaguuugcauuuccuuuuguacccaacuuaacagcagcccugcuggcuuaaagcuucacuuuucccauaagcccguuucuacuucauuguuuuuaguacccuuuauuauccccugagguagcauuccagcccucuuagcugccuuaccugcguagggauguccaaguuaucucugguggucccagucguuguuguuuuagagacagggucucacuuuguugcccaggcuggggugcaguggugcaaucauagcucccugcagccuugaacuccugggcucccaccugagucucccaaguagcugagauuacaggcaugugucaccaagcccagcuccaaucauuguuuuuguuagugcuaugguuacaaaguuacaggggcaugaacuaaucugccccaacauaccucucuccccuucuggacccauuuuuuccauaaguuuuguuacuuuuauuguugcagaaugcaagguuuucaugaauguauguauguauguuauagcagcuguacuaggacauuucagggggaggcuaggacuuaauguaguugaaacugcuguauuauuucuguucuucaaagacuuuauaaagagagcuccuguauuuuuugauaaugaagauuccauguuugugauaggaggcucccugauccucauuuuaaaauacaggagaauaguacauggucagaauuggaaggauuuuauuguggaucacugaggcauuauuguaugcuauuguaauuuucaccauuuacaaugccaaguuuuguuucagaaauaaugcagcaauauccaacuuguagaaaauguauguuagugcauuuuauuaguugcuguaggguaaaaacauuaaauacaaaaaaguagagaugagaauguugauuauauguaucaauuauauauaauauguaaauuugaagaucuaauccuuaccaaaagauuucagguagucucauuaaaacaguaaggaauuauguagggcaguauuauaguaauacuagaaaaucacucauguggcuaggugcuguggcucaugccuguaaucccagcacuuugggaggccgaggcaggcgaaucacgaggucaggaguucgagaccagccugaccaauauggugaugcccugucucuacuaagaauacaaagauuagcggggcgugguggugcgugccuguaaucccagcuacucgggaggcucaggcaggagaaucgcuugaacccaggaggcgggcggagguugcugugaggcaugaucgugccacugcacucuagccugggugacagagucagacucugucucaaaaaaaaaaaaaagaaaaagaaaaaaucacucaugugcaugacucuagaaaaaauuuacaaaugaggcuggucacaguggcuuacgccuguaauuccaaccucgucucuacuaaaaauacaaaaauuagcugggcaugguggugggcgccuguaaucccagcuacucgggaggcugaggcaggaaaaucgccugaacucaggagguugagguugcagugagccaagaucacaccacugcaccccaaccugggcaacagaggaaaaacucugucucaaaaaaaaaaaaauuuacaaauuagaaaacuauauauauaaauaguaaaacauaaaucauccuaauggcugaaaguauacuauuuuaguccauuaguacugcaagaauaguauaaacuggucauggggacuugccccauauaagguagcaaauagagagcuuuguuaagggguagacucuauauuauuuauucugguaauugaauaauugagguaggcagugcggguguggcagugccaggccccaccuuuauccccacccucuauuuuugggcuauaugugacuugccagcacauucaguggggcucccucuccuacccugaguugcuuaaggaaauuaucucuguucuuaaggacacuucuaaaaaugagggaaagcuuuugaagauucagagcacauucuauaauucaauauuuugauagcauggaaaacuuaauggaccuuggggaagggaucugaauuguagggaugcuguaauuguauuuguauauuguaauugcauucauguucuuacagcccugucaaauuuuuucuguguugauauuaccuauaauugcauuuuguuuuuccuggauaugaaaagcagaggaaaguauauuauaccguauuuuuucauuuuaauauuguaaccuguaaggcagaaugauugugcuuaguguguuuuuuuuucucuuauaucuuaaggaagagagagaaaauccuucaaaacggaguagaauugaacgugauauagauaacaauuugaucacgucaacaccaagagcaggagaaaaaccuaacaaacagauaucucgaguaagacggaaaagucaaguaaauggagguuuguuaauauuuagauacuguuuuauuuagguguaagcagagaucucaccugacacauuucuuaucuauuuuuaaaacucuacuuugaggccgggugcaguggcucaugccuguaauccucacauuuugggaggccgaggucggcggaucauuugaggccaggaauuugagaccagccuggccaacguggcaaaaccccgucucuauuaaaaucacacacaaaaaauuagccaggcgugguggcgcaugccuguaaucucagcuacucagguggcugaagguugagaaucgcuggaacccgggaggcagagguugcaguaagcugagauugugccacuacacuccagccugggugacagagugagacucugucucaaaaacaaaacaaaacuacuuugaguaauuuuugccuuaauuuuguaaucuuuguauuauuaguaacaugaagugaaauaaaaaugugcuaauuugaaucuuacuuugaauuaaaguaaguaaagauagaguauauaccuuuaugcuauuuagcauaaaaauguauguggaucaacauuuugaacaucuaaauaaacucauuucuuaaagcaauaauaauugugacuuaauuuaauugaaauauauaccaaauuucuuccuagauuauucuacuuaagagcucagaggggacuugcaucacuuaguccaguagguuucaacuaggggugauuuuuuccuccaagggacauuugucaauaucuagagaccuuuuugguugucacaacuuguggagggguggcuacuagugucuacuagguggaugucagagauguuaaacauccuacaauacacaggacagcucuucaaaacaaagaauuagacugaaaugucaauacugccgcuguugauaaacucugucaauaccuuguugcauagcagagaaacuccucaaagucaaaaagaaggagaauagcauuaaggaaaagcagagacagcuauaaagaauaacacuuuagagcaacaguccccaaccucuuggcagcaaggaccaguuuuguggaagacaguuuuuccacugacagugaugggaaugguuucaggaugaaacuguuccaucucagaucaucagacauuaguuagauucucauaaggaucgcacaaccuagaucccuugcauguaaaguucacaguaggguucguguuccuaaaagaaucuaaugcagcagcuuaucugcagauaagguaguagaggcagagcucaggcguuaaugcuuguucaccuccugcucugcggcccaguuccuaauaggcugcggacugguaccaguggguaugggguuagggaccccugcuuuagaguauggaguacuguuuuaacgaaugcuaucuuaaacacagcagcaauuucuccccuugucucugcccagugcagcaauauaucuuuauuguuagaaaaaacaaaccaggagggagaaaaagacugagacaagacaagggggacaaaauagagaaagaaacaaguuaaaagaaccauagcaaagaaggaaauaaguguuguagacaucaaaaguugaggagaaucaaaggaugauuaauuagaacaguugauugauuuuacuuuuauauucuuaaaagaucuguggaacauuuugauuuacaggaaacuuaaaauuauuuucccuagccacucugagauggcgucucaguguccauaaguaauuuuugacacugcuauauauagccuuuugcuucaguagaguuauguugccucuauucauuucgcugucauucauuagauagaagcagaugugagggaagguuuuaugaauuagaaccguccuagaauguaaacaaaaauaaaauuauuuguguuuuaguuggugggaacuaguuugcuuguuuacaaagaauuuucuucauuuuguguuauacuguguugauuugaagccuuucagucuauagguguaaaucuacuuugaaaaaacucaguaaauauuagcauuauaaacacauugauacauaaagagcauuugacuuacgaguaauuuaccucaauguuucuuuaauaagcuuuccugaacauuaacauuaauuagcuuucgugaaguauuuugagggaaaaagaguuacuucuauaaugaaugauuuauaacacacuucugaaauucaguguuuucuagaucaugacuuuuuucuuguuucuuuuuuagaagcugguaguuaugaaaugacaaaucaacauguaaaacaaaauggaaaauuagaagauaauccuuccucuggcaguccuccaaggacuacuuuguuggggaccauauuuucaccugucuucaacuuuuuuucaccagcaaauaaaaaugguaaguauaaacuguuaacugugauuuggauuuuuuuuaaaaaaaugcauaguuuggguuuuuuuuuuuuuuuuuucuugagacgaagucucucuuuguugcccaggcuggagugcagugacgcgaucuccccgcucacugcagccucugccucccagguucaagcaauacuccugccucagccuuacaaguaggugggacuguagguaccugccaccaugcccggcuaauauuuuuuguauuuuugguugagacgggguuucaccauguugaccaggcuggucucaaacucuugaccuucaagugauccgcccaccucggauucccaaagugcuggaauuacagaugugagcaacugugcccagcaaaaaaauacauaguuuuuaaaaagaucuuuuuuauuuuauuagcauauuuugucaaugucucguguauguuuuccaccucauuaauaauauacagcuccuugggagcugggugugguggcugaugccgguaaucugaacucuucgggaagccaagacaggagaauugcucaagggcaggaguuugagacuagccugggcaacauagugagacccugucucuacaaaaaaauguaaaaauuauuugggcgugguagugcacgccuguaguccuagcuacuccagaggcugaggugggaggaaugcuucaauccagcaguuugaacccaggaguuugaggcugcagugugcugugauuguaccacugcacucaagcuuggacagccaaguaggggguccacguaaaaaaaaauaaaaagaauggaaugguccugucuucuggguggcagggguaguggcucacaaaaggcuugaaagaaaagccgaaucuggaaaaguggcaaaagccauuccagguagaaggagcagcaugcguagaggccuugcagcagaaaacagcauaguguauuugagagcuguuuguaguuuguaauugauggaacauugcauuugagaagggauaagguaggagagcuaugaagaagucauauaauagagcuaacauaguaagaugaugaacuuuauucaaguaugggauaauugaaaguuuguuuuguuuuguuuuuuuccccaaggugaaagcaauuuuauuaagaaaguaaaggaauaggccgggcaccguggcuuauaccuguaaucacagcacuuuaggaggccgaggcagguggaucaugaggucaggaguucaagaccagccugacuaacauggugaaaccaugucucuacuaaagaaaaauacaaaaguuagcuggaugugguggcaugugccuguaaucccagcuacucaaggcaggagaaucacuugaacccaggaggcggaggcugcagugagcugagaucaugccacugcacuccagccugggugacagagcaagacuccgucucaaaaaaaaaaaaaaaagaaaaaggaauaaagaauggcuccuccuccauaggcagagcggccugaaagguuuuaaacuggugaauaauacgaucagaucuauguuuuauaaagaucacuugggcaguaguguguagacuagauucugaagaggccauaggcagguagaacaauuaguagacuuguagucguuugugugagacuugaugagaccuuaauuguauuagagaagacaggaaggaucagaggauagaaaauagacacauuuuuggugcagauuggaggugaaagagaauagagaugaagauggcacaagaguagaagauucaaggaaaauaaaguuccugggagauagauaauugaguguaauuuggaccaugcugaguuugagaugccaugaaauauuuaaauaaaaauauucaggcugggcgcgguggcucaacgccuguaauccgagcacuuugggaggccgagaugggcggaucacuugaggucaggaguucaagaccagccugaccaacauggagaaaccuaucucuacuaaaaauacaaaaaaauuuagcugggcaugguggcgcacacccaccuguaaucccagcuacucaagaggcugaggcaggagaauugcuugaaccugggaggccgagguugcagugagcugagaucgcaccauugcacuccagccugggcaacaagagugaaacuccaucucaaaaaacaaaacaaaacaaaaaaaacaaaccccaguaguaauauuuuccccucaugcugaaguaaagaaucucugaagguguguauaucucugaagguguguacagaaauagaugucuggggaagaaggaguugaaguuugauagaguuuucuuggaaggaagagauggugucauuaaugauaguucuaguggaagggacuugggaagaauagugaagguuuacauugauauuuucuuugugugugucucugucucucucuccccaccccauacacacacaaccucucucuccacucccacaucugucucuuccccccucccccccaccuaccuccuccccucccccugccuuucccugucucugugucucuguuuuauuuggauuaugaccagucuuuguaauuguauuuuuuguuccauagccugcaacuagggucugagaagccuguugguuacguugauucaagagggauuucuugauggaugacaguggaggaaugagggaucaaggauacugaggcugccaguuugacaguguauuuaagugauacaccacgaagucuaacuagaugaggaggguugagaagaaguguuugagggacguguuuggaauuaaacagacuggccuuuaucaaguuugaagaucacauauaaugggaguaugagauauauaauuugaggguuaggagguugugcuaagugguuaauacaguauuagaauuuuaggcuucagaggugaaguuucucaguguuaauguccagguuauagcuaugguaguaacugauauagagcaguaugagugaaggugguuggagcugaagagggcaagaacuuugaggauuagucauuggaugagucauugacaucaucuguaauaacaacuagaaaaaauacuguguuaaauagagcaguaaacuaguagcuauguauuaaacuucuuugcgauugagaggauucuggcaguagaugguaggugccagcagugaggauaagugaagaauuauauagccaugugacaucagucucaaaagagcagacuuuuuuugcacauuaguggaaaaccagcgauuggauaguagcaauggagauaaaugaauucugauucaauuaguauauugguaugggagaauaaagagcauugagggaaggguaucagaaaaaccuuuuaggaaagagguuaaacuuaaagcaacaagggagaaggaauguucuguaaggaaguugagaauauuggagguuaauuuuuuuuguuauuuuuguuuaaaaugacauuuggaagauuccagaaggaaauggaaagaccugggauuauuauuuuuucuuuuuuaauugagacagggucuugcucugucacccaggcuggagugcaauaguacgaucaccguucacugcagccuugaccuccuucugggcccaagcgauccucccacuucagccucaugaguagcugggaucacagaugugcaccaccacacccagcuaguuuuuauauucuuuguagagacagccauguugcccaggcugguuuugaacuccugagcucaagcaaucugcuugccucagccucccaaagugcugggauuacaggcaugagucaccacaccuggcccagucuuuguuauugagauggaguuuugcugagaaauuauuuuuauaucuuuuaauuaaaagguucucaugauuaggggaacagcuaauuuuuugauaccucugguugaaaaauuacaauugcacacaugacuaggaugcagaaacuuugcucacaaauguuacucuagccuguaagucuuuauucuucauuguuugaaauagcuagcaaagauucucuaaaagcaauauacucagcuuuguuccugcaggaaugaucagucuaaauaaauauauuguacggugaugcugcauuuaguuuuucuaaauaggugcauuuuuaaaugaugauaguacacugaaucaugauuucaggaacgucaggaucagauucuccaggacaggcuguggaagcugaagaaauaguaaaacaacuugauauggaacagguggaugagaucacuaccaguacuacuacaucaacuaauggagcagcuuacucaaaucaagcaguucaagugagaccaucacuaaacaaugguuuagaagaagcagaagaaacaguuaaucgugauaucccaccccuuacaggugaagaaaauuucuuuucuuauacaucuucaugaguaguugauaaaaaauaacaguauuucauauuuuuucuuaaaugagcacauuauaugcauagguuuuucuuccuggaaguuaagaaaaaguuaaaauuggaaacaaagcuuugucccaaaaauccaaagucauuuugaaauugaaauuuuuuaaaagauuuugacuaaguauuagucauuuuacaguuuaauuauuacuacuaaucuuauugcuuggagaaauuuaauacaacuaacaaaauauaugcucauguuuaugaauauccuuauuauuauugcacaagucuuagacccuuaugucugaggucacuagcuagaggcagucucauaccuucagauuuguuugauuacaucaaugacauccccccaaaaacugcuucuguuccuagaucucccuauauaccuaaguuugcagccugacuuggaaccuuauaaaggccaaacauaauuauuggguuucggagccauuuguccuugaaauguggaaacauauggaucaggaauuucauuaccucugaguacugugguggauagacaggguacaagauggaauuguguuccaccauucuuaaaagcagaaauaaaacugaagaaggccaucuucuuauuagggcauggagauuuuaucuuaaauuuguuuuguuuguuuguguuuguuguuguuguuuauugugguaccagguauuugagagagcgcaguaaauauauauuaguuaagaaacauaguuuggggccaggcaugauggcuggggccuauaacccagcacuucaggaggccaaggcaggaggguugcuugaggucaagaguuugagaccagccugggcaaaagagccagacccugucugggguggagucucacucugucgcccacgcuggacagugcaguggcaugaucuuggcucacugcaaccuccaccuccuggguucaagcgauucgccugucucagccuccugaguagcugggauuacaggcaugugacaccacucccagcuauuuuuuuuuuuuaacuuuuaguagagaccagguuucaucauguugaccaggcuggucucgaacuucugacuucaaaugaucugcccaccucggccuccgaaagugcugggauuacaacugugagccauugcgcccggccaaaaaaaauuuuuuuaaauuagccggggaugguggcaugugccuguaguccuaauuacucaggaggcugaagugggaggauugcuugagcccaggaauuccagacugccgugagcuaugacugagccacugcaauccagccuaggcagcagagcaagauccagucuugggaaagacaaaagaaaaaaagaaacauaguuugguuuaaggaaauauaauauacagaugguuccugaguuacagugguucaacuuccaauucuuuuacuuuacaauggguuuaucaggguguuaaaugcauuuugaccuaugauauuugugacuuaugauggguuuauugggauauagccccaucauaagucuaggagcaucuguacuucucucagcuauaaaaaggaaacuuuuaaaaaaguaauugacacagcagaaaacauuuaaagaaaauaugauacaauuaugaaacuucuauauaaugcaauccaguaauaccaacgugaagagacaagcagcaaaauagguuuauuuuaaagucaucaagugaaagauucauauguauaauguuaaauucagaauuuaaaaauaauacagaaucuaacagucaaaucaauacaauuacguucauucuuuuguggguaauauuugcaauuuaacccaccuuugacccaucauuuuaugcuuauuacuuugcccagugguauaagacuaauaaaguauagacuaaaguucagggcuuuggcuuccuguucgauguuuguucuguauuuucaugcucuuguauaagccuuuuuauuuauuuuuucugacaacugugaagauggagaaaggauuucuguaacuuagcgguuucuagaagggaaaauuaagauauacuauaguugucacagucauucauuuauucucccagcauuuaugagcaccuuuuuuuuuugugauuggaacuguugaugaauugacuccugaggaguuugugaucuaauugaagagccaaauauacagaaacaucacuauacaguauggugagugcugcuacaaagaagugagcuaaaugacauggugugucacauugcaguuacucugauugggaugaucaugagaguauagauagaggcauuuaguaugagugacaaaaguauucuuuuccuuaacuuugagaacauagccaaagagaacaagaagguaggaagcuagcagcuguguuacuuuggacagcuuauuuaagcuuuugagacaguuucaaaaacaguuuucuuagcuuuaacauaguuuuuguaauacaagguuuugcaggcuaaaggagauaaaauaggcaaaauacuuagcauauaagcacuuaacaaauauucuuggcugggugccguggcucaugccuauaaucacagcacuuugggaggccaaggugggcagaucacuugagcuuaggaguuugagacuagccugggcaauauggcgaaacccuguaucuacaaaaacaacaacaaaaaaauuagcugggcaucguggcuugcauacuauagucccagcuacuugaagggcugaggugggaggauugcuugagccugugaggucaaggcugcagugagcuguguucaugccacugcacucuagccuaggcaacaaagugagaccugucucaaaaaauaauaauaaaauaaaaauauucuuucaucugagauuaauaggaacuugaaaugguaaaguuguuggagauuuuuuuuugugcugauuauuggaagcauaaugucagagaugaaaaaaaauucugcuuuacaucugaugucauccauuggacauacacaccacguugacucugucucaaaagguguuaauacaugauaauugcacaaaagauuaauuuuugucuugaaagacuauuaucuaccauuucauuucuauagaaagacuauagaaauuuuuauuggguucuacuuuaaauuuuuauaucugagacguuaccuauuuggcuuguaaguuaccuuugucuucuuacauuuaaguuauaauuauugucuuggaaaauucccagcauaauuucuaaagcacuaucaaaagauaagcucuuagcucaaacugggaaugaacuauggcaugcaauauagaauuacuucuugaucauuuuuaaguguuuauaaauuagaaguaaaauaguaagucuucuaagcagugauuuugaucagguacaguggcucaccagcacuugaggaggccuaggaaggaggaucuguucagcccaggaguucaagaccagccugggcagcauaacaagauacuuuuuugucuccacaaaaaaauuuuuaaaaauaauccagguguggugguacaucuguagucccaccuacuugggaggcugaggaggauugcuggagcccaggucgaguccacaguguuugcuccacugugcuccagccugggcaacagagcaggacccugucucaaaaaaaaaaagguuaaaagaauaauuucuggcuggaugcaguggcucaugccuguagucccugcacuuugcgaggccgggucaccugauguggaucaccugaggucaggaguucgagaccagccuagccaacaugaugaaaccccaucucuacuaaaaauacaaaaaauuagccgggcgugguagcaggugcauauaaucccagccacucgggaggcugaggcaggagauuugcuugaaccggugaggcggagguuacagugagcccagaucgcgccacugcacuccagccugggcaacagauugagacuccgccucaacacaaacaaacaaagaaaaaaacagaaugucugcauagaguagcauuucuuaauuuuuuguuuuucuuuuugagauggaguuuugcucuuguugcccaggcuagagugcaaugacacaaucucggcucacugcaaccucugcuucccggguucaagcgauucuucugccuuagccuccugaauagcugggauuacaggcaugugccaccaugcccagcuaauuuuguauuucuauagaaaugggguuucuccauguuugucaggcugaucucgaacuccugaccucaggugauccgccugccuuggccucccaaagugcugggauuacaggcgcccgccaccacuccuggcugcauuucuuaauuuuuuaagauuauagucguggccgggugcgguggcucacgccuggaauucuagcacuuugggaggccgaggccgguggaucaugaggucaggagaucgagagcauccuagcuaacacugugaaaccccgucucuacuaaaaauacaauaauuagccaggugugguggcacaugccuguagucccagcuacuugggaggcagagccugcagugagccaagaucacgccacugcacuccagccugggugacagagcgagacuccgccucaaaaaaaaaaaaaaagagaucauagucuugagauuccugggaacauacaguuuuuuaaaauaaaucuucaaagggcucaugaacuuuuuaaagacuguucaugguccgggcgcaguggcucacgccuguaaucccaacacuuugggagguugaggugcacggaucaccugggguuggguguuugagaccagccagaccaacauggagaaacccagucucuaccaaaaauacaaaaaucagccaggugugguggcacgugucuaaucccagcugcucacaaggcugaggcaggagaaucgcuugaaccugugggguggagguugcagugaguugagaucaugccauuugcacucuagccugggcgacagaucgagacuccaucucaaaaaaaaaacacaaaaaaccuacauuugggucuguugucagcauacauuuacugacugcguguauguacaaggcauuuuaugaacuauuaccccuauaagagcaccaugaaauuuuuuggugauuacauguaaacaccauacaauuagaagauuacauuuuuugguguauauuuuucuaguaauaaguaguagauuuuuucuuagcugauaaacaucuuaauucuagccaugaucugguuugccauuuuuucuauaguggucauuuuucccuuuagaucuaaaguuagaucuguauguuaauaaauuggcuuuuagguguuuacaaguuauuucugucuuuaaaauacacaaggcuuuaggaagaucuuagauagaagcaguaaaaauauauauuucaugaagcauuaaguaaaagcaacauuuuuucuuucacuauguuaaauagcaccaguaacuccagauagugguuauucaucagcccacgcggaggccaccuaugaagaagacugggaaguauuugacccgugaguugcuuuuuucucuuuuuuucuuuccuuuuuggagcaugaugagaguacguuauauauguggauugguggcuaaauaguauauugccaagauaugugaccuguagguauuugaaacuuuuaauggggcugggugcaguggcucaucccagcacuuugagagacccaggcaggcagauuguuugagccuggaguucaagaccaaccugggcaacguggcaaaaccucgucccuauaaaaaauacagaaauuggccggacacgguggcacaugccuguagucccagcuauuagggaaggugaggugggaggaucacuugagcccaggaggcagagguuacagugaccugugauagagugagacugucucaaaaacaaacaaacaaaaacagcuguuacuauuuuacagagauacuaauuuguauguuuucacuuuuauuaauauguuuuauaaguuuuguuuucuggguuaacugcuuuauagauuuuuaaaugggcugagcuuaguaauguucuauauguauaaaaaguaaaauguugaaauuuucuuaaaaucugauuuauagcuauuauuucaucaaacaugucccgccacugacagaagaacaacuaaauaggaaaccugcucuuccguugaaaacaagaagcacaccggaauucucccuaguuuuagacuugguaaguauauuaucuguagagguagagagaauaaaggggugaaauucuuuuuuagaaucaugcuuauguuagcuuucccuuuuuuuugucaggaucauguuuuccugaaggaccaaaaauaauuugggucaacuuaauuaaccauaugcaagaccauaacccuuuucuuauucuuauuuuuacauauauauuauaccaauacacuuuuuauuaauagucucaaaagcacaauuucuuauuuuuuugagauggagucucgcucugucgcccaggcuggagugcaguggugcgaucucagcucacugcaagcuccgccucccggguuuacacaauucuccugccucagccucccgaguagcugggacuacaggcgccugccaccaugcccggcuaauuuuuuguuguguauuuuuuguagagacgggguuucaccuuguuagccaagauggucucgaccuccugaccucaugauccgcccgccucggccucccaaaguguuggaauuacaggcaugagccacugagcccggccccaguaugauaucuugaugugauuuaaaaauuuguauuuuagggacugggugugguagcucaugccuguaauccuagaacuuugggaggccgaacuuuuggccgaucacuugaagccaggaguuugagaccagccugaccaacauggcaaaacccauucucuacuagaaauucaaaaauuagcugggcauggugauacacaccuguaaucucagcuacucuggaggcugaggcacaagaaucacuagaacccaggagacggagguugcagugagcugagaucauaucacugugcuccagccugggcaacagggcaagauucugucucagaaaaaaaaaugauauuuuaggguaccagaaaagcuuugaaaacaaugaucuccuaucauuugcuaaccaaauuuaauauauagucacauuuccccucugccucuugauuucuuauuaauuuugcauuuuuaaaaucuguuuacuuuuuuuaaggcuaguaaagugaagcccugggauugaggaaggaacuaauuucuugauauuaguaaaaauguaucucaugucauauuggaaaauauuuuauuauuaagcauuuguuacuggaacccuauaauugguacccuauauuuggagaugugguuuagcucucauagaaaauuuaucuuagccaggcacaguggcucaugccuguaauuccagcacuuugggaggcuccauucagcccaggaauuugagaccagccuagacaacauagugagacccacgucucuacaaaaaaugaaugagccugguguugcaagcguguagucccagcuacucgggaggccgagagaggaggaucccuugaggccaggaguuugaggcggcagugagcuacaauugugccacugcauugcagccugggcaacaaagugagaucucauuucaauuuuaaaaggaaggaaagaaaauuuaucuaggucaggcacaguggcucacgcuuguaaucccagcacuuugggaggccaaggcgggcagauacuugaguccaggaguuugagaccagccugaccaauauagugaaaccccaucuccacuaaaaauacaaaaauuagccgggcgugguggugggcgccuguaauuucagcugcuugggaggcugaggcaggagaaucacuugaucccgggaaguggagguugcagugaaccuagaucaucuggugcugaguaaaauuacaugaaacguaauuugugagauacuaaaacaucuacuuaaaguaagaugcuuuauaaaaaguuggaggauaaggaguuaaaugaacagaguauauauuuuuaauaauuagauucuacacuuacauuugcugauuguaaaaaaguagcaugcauguggguuuaacugaaaguuggcaacugcagaacucaaagccuugcuucucaaacuugagcaugugucagaauccgaagggcuucuaaaaacagacauuguugccaggcacgguggcucacuucuguaaucccagcacuuugggaggccaaggcauguuccugaggucaggaguucgagaccagccugaccaacauggugaaacccugucucuacuaaaaauacaaaaauuagccagacgugauugcuggcgccuguaaucccagcuacucaggaggcugaggcaggagaaucguuugaacccaggagguggagguugcggugagcugagaucgcaccacugcacuccagccugagagcgagacucugucucaaaaaauaaaaauaaaaaaaacacagagauugcugagacccauccccuccccugaguuucugaucaucagaagugagguuaacauuugcauuucuaacuaguucucaaaugauguuuauucugcuugcuaguccaggagcuauaccugagaacuagugacuuuagaaacuccuaccccaaauugcugugccacauauaguaauauauuauaaauguaaaauucaacauaugaaugggugcuuuaguguuuuggugauuaaggauaaaaguauccuuugaaguuucuuuuacuaucuuguuucauucaauuucuguuuuuuauuuuaaggaugaaacacuagugcauuguagucuaaaugagcuagaagaugcagcacuuacuuuuccaguccuuuuccaagaugucauuuaucagguaauuaaaauuuuuuugaugauuuuuggccugauagguaacauucugauaaaaaaaacuuuuguauuuuuuuuguguguaugugacauuaaauguguuuuucuguagaaguauaauggauuucaucaacauuuuaaugauuuauuaacaaaauuagcaucaugcuagauauuacauaaaacaacauuaauuuguuacuccaaaaaugcuaacuuucuuaccuugagaucucagcuaguuucauaaucuguuugccagcagguggaggcaggagcacugacaucauagauccucaagaggaacuugccagguuaacuccugguguuuuuguuuuuguuuuccaaaaauccaauuaauacaaagaaaacucauuccuuguugaucauuuuauuuccuauaguaguaauguggucugugaaaauuacacuuuaguacaucucuuuuauaauuaaucuuagaauuccaggacacucuucuaguuauuguuuuacuuagggcauuuuaguuugagcauuucucucucaucugugcugauggacagguaacagugcaaaauacaaauaucauuaacauuucacuguggauuaugugugcuggccauaguuuuuacuuuaagguuuuuccauuauuauaagauugaguuaauaauauaagugaauacacuuugaaaauugcaaaguacguuucuguuuuggagguuguuauuuaacuagcauuauuugcauuauauaauaguugaaagauugggaaucgaaaaguuuguugucugucaagagggagccagccuaaagauuaacuuaguaaagucacagagugcuugccauguggaugaugaaaauguguuugguuguuuaugugcucuuaaaggcaguuagaaugugguuauaguuuucuuggcagauaauaguugaugucucacagaaaccgugaaauuuaagaguuaaauagaaguuugugguucauggcuacuuuaaccuacuuugucuaguaaugaguuguaagaggauuuauuuuaguugucaguucuaguuuuaaccuaggguagguauuguagcuauggcaauaaauauuugaauacugaauucacuuuuuauguaagcugauuuuaguccugauguauaaucggggguaagcaaaauguacauaaaauuaaaagauuuaaagauuuuucuguucccuuucaaaacugaugauuauuugguuuaaggcaaguauuuuucuuaagaccuuuuuuaucaaauuuguuguucuuguuuaguggacuuuaaggacaggaguccuuguggcagauguaaauaguauagugauaucuuaguuuucucuuuuaagcucgauaaccuuguugggguuuuucuuuguuuuuugcuuuuggguguuuuucgugauugcauuugaaaaaaauggcuuuaaggcuuugaauuuggaaaggaaagcuauuaauugaaaaauauagauaaacaaugauuuugagaugacuucuuaagcuucuagguuugaaauugaaauuuauuucuuacagaugguuuuuguucuguuuauguaauucuuaguagugaauaagaaacuuaaguagguaaauuugauucuucccuuucaugagcguuucucuucaguaugaucauaaaauugaauuuuuuucuuacugcuucuaccauuucugcuuuaacucucuuuuuaaaguucuuauuauuucauguggaucuggauaguugucuuauuuugaauaaaaagcuucuagcagcauauaugacuaauuaaaauacuguauguauguacugcaucuaccucuguggaauucagacaacucuuuuucuuauguauucugaguuacacuuucugaaacugaaaaauaaaugaucuagccuaaaugagagcacagagcagguaguuugaaccuuauaagcuauagagaugauugcacuuuaauacgauuuaguuaccauaucacagacagaguuuaguuacuuuuuaguaaauuuuugaggauauccguaguuaauauuggguacauucccuuggauuucuuauuuuggcauagccauucugucuuuuaaaaaauaaaugaagaaaucuuuggguuaggguucccccaguuuucagaccagcaagcucccuuuaaacagggaaugaugucuuuuaaacuuucagugguguugucuccaucuacuggcaaagaagaaauauacacaagggucugagaugaucuaagagauauuggagaaaccacauuauuagguaagauguaacuuaaaucuuuaaccacuguacuaugauguggcccacuuaaagguagaaaucuguaaaguacugcauauacucuuauuuuuuaaaaaauuuauugaggugaaauuuacaugacaaaauuaaccauuuuuaaaugaacaguuccauagcguguaucuguauuauucuugaauguuaguuuuauagcauuuacauauauauguauauauauuuuauauguaaagaucaaauuuuucaucugaaagccagauggaguguccucuugggacuuauuuuacguuuuuuuucuuucugugguauauuuguuaugguugaccuauaacuaauuuuaacucuacauguuauuucuguuucauuucaaaauaauuuaauuguauuauauauguuuuaauaauugucuauaucagggguuggcaaccuuuuucuauaaagggccaguuguaaauauuuuagguuuuguggucccugucaugacugcuuuuugugcuauugcagcaugaaaguagccauggacaauacauaaaugaaaaagcaugacugugucccaguacaacguuauauacaaaaaucaguggcaggcugcauuuggccaccauaguuugcugauuccuggucuaauaauuaugagaguauauacaguaaauuuacauauucaaauuguaaguagaaguaaguaaucaaauguucaucaaaauucuuguaaauguauguagaaaauuuaaauuagauccacaguaaucugguugugggccuuuaaaguuuuuuuaaaaucaaaguuugagggaacuuugagguggccacuacucacauuuaaagauugccugacuuaaugauacguacucuucuuuugguugauauguaggaauaaacuugguuaaugcaagucuuagaauuuguaagcagguagauuauuguaaauuaguaccuugagguguaauuugaauuucauuucucuaggggauuaaaaaaaaaccugaaagaucuaucucaaauuaaaauuugauguauguuacuacugacacuauguggacuagacagaguauaguuuguauauggauaaaaagucauuugaaagaaccgacuuguuaaacgugaggaaauggcacucauauaggcaaaauuacaggcuuuuuguuugaaugggucuauuuuucuuaaauugguuuuuuuuuuacauuguuuuauaaucaguuauuaagaaaacauguauucauaaaaugguacaaaugcauuugauaucuggaaaaacaagugcaugaucacuuuuauugcacauguuuaaucuuuauauuuagccuauauuggcacuuugucaggaaauccaucucgugguguuacucaguuaagaggucuccacuguauuuaguuucuguuccugcagauccaccaauucaagacucuaggucaucucacucccucuuccaucccgaagaugacuucuauccacaagcaggagugaaucaaaagacauuuuucacuuagcucuugagcugaaccaccuccucaaugaccuuccucugucuccaucaagaacuggagcucaguuuuuugaagauguaauagaacuacucagcccaaauguggcugauugaagacaaaaagaagauaccucauauguuucaccacagugcagccaaacguaacuguguuguccaacuccucauucuguaaagcuuggcaggggcaucugauuuuugacucuguucaccaauaagacuuuagccagucaguggcuuucugaagaucaguaaaaucaacaaacuuugggucagcuguccagaaaucagauugugguaagcacucaaggacagauaggaucccuguagggagcuacuuguaaaagaugcuuuguuuuauuaguagagguugcuuuuaugggaaaaguugggggaagagguggauggggaaggccacgguuagcaaagcuuacccgcguccccauucuuucaguuuucuugggaaucuuacagcuuaggauaauuuucauaucacagaacaagagaaguagaaccaggugcaguggcucacgccuguaaucccagcacuuugggaggcggagaugggcagaucaccugaggccaggaguucaggaccacccuggccaacauggcaaaacccuaucuccacaaaaaaauaaaaaaaauuagccgggcgugguggcaggugccuguaaucccagcuacucaggaggcugaggcaggaaaaucacuugaacccaggaggcggagguugcagugagccaagauugcgccacugcacuccagccugggcgacaaagcgagucuccaucucaaaaaagaaaagaaagaacaagagaaguagagggucaguugcuucugucuccucuuuacagucuuuucuagaaaagucagcuuuauuuuugcuucaugaaggaaagaaaccaaucauuuaaauuuauaauuuuguaguaaauaccuaauuuuuuucucaaguucuggcuuaaauugauacuaaccaacaugcacauuguucuugagauucaucuacaaaaguagccuaaaaaaaacuuuugaggccggggcaguggcuugcuuguaaucccugcacugggaggcugaggugagaggaaugcuugagccugggaguuugagaccggccugggcaagauagugugagauccugucccuuccaaaaaaaaaaaauuagccgggcaugguggggagcaccuauagucccagcuacucgauaggcugaggcaggaggauugcuugagccaggaggcugagaaaucagacaaccauuucagggucauaguugcauaguauagaggauaaaacuaauauuuuagcuuguagggaacaauaauucaauaauuaauuguagaugaauauuaaaaauacuacuuuagaauaauuuuaaagucacuuucccauccuuauuaguauguuuaguuauugguacuaauuuuuucaucauaauuauucauuauuaauuggcuaaaaaaaggaaaagauacaaaugaaaccaauaguucucuauuucucaaaaauauggaaaaauauauuuuauggggauucuuugucuaaaauguaucuuucaaaauuaggagcaauucauuaaaauaaaauagaggccaggugugguggcucaugccuguaaugauagcacuuugggagcccuagguggguggauggcuugagcucaggaguucaagaccagccugggcaauguagugagaccuugucuccacaaaaaaugcaaaaauagguggcacacaccucuagucccagcuacuugggaagcugaggugggaagaucaccggaaccccgagagcuucaggcccuagugagcugugaucacgccacugcacuccacccugggugacagagagccagucucaaaaagaaaaaaaagaaggagaaaaaacauacgggccagccaugguggcucacaccucuaaucccagcacuuugggaggcugaggcagguggaucaccugaggucagagaguucgagaccagccuaaacaacauggugaaacccugucucuacuaaaaaaaagaaauuagcugggcgugguggcaggugccuguaaucucagcuacucgggaggcugagacgggagaauugcuugaacccgggagggagagguugcagugagccgaaaucgcaccauugcacucuaggcugggcaacagagcgagacucugucucccaaaaaaaaaaaaaaagaaaagaaaagaaaacauacuauguggaaaguucuuauuuaauggcuauaaauuuagaaggugugacaguugauuacauuaaauuggaggcuucauuuccuuugaaguuuagaguuugaguuuaaagguaacauuuuuguuuuacuaaaauggccauuguuuugacuaaacuuuuauuaauguaaauacaucaaguuuuuuaacauaugcaaauauauguacauacaauauaauggccaauuuuucccugaugaaaauuaugcuucauugguaacuuuuuuuuuuuuuuuuuuuuuugagacagagucucaaucuguugcccaggcuggagugcaauggcgcuaucuuggcucaccacaaucucugccucccagguucaagaaauucuccugccucagccucccgaauaacuaggauuauaggcacgugcuacugaggccggcuaauuuuuguauuuuuaguagagaugggguuuuacccuguuggccaggcuggucuugaacuccucaccucaagugaucugcccaccucggccucccaaaaugcugggauuaccggcaugaggcaugagccaccaugcccagccccauugguaacuuuuaauauaaaucauauaaaucaccuauaugaauacauuaagcuucauuuuauccuacuuugacuuuuuuuuuuuuuuuuuuuuuggaggcauggugucgcugugucacccagacuggagugcauugacacaaucucugcucacuauagccucuaucuuccaggcucaaaccgucuucucaccucagccucccaaacaguagcugggacuacaggaaugugccaccaugcccuuuuuuguauguuuuguagagacgggguuucucuguguugcccaggcuggucucaaacuccugggcucaagcaauccacccaguucagacucccaaagugcugagauuacagaugugagccaccgugcccugccuguacucuuuaaaaaauuucuuuucagguugauuucuguuugaguaagguuuugcaggaacuuuuuuuuugagacagagucucgcucugucgcccaggcuggaaugcaguggcacaaucuuggcucacugccagcuccgccucccagguucacgccauucuccugccucagccucccgaguagcugggacuacaggcgccugccacuacacccggcuaauuuuuuuguauuuuuaguagagacaggguuucaccguguaagccaggacggucucaaucuccugaccucgugauccgcccaccucggccucccaaagugcugagauuacaggcgugagccaccgcgccuggcuuuuuuuguuuguuuuuuguuuuuuuuuuuaaauaagacugagucucgcuacucugucgcccaggcuagaguaugguggcaccaucucagcucacugcaaccuccaccuccuggguucaagcgauucuccugccucagccuucugaguagcugggauuacaggcaugggccaccaugccgagcuaauuuuuguauuuuuaguagagaugggguuucaccauguuggccaggcuggucaugaacuccuguccucaacuaucugcccaccucggccucccaaagugcugggauuguaggcgugagccacugcacccagccgcaggagcuuuuaauuuagggauuuuuuguuguuuuguuuuuauuuuuauugguuuuaguguuuaccuauucaucccaaauuuauccaccuacaaauacuacccccagcaucugucuaccucuuauuggaauuuucaugaagcaaaagauuacuacuguaacaucacucaguggguuaugaaauugagaccacucuagggccuaccugaauaacccucuuucuuuggagaagguuuggguuuuaucuuuaaguucugguauugaugcuaagaacaugugaacuaaauuaaacaguuuacugaaacaguuuguuaucucccucuuccaaaaguauagauuuuggcuguagggcuuucucuuuggaauugagguugcccaguucugcccaauagaaucauacucacuccagcucuucuugugacugauuacuuuuaaacaaugagauagauaauaauagcuaauagcuauuggcacuuugaauguaccagacacuguucuagguacuuuacguguauuaacuuauuuaaucuucacaaccaccuuaugauguagauauuguuguuauauccuguauuuuauagauagggaaacugagguauacagaagaguuaaaaaauugguacagccacuuguacacuugugguaucuacugaugguaagauaagauuuuuucaguuaauuguagcaucucauucuuuuuuuuucuuuuuuuuuuuggagacaggguuucauucugccacccaggcuagaguacagugacaugaucacaucucacugcagccucaaccuccuggguucaagcaauucuccugccucagcccccugaguagccgggacuacgggcgagugccaccacgccuggcuaauuuuuguauuuuuuuguagagacaggguuucgccauguugcccaggcuagucucaaaacuccugggcuccagugauccuuucaccucggccucccaaaaugcccuagcauuuuaggauuauagacauugagccaccacaccuggcugcaucucauucuuuauguuccccaacuuuguuuauuuucuacuguuuuaauucuucuugcuuaauuaaauaagaaauagcaccuaccagucaucuuuuugauuaaaagaaaacagaugucauacucuaaaguggaugauuccuuggauucaucauuuuuuaaaaccuauugccacaauguagcaauagguuggaaggaugucauggaaaaaguuucaaagauguuucuuuuugaaaguuauggucugccgggcgcuguggcuagccccuguaaucccagcacuuugggaggcugaggcggguggaucacgaggucaggaguucaagaccagccuggccgagauggugaaacccugugucuacuaaaaauacaaaaaacuuaggcaugguggcggagcccugucagcugagcuauucgggaggcugaggcagagaauugcuugaacccgggagguggagguuguagugagcugaaaucgcaccacugcacuccagccugggugacagagugagacuccaucucaaaaaauaaaaaaagaaaguuauggucauauuaucugggccuaaaaaucauuuagaaauguuuuuccuaaaaagacucacauguaauuuuugggggggucauacuguuaaaauuaucuaugauauuagauuaagguuugauaaacuaguagaaauuacuaaguauauaacuugaaauuauauaauucgaugugaguuuuaauuuagacuuuaccacauaauauguagaaucaguuuauaaguggauuaucauuuuaaugacugccuuuuuuauuuuuauuuuuuuuauuuuuuaauuuuuuugagacacagucuugcuugaucacccaggcuggagugcaguggugugaucucagcucagugcaaccuccaccuucgcuguuccagugauucuccugcuucagccuuucaaguagcugggacuacaggcgugcaccaccaccaugcccagcuaauuuuuugcauuuuuaguagagacgggguuuccaccauguuggccaggcuggucuugaacuccugacuucaggugauccgcccgccuuggccucucaaagugcugggauuacaggcgugaccuaccacgcccagccaaugacuacuuuuuuaaaaauccagcuauguuaacuauuaauagccuuucaguacuaucuauauacaauuuuuaucuuaacacacaaaaaaauagaccaucaaguauuauucauaucaaguaguaguaguguaguggguuuuuugaaauuauauauauggcugggugcgguggcucaugccuauaaucccaggacuuugggaggccaaggcaggcagaucacuugccuugcugacaugucaaaaccccgucucuacuaaaaauacaaaaauuagccgguugugguggcaugcgccuauagccccagcuacuugggaggcugaggcaggagaaucgcuuaaaccugggagacggagguugcagugagcugagaccacaccauugcacuccagccugggcaacagggcgagacuccauuuaaaaauauauauauauauauucauuuucuguguaaaauuuaaauuuugguaaaaucaguucacaacaccuuuuuuuuuuugagacggagucucacucuguugcccagacuggagugcaguagcgcaucuuggcucacugcaaccucugucuccuggguucaagcaauucuccggucucagccuccccaguagcugggacuacaggugcaugccaccacguccagcuaauuuuuguauauuuaguaguauauuuaguagagacaggguuucaacauguuagucuggcuggucucaaacuccugaccucaggcgauccacucgucuuggccucccaaagugcugggauuacaggcgugagccaccaugccuggcaccacaacacucuuuuacagauauucugauagauuuucauuuuaaaaguuuugcauaaugaacauguucauaaaucuguaucuucaaguaguagucaaucuugaauaguuuuuuaaauauaauuauuucuuauuauggcuuuaggcauuauuuuuaaacuuuugacauuuuccacaauauauuugguuuacugagaaaauauuaaaauuauuuguacuauaaauaaaauauuaucgauuugaagaaacauguauacuagacugaaaugaagcuuuuggccuuugggagauuacauaauuuugaagagcugcaaguuucaagaagguaaaauacuaaguagagaaaggaguggauuaaggaaauguagaaaaugggaaguaggcagcucaggaaaggaaucuuuguaugagaguaaaauuagaagaaaaauggagcuaaugcuauuuguagaauagauuuugaagcauuuggaggcaugucuaugugugcaucugucuguuuuuguaucucugaccuaacacaauaaaguaaugguagucucaagaguuaaacucauuguauuauauguaccugacagauguucuuuauuuguucuuaccagacaguacguagugcuucuugacuuauauauuucuguucacgcuuaccuauauccaaauaacuuagacgcugcuggccuuaugucucaucucuacuucuguuucugagauuuuccuuugcaucacauggcacaaccccauguggcccuaaccccagcccaguaccuuucuacguuucuucccacuuuccucccucauucucugccugugucuuuuaauacugaaacaccuucuuguucacauggugaaucuguucugaggauaggaacuauuauuuucaacaguuacucuuuccauucucauaguaaagaaacacucuagcaauauauuccuuuaucuucagugccaccucuuauccccaguaaacaaacacauuuugaaagcaaugucaaauuuuaagaugcauguuauauuuaaguauaguuaaaguaguaguaugcacaaugaaguuauagcuuugaccuaaucuggaagucacuguaugagaaguuggaaaaugucaccuuugaacaauguuccacuuacuauggcuggaaaauauuguuaacuagacauauucuugugcaguggaauugugucguguucagaggcaauaaaucucaaagaggcccugcuuaucuuaguuuacugcagguugaauaucccuaauucaaaaaaugcgaaaucugaaaugccucaaaaucuguaauuuaucaccaggugugguggcugaugccuguaauaccuccccugggaggccgaggcggggagaucaccugaguucgagaguuugagaccagccuggucaacacggugaaaaccgucucuauuaaaaauacaaaaaugagccggaugugguggcacacgccuauaaccccagcuacuggggaggcugaggcaugagaauugcuugaaccugggaggcagagguugcaguaagccaagaucauguuacugcacuccagccugggcagcagaaugagacggucucgcaaaaaaaaaaaaaaaaaaaaaaaaagaaaaucugaaacuuagucgggugugaugggucaugccuauaaucccagcacuuugggaggccaaggcaauauugcuugagcguaagaguuugagaccagcuugggcaacauagugagauagugagagcccaucucuaccaaaaaaaaauuguuuaaagccaggcaugguguuaugcacuugucaucccagcuauguggaaggcuaagacaggaggaucacuucagcccgggaggucgaggcugcaguggccauguuugcaccacugcacuccaaccuagacaacagagugaaaccuugucuuaaaaaaaaaaacaaaaacagccugaaacuuuuugagcacugacaugacguucaaaggaaaugcucauuggaucauuuugcauuuucagauaagggacacucaaccuguauauggagcaagugauaauagggauauugaaaauaaaacauuuauauacaugaaaaaaugaaauauuuuugguuacuaacugcaugugagugaugaacacuggcaacaaguaaaagguucugauaguuuauaguuuaucaucuaccuugagauggaauucagaaaaaguauuggcagaauagauggguuguucuuaaccaucacaaaucuguuuugaaaagacucaguugauuaaaaugauuuuguuaguaaaauaauauacauaaaaaucuguuguuguuuggcuuaccaaagaaggugugugugguuuucaaucaaggcuacaaacuacaccaaauguuucaggaugaaaauguuaaaauugauuagaagaacaacuaucguuaaauuuuuuagaccucauccuaaacgauggugauuggaugcugaggauuugguucuuuuuuucugcuuugaggagggguaugugguuuacuuuguuuuugaucaucaagacugauaggauuaggccgggcggaguggcucacgccuguaaucccagcacuuugggaggcaggcagaucacuugagguuaggaggacaauguggugaaaccccaucucuacuaaaaauacaaaaauuagccagccaugguggcccaugccuguaaucccagcugcuccggaggcugggguaggagaauugcuugaacccuggagguggagguugcagugagccaagaugacgccacugcauuccagccugggggaaagagcaagacuccuucucaaaaaaaaaaaaaaacuaauaggauuaaaaacaaguaaaccuuuaucuagcccagagauggggacagagugauauuauuagcacaguaaugaucauucaaaauuugucuucuggccuggcuugguggcucacgccuguaaucucagcacuuugggaggccaagacgggcggaucaccugaggucaggaguuugagaccagccugcccaacauggcgaaaccccgucucuacuaaaaguacaaaaaguuagccggucguggugaugagcaccuguaaucccagcuacuccggaggcugaggcaggagaaucacuugaacccaggaggcggagguugcagugagccaagaucaugccauugcacuccagccugggccguaagagugaaacuccaucucaaacaaacagaauuugucuccuauaaguggucaguucuuaaggaaauucucuauuuugcccuaaaacauuccuagaacuagauuuuugucaugggggcauuuuugugugcauguauauggaugccagaauugaaacuccacuaagccuggguuugaauuuguugcuaccacaagguguuugguuuguuuuuaaucugaauccgugaaucuaguucaauaaauacuuguuauucgugguauuugaaauuauaauaguagucaccuuugaaugaaguauaguauuuuucuuucuguaaaauuuuguaacaaaaugaauacaauuuagaggagucagaauguaaauaguuuuaaugguugcucauggcuuuuugaauauuagauuauaggagcuauauuaaauguaggcaaagagagacacagaaauaagaaaauaauguauguaaagcaguucuguggguacuguagucuuuucugauacugaccaguagguuuugagaacuguuguguuugacuguuauaauuuuaaucucaaguagccaauagugcuaauuuagaugccacaucugagucauuaaauguagaauaggaagauugauuucugaaaaacugagguuauuuaaacccaucaauccagacgucuccuuuugaauauaauuuaccuugauauaaauuuaaaauagagauauuuuuagcaggugguuguuugaaggaauucugaguaauuauugaggaaggucauugagacaggucagcuagagguggacacaauaauuggauggaugcuaccuggcuggaagauggagcuuacugguggaucaaaaucucagagggaaacuuuccauuuuuagcuuaaauguuuauuaaaauuacauaccagugaaguacuguaugcugcuauuaguaaaaaugacuugaucaucagugauuauuauuaucccaccaaagagauugguuuaagugaucgcuuguaugugaaauauacuugguuugagugguacuuaguuaauauuucuauacuuuaaaacaugaacuuuuucauuauaaucaaaguuagaauacagcacaucuuaaaaagaagugguuucccauuguauguuuauuugcugaaacuuaucuuuguauuuccuuagguuuaugugagauuaagaccauuuuucagggaauuccuggaacgaaugucucagauguaugagguaaacaugcuuaagcuaauuacauauguauuuuuauuuuauucaauauaguacccauauuuagaccauguauaaugauuacuucuuuuccccugaauuuauagaucauucuuuuuacugcuucuaagaagguguaugcagacaaguuacugaacauacuagacccuaaaaagcaacuggucagguaaauuuaauuaagaaauaguggaaaugucugucacacugaucuaugaaauuacugauucuauuucauuuuaauggccauuuucaguuggcugcauauguguugaauggugaauauaaaugaauuuuuuaagccccuaaacucuuuaaaagaguuccuaaugauggaacuccagacagacguucuuuaaaggauacaaagauccagugccuuuauucacugugacaucuauauccucauuucuuuugggauuggggaagacggggguuggggggguuguguggaauuuuuccacguugugcaugauguuucaucuccauaugucucugagguaaugcauguuaauuuacuuuuuaauggcauagagaaauaaaaauuauuuuuuaacagaaaggaucaaauuaagcccuugcuuuuuuugaaagcaaauuuaucuuccauggaaagaaaauguuacaugaaucugauuggaaauuacaguggguuuagucacucagguuauccugacuggacucaguuccuugugugugcccugagccagcagaugcaguguuuuccugguuagugggagugccguggugauuuuaaaauauuaugauaauuaguuccauuauuuugucagcugaagugagauaguaagacugcagcagucuugcuguauccuuuaagaggagggguuaaucuuugaauuuuugaucaaaagcugagagagaugacacaaacggcucauaaaagcuuuaauagggccaggcgcgguggcucacgccuguaaucccagcacuuugggaggcugagucuggcuaaucaccugaggucaggaguucaaggccagccucaccaauauggagaaaccccgugucucuacuaaaaauacaaaauuuaggugggcgugguggcgcaugccuguaaucccagccacucgggaggcugaggcaggagaaucgcuugaacccggaaggcggagguuauggugagccgagaucgugccguugcacuccagccugggcaacaagagcaaaacuccaucucaaaaaaaaagacuuuaauagcuggguugguugguugguucguucguucuuucucucucucuuucuuucuuucuuucucuccucucucuuucucuauuucuuucuuucuuuuucuuuuuuuuuuuuuuugaggcggauucucacucuguugcccaggcuggagugcaguuugcaaucucugccuucugaguuuaaaagauucuccugccucagccucucgaguagcugggacuacaggugugugccaccacaccuggcuaauuuuuaguguuuuuaguagagaugggguuucaucauauuggccaggcuggucuugaacuccugaccucaagugauccacccacuuuggccucccaaacugcuggcauuacaggcgugagccacugcacccagcccagcugaguauaaauuuucuuaaauacuuuucccauguugucuuacuggaaaauccuaaaguguauuuucugcuguuaacaguaccuuuauuauucagugguugcaaguauacugaaaggcuuuuccuaauguucauauuuuggaagguuuuuuauucuaaauaaagcugugguaucuuuuguuuuuuaaucuaaagggucaaaauaaguaagcugcagucacacaaaugggaaaugguauuuucuguucacaaaaguauauuguaauuuaugcuaauuuuaccucacuuuacuaaaguauacccagugauuuuguuuugaugacuucauucauuauaaugauuucuguucagcaucuccaguauuccagggaacaguggugagcaacacaagcucuucccucuuggagcuuucauuuacuaaugaggaacaaaugauagucauguuaugacaauguguuauaaauuaacaauccucuuuuaaacuagauuuauaaaaccuacacacuugaggguuuccauuuguucuaucuagauguauuuugagaaaucugaaacaaaagcuuguuuuuuuguuuguuuguuuguuguuugaaacagucuugcucugucacccagccuggagugcaguggugcgaucuuggcucacuguaaacucggccucccagauucaagcgauucuccugccucagccuccugauaagcugggauugcaggcgcgcaucaccacgcccagcuaauuuuuguauuuuuaauagagacgggguuucaucauguuggucaggcuggucuggaacuccugaccucgugauccgcccacguuggccucccaaagugcugggauuacaggcgugagccaccgcgccuggccaacaaaagcguuucaaagaguagauugugagugcuauagggaauugucuguguuggugacaagguagacucuaagaaauuccuaugaucuaggcugagugccguggcucacgccuguaaucccagcacuuugggaggccaaggcaggcggaucacgaggucaggaguucaagaccagccuggccaacauaaugaaaccucgucucuacuaaaaauacaaaaaaaauuagcugggcaugguggcaggcgccuguaaucccagcuacucgggaggcagagguugcagugagccgagagucugccauugcacuccagccugggcgacagugggagacuccgucucaaaaaaaaaaaaagaagaaaaaaagaaauuccugugaucucuaaaucucaugaguuucuaacacaagucuguacucacauggaugaucugcucuuugaugacugguacaaauaguuuuuuucuaaaaaugcaaauacaugcuauacacccucagauuccugaaugaauaauuggaaggcuuuuacuguaauuuaauuaaaauaacuguaguauccacguacagauucaguugucuccugucucaaugaguuugccacuaucggugaagaggcaucaacagugacuugaauuuacaugcuguaucugccuuuccaguuuccucauaucuaaauguuuauagaaauaaaacagugaaucuuauuuaggcccaaccaaggcuugaauuaauuuacuuagucuuuuuuguuguuguuuuuucaaaguagaacugacuaaacuuucccggggccagaugaucguuugacugugauuauuaaaguuauuccuuauaauaagggggaaagaacugcuuauacauuuugucuguucguuaaauucuuccuuuuugccauaccaacuggcacugauaauuuuaagguugaguuuuuauuuguguguguauauguagauuuuuauuuauucuugguagcacugugacagauuuuguggguagaaaauaccaguuucuugaaauugcauaauuuaaaauacagguccaaauagguccuagauuuuguaaaauuguuagugugauuaagacacaaggaagacaacuuaccaauuauuaauauauacagaauagaguacuucaagguagaaaaaaauuauaugaaacaauuauuaguaauguucagagacuaguauuuugaguauaaauugagauuauaauaaucacuuuaguauuguaaaaccuuuaauagcuuucuaaaaugauguaguauuuuucuaugugagugaaauaucaguuuacauuuauaauacuugauacuuaaaucugaauuccucauuucacuuaaucuuuuuucaaaugaucauacacauauacuaaaagagggguguuuaggaaaaguugaaaugauggaauguuuuggucuuaggaccuuuucucaaaaaaaauaaggaaaucuaaaaagcauuuuuucaaaugccaacacaaaaacauuccuucuuauauuuucuauucuggcauguacagggauagggaggcugugugguccacugguuagagccaaggacugggagccaggaggauccuggguuccaaugcggggcuaaccacugacuuacugugugaccuugggcaagucacuugaccuccuuguuccucagucaaccaucuggaaaauugguuaaaaagcaggaccucgcugacaaccagaugcugcaucugagcugagcuuucuuggguaaauaaauuacaaaaacaauuuagaguuuuuaaucccccuuuauaauuuaauaauaacauuuugggauaaacucaaguucuuuaaggcauaguaauauuugguuguaagcuuucaguaauugcuuagaauuuuuauaguaaaauggcagcccaacgcuuagacccauauuuguguuugaauuuccuucaagagagaaaaucauauggcuuaaacuauaaagccuaugguguauauauauguguauauguucuacuuuuuagaaaguuuuuuuuuuuuaauuuguuuuuauuuuuauguuuaggcaccggcuuuuccgugaacauuguguuuguguacaaggaaacuauauaaaggacuuaaauauucuuggaagagaucuuucaaaaacuauaauaauugacaacucaccacaagccuuugcauaucagguaggaagaaaguugauaaacaaacucagauuggaaaaaauacaaugaagacacaugcugccaaacagaauaugaugggagaagaagaagagaauuuucacugguggaauuucccuuuaaugugucauuuuuuuagaauuagaaaugacaaagugguauauuccuuuuggaaaauuuuuacuuaaaugacaugcagcauaaaugaagaaaaaccugaguaagaaaacuauaagauaagcaucauugaauagcauucuuaucaguuauuaaaucaguaauuaguaauuuaaucauaaacauauuugaguacuauaguuaguuuauguucuucuggucugguuauuugguuuaauguucugaaauauuuucuuagacuauuuugucaauauauuuguacccuuuguuaauauuucuuugacguauaacuacaaauguagaugagucauccuuccuuccuuuuguuuuuuuguuuuuuuuuguuuuuguuuuuugagaagcaguuucacucuuguugcccaaacuggaguggagugcaauggcgugaucuuggcucacugcaaccuccgccuccuggguucaagcgauucuccugccucaaccucccgaguagcugggauuacaggugucugccaccacgccuggcuaauuuuguauuuuuaguagagacgggguuucuccauguuggucaggcuggucucgaacucccgaccucaggugaucgccugccucagccucccaaaguggugggauuacaggugugagccacugcgccugccugaugagucauccuuucaagguauauuuuagauuaugaauauguccaugugauaugauuucuuuuuucuuuuuuuuguuuuccuuuuuuuuuuuuugagacggaguuuugcucgucgcccaggcuggagugcaguggcacgaucucagcucacugcagccuccaccucccggguucgugauucuccugccuccaccuccuuaguagcuggcacuacaggugcgcgccacuaugccgugcuaauuuuuuuguauuauuaguagagacgggguuuugcuguguuggccaggcuggucucgaacuucugaccucaggugaucccaccugucucagccucccaaagugcugggauuacaguugugagcuaccacacccagccccaugugauaggauuucuuagauuugcuucacaauaagccaguccagaauagggaugaugcaaaguggauuggaguauaaacuagauuuguccuguguuucaaaaugucuauaauaaaaagaaaacaagugaaaagcuguauaugauacuaaguuauauuuagguccuuacuuuuauuuguuuacauuuaaaaaugucuuuuaagaauuucaucuugguuccuaguuaaaauuauaucaauuauccuccaucucauauacaacauuuagccuaaauuuuaaaacauuuuaucccagagauuauucaccauaaaauaaauauggcuugcauucuuguuuuuaggcuccucuucaaugaaauaccauuaauuuguuaaguuucuacuauauuucaaguuaucauccuacucgaugggaauagaauaaugaaugggagauauggucacuguauuuaaggggaaaaaaaaguauaggcuuuucuauauucucuuuagauuggcagugucccaucauucacagugccuaccuagcauuguacuaauuguaacuauuucuugaaggaauaauggaauauuuuauuuauauuaaugauccuuauaaaauguauuuuaauggaacuuucuuguuuaguuuuauauacucugagaagaaaugacacugaaaaaccaauaggcuucaauuuauuuccuuauccucugucucuugcacuauugaguugucaaagaaaagucuggugacauuacuuuucaaaggaacuuuuagaucaguguuuacuuaauaaaucuuuguuuauuuuuuaacuuuuuccaaacuagguaaaauauaaguaaaagaggauuuaauuacuuauuuauuguuuuagcuuucuaauggaaucccuauagaaaguugguuuauggauaaaaaugacaaugaacuccuaaaauugauuccauuccuggagaagcuuguagaacugguaaguguagcuuaucuuuuucuguuguguuuuuguuagcucaacuauauugaaauaaauauuuuuaaaugucuuugcuuuguguguacugacuuauaaagucaacugugagccaggucacaggugccaucauaggcgccuguagugccagcuacuuuagagucugaggcaggaggauugauugagccuaggaauuugaggucauacuaggcaacauagugagacuccagcucuuuaaaacauaaugaugggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggggaauggcgugaacccgggaggcggagcuugcagugagccgagaucgcgccacugcacuccagccugggcgacagagcgagacuccgucucaaaaaaaaaaaaaaaaaaaaaaaaaacaugaugaugaugaugaugauaaagucaucugucaugggagaugagggcaaagguugaaaaagauuaugugcauuuucaaacuuuuuugaggcagggucuuguucugucacccaggcugcaauguaguagcacaaucacuauucacagcagccuugacuuccugggcucaaucuauccuccugccucagccucuuggguagcuaggacuauaggcaugugcgaccaugccugucuaauuuuuguauuuuuuguagagaugggauuucacuguguuucccaggcuggucuugaacucaugggcucaaacuaucugcccaucucagccucccauaaugcugggauuacagacgugagccaucaugcccaaccacauuuucagacuuuauauauuauauuaacauuaugcuuaucaguacuuaagaauuuauagauugaaugucuuuacuauuucaguggucuuucucuuacaaauugcuaagcaguuguguuagaaauaacauuaaauuggccgggugugguggcugaugccuguaaucccaguacuuugggaggccgaggcaggcagaucacuugaggucaggaggucgagaccagccuggccaacauggugaaaccccaucucuacuaaaaauauaaaaaugagcugggcguaguggugggcgccuauaaucccagcuacucuagaggcugagguaggagaaucacuugaacccgggaggcggagguugcagugagccgagauugcaccacugcacuccagccugggcaacagagugagacuuugucucaaaacaaaacaaaacaaacaaacaaaauuaaauuuuucauuuuggucuuauaauucacaucuagaauuaaugcuuaugcuacugaaacuuuauucugggaauucuauuucuauaucacauggaacacuuagcuuuaaagaccaauguagaaaguagaauucccuuuuaccugucuugguuuggccucuauugcuugaugaaacuuuggcaggauguaguggugcacaccuauuuaaucccacuguuuuuuguuuguuuguuugagacaggaucuugugcuuucgcccaggcuggagugcaguggcgcaaucucggcucacugcagccuccgccucccauguucaagggauucucgugccucagucuuccaaguagcugggauuacaggcgcccgccaccacgccuggcuaauuuuuguauuuuuaguagagacuggguuucaccacauuggccaggcugaucucgaacuccugaccucagguaaucuaccugcguuggcuucccaaagugcugggauuauaggcaugagccacugcacccagcaguaaucccaccauuuuggaaggcuaaggugggaggauugcuugaggccaggaguuugagacuagccagggcaacauagugagaccucaucucuacauacauacauacauacauacauacauacauacauacauacauacauacauacauaagcaagcaagcuugcugggcauuguggugugugccuauaauuccagcuacacaggaggcugaggugggaggauugcuugagcccagaaguuugaggcuccagugaaccaggauugugccacugcauuccagccugggugaaagagcaagacccugucauucauucauucauucguucauuuauaaauaaacaaacaaacaaaucuucuugggaggccaaggugggcagauaaccugaggucaggaguucaagaccagccuggccaacauggugaaaccuugccucuacaaaaauuacaaaaaauuagccaggcaugguggugggcgucuguagucccagcuacuuuggaggcugaggcacaagaaucgcuugaacccaggaggcagaaguugcagugagcugagauugugccauugcacuccagccugagcaacagagcaagacucugucugaaaaaacaaaaauuuaaaaaagaaaucuucaacgaaauucuuuucaaaaucuuaaauuuaacugcaucuguguaguaucucuauuuggcaaauaaaauaugucauaaaauaaaaacugguauguuuucucugcaagguaagaauguauguuaugaggaucauaucuuugaaauuuuaugccuuuuuaaaaauugucuuuuuuccacgcagaaugaagauguucgaccacacaucagagacagauuucgcuugcaugauuugcugcccccagauuaaguacaaagacuugucaaaucacugaagggggagagaaugcaggacccuuuuggacuaagacaaaaacauugccauuacuguugaaauuuugcauuuuuguaccccgucuugcuuuucuuaucuuuggugcccaauaauaauuaaggguuacagaaagagacuuuaucuaucucagaucgaauacauauaguagguaggcuaaaacagaagagucuuuagaacuagugcaacuccagugaaauuuuuuauguacaggacaucugcaguuuauaaagaauucuguuucugccaccagcaguuugaccuguagucacacaggauuuuaugauaauaacagagaugaaaauggacuuuuauuuucucucuguuuggugcucuaaguggguuuguagccacuuuucuguuacuuuaugauucucauuucaacaggaauggccaguaaaaguuguuuuauuuuuccuguuaagguuuauaaccuuuuuacauuuuugaccuguauuagauuagaauuucauuaugcauuccuuuuaguugaggcgcuucauaguuuucuggagauagucaauuuuuaguuuuuuauuauacauuugaauggccguuuuccugcuuugucugccugcacauuguauauuuguuuaaaaauauucucuacuuuuagucuauguaaguuucauuuagaaagacaugcauuuauauuuuguuucuguaauauucuacuguaggugaaaucuuuucaaaaaucaagagacuggguagauaagaauauaugaaugacuaauauacaaaagauuuaaaccauugugauggcguauauucucaaaugguaauaucuugcaauggcacacagauuuaauggauaaagguauaccucagacuucacugugcucacaaaucuuugaggagaaaguuuggucaccuguuuggcuugauuuaguuacugcugccuuugguuuucuccaggaaugaaguauucagcacagugacucaguauuuuuaguuauuuugcaugggcugguaguaccucuguuaugcucucaguuacaaucaauuuaaaacuguauaacagucuugguaccuaacaguagcuaugcauaauccuguggcacaguacacucccaagccaccaaugcaguuaauaugcucucauagugguuuuucuaugcuauaugaaaauagucuucaagccuugguucucuaaugcagcuaccacaagagguugauauuuuuauaguggcguguaaucuccuuuucgggaggcuuuuuauggaagguagaauuuguaaaaguucguaugcuuugccucucaacugcauuaacaugccacaggcucagacuguuuuuguguaaaggaugucaaagaacggcacuuuuucuaaagagaaguuugauauuuuguaugcuuguuaagaaaguacaguauuggaaauuaaagguggacaacugauaauugaggaguaugucaauuaauuuuuuauguauauuaccuguuuacuuguacaacuuacuguacaaauuacaugcagcuucauuuucaaaugaauccuuaaaauaaggaaaucuuuuuaggaaaacauuuaauuuuuguauuuuugauuuuaaaggcaugaguuaugucaauuuucaguguauuaaugaagauuuuaacuuuucaucagguugaguguuuucuuacuauauuaucuguuguguauguaguuagcauauugugucacugaacuguuuaaaaaucuagcauguagagcaagccuguuuuguggaaaauccuuauucauuaaaaaaauaaucauggcagauuuucugcaaaaaaaaaacaaaagcauuugcaauucagaauacugauuuuuuuaauuuuauuuaaagaaagguauuuugcuugcaggaaaaaaauacuacagauucauuuuaaugagaaucuuugaaauguauuuaucuuuagggcaucugggcaucuuuaugcuguuugucuucugucuuucuugaaauaaaauguacauacguuaccuuuacauaugcucuugcucaaaauugugaaccuaguuacauuucucccugcucccuuccuuuuuaugcucaaacagcgaaacccaaaacuuaaaagaucugaacuuucagcaugcauucugauugcugaaagauuuccugauuuagugcauucucaaaagggcuuucccauaaucuaaagggaaauguaagcaccuauacucuugugccugugggcacuucaauaauaaaaaccaacuuuuuaaacuaaucaucuuuuaucaaugauaaaguuguuuucagucccacacuaggagaguuccuuuaagucagcugaucaagcauaagauacuuccguaaagaaauaaacuaagaaaauuuuuuauggcuugagaaaauuccuugaggccaaauuaauauauuuuucuuuguuauuuuauuugagucauuuuaaauuuguuaauacaaaauuuaagauaauuuacagagacaauuuauccagcuuccuucuaccuuaauacaauguuuugucuucccauuauccucucuuuucuuuaucuguugguagauguaaaaaacuuccauuuaguuaaucggagguguguauuuuuuaaauugaaaugugcccagccccuucagcucacacaggaaacaugaacucuuaaaaaacugacuaguaaaugcaggagagguggauaccugaugagacacagcgaaagugaccuguauacacauuacaacucuggaguacauauuaaagucgugcuauuuccagugguaaaugucugacuuuuaagacauucuuuuaaauauuuguaucauuguuaggauguuuuaaucaguuguuuuuuaauuccauguaauauauguagcccucaucagauuuauaucaccauauuucuccuuguguccuaagagaauugaugacaauucguaaccauaaauuguuuuauauuagcuaguauguauauuuauuuuuacccaauggcuuuaucuguuucccaaaauuuguuugggauuuguugaaagcauuguguaacuucuauaaacggcuauuuucuuguaacugucagugaa

SEQ ID NO: 191232 - RNA, 73209 nt, Homo sapiens
gcccaccgggcgagcuucuagucggcgauugaaggaugcgagugcuccuuaagggccuccgccccgugaguucgguugugacuaggaaggagcuaguggacuagagccaggguaaggggaucugcuagaaguuggucuuccgccaggacuagaguuuccucgcgguaacagccuccguggccuccgguaaguucugauucacgggugagcuuggaccugggguuagaggaguugcgggguccucgggaugcuggcugaggguuccugggggggcugaccugcccccuccccaaaucccgcggugguggacugcccgcauguugcgggcucagcuuuuaccuuaacgugucauuuagaccucuucauuccuccaauauccuacuuagaagugacauaugggaagcccgccucguuuccaggcugcuggggucgcccugagacccuacucugcggaccccgccuuggucacccuggcgucacgccuggcucacaguaggugcucugugcacguguguugaccgaguacaagugacgcuggcacccgaagccaguagccccgggcauccugggccccgugcggcuuuggucauguuuguagugccguagcugacgccaaacaguuccucaaggucauucgcucagccuguggaugcuuauuguguauuagcauuacucgcuccgcccucugggcaacuugaaucaauuuguccaaagugcuguuauuagcacugaucacaagauguugugaucauuuguuuauaugucuauuuucuuucccuucaucguguccuguuaaacuuuguaaucuugaacagugcuugguaaauugucgaaugaaugaauaaggugucuccaccagguguugcaagucuaaaccgggcuaugugcucuggcuauuuccauucuagaaggcgaguuaugucagcaaguaaguagaauuucccaacuccaagugcaguucuuagaaaccccuuuuguggggguuuauaacccuuccuauaucguagucaugaacuugagucugauuuaagccuauuaucaccuuauaccuucauagugcgugacaaugaacaugcacucccuagacaggugaaugcacucaacuaaagagaagcugaaguugaagccauaagaaaagcauaagaaauacagucugaaagugcaaaggaguggccagcuccaugggggaacaggcuugggagggcaucuugaaggaggguggcauuuuuguuccauaggagguugcauuauuagaagugacauuucucauaggcugcacauucaccuuuucucagauaugcggaauccucuuuauucccuaaaccucuucgguagcuggcagacuccuauucaucaguaauaaugucauaauaguaauaaaacuacaauguauugauugguacauagugcuaauuacuuuacauguaguaucuugugaauccucagaaucaaucuuugaaguagguauuauuuuuacccccauuucuuuaacguagaagcagaaacaguuugcucaagauugcacugcugauaaauagaagagccagaauugagcccagguugucugaaugagugcccucauucuuagaaccacuuauagccauauuguguccuuuaagauuuauuucuaaucuaaaagcucuuuuuuuucuguaaaacuucucuaaacuauccuuucuucuuaggaaaaguaauuugugcuuuguacuuucaucuacuacggaauuuauuacaauauguuauuguaacuguuuauaucaguggcucuaucuaagagagggugagcagagacagugagcuccucauggcugguaccaugucuuaggugcaucuaggauaugaucuggaacacaguggguauucaauaaaauuuuauugaaguaaugaauucguauaagguaacaugccuauaucauauucagucaacaaauauuuguuauguacccaccaugugcaagcaggcagauacauuuuaauucugccuucagggugcuuauaguuuauuagaugaagcaaaaacaaugcuacuuuugcuuuguaaucuuuuguccaaauacccauugcuuuuguugcaaggagggcagagaaaacaaccggggacaacaaaaggaaugcugggucagagcauccaucugaguguaacaacaagacauacuuuuuauagucuuguuaaggguucagaaaaaguuaucuaggaagaaagucuaccagacugcuauugaagaagaaaaccaaaacauacuguauacuuaaucugcaucuugauuucucaaguggucagccuugagucaauagauauagaaaauuuucaguauuuuuacuaguggcauaguauugacaaauuaauucaaaauaauuuuacuaguguaaauguuaauuuucaauauauuaauauugauaguuuucaagaugguuuagcaguugauauuuucaccagcaacucaugagccauacaaaauacaaaauagucaccacugggugauaacaaguuuuuuuuuuguuuguuuguuuuuucaaucuagugguugaaaauggcauauuguuuaaaugacacuucuuugaaacaucacgagcuuaagcaucuuuucaaacuaauugauuuacacuuuuuaaaauaaauugucaugucagucgcccaauuuuauauuggauugucuuuuucucauuucuuuguaauaauuuuauauugggacuuugucaggugcuuugcaaauuuuuuuuauucuuauuuuucuugacuuuguuauugauguauuuuuucauauauaauauuugacucguuaaugaugucuuuugccuuaaacaaaauuuuauuuuuugugguuagguuuccaucacauuuuucuuuauggcuuuuggauuuacuaucuugcuauuuuuuuuuuuuaaagaagucucuuuuguuguucugaauauuauacuaaagucucugguagcagugauaaugaguggugauuaauaaguuaagguauuagcuuuuauuuuaagucucauuuaaaauauguauuaccuuuuuacuauauauauuuuuaaccacauuaaguugaucagguuucccuuuaugucugaaaucauuucuuaaagucuuuuauaguuuauaguucugauaaggaaaacuuauaccuucuucagugggggagauuuuggucuuuucagguauuuuuagaugucuucuuuaaugacauguuuugaauuuaaaauaacauuaaagauauauacuuugauauuuuacauucucuuuaaaaacaaaacccuaaguauucucuaucugagaaaaaguagcugucuauuuaaaauauuaguagcuacauuuuuagcaauaggcucuuauaaaucuuaauguucuuuuucaauaaucaacaucaguugauggcagguuaauaaaggaugggaacaaaccucucuucucuaacuuaaugaaggagaaaguaacccaaauuccauauuucgucuuguauuuauauuugaaugaaagaaagguagaagacacagaauucagaaacagaaaggauuuuuucugccuggaggauucaggaauuucuuuaagguccagcuuaauuucaucucuuuuuuuuuuuuuuuuuugagacggagucucgcucugucgcccaggccggacugcggacugcaguggcgcaaucucggcucacugcaagcuccgcuucccggguucacgcccuucuccuuccucagccucccgaguagcugggacuacaggcaucucuuuuaaggacauaggauuuaauugggcuaguauuuucaauauauauaguguucuguagaauauuaagucuauuugcauaguggaaaaaaaucuagagacaugagauuguguguuuuucccucaccauuucauguuacaggcuuuuuaucauauucauaucuucaucuuauguugacauacaaaaggauucuuauagauagauuuauuuuccucgauaugcaugucucuucccccguuuagcccugucacaaggguagaaaggaauagguguggucugagaagcagaggcuggaggguuuuaaguugagguauagucugaguugauaugaguuuaaagggacggguuggguguagggaccagagaggaagggauuagaagguagacugcaaauuagagguuggccaagaaacauaacucagucuuugaaaaacaaaaacuugucauagggggauuuuuaccacugaaguucauauguauguuaaucuuuaauaccauauucaucuauucuagcuugcauauuuucuuuucacacuuuaauaucuacaacauagacugcguccuaaaauuaauguuaugucauaauuugauuggcuacaucucguuccuacugcuacaaauggaacugcaucauagaaucaaagacaucuuagaucugaugaaaugggauauugucugcucuagagcuauuggcuuccacaaaaguuugugauauaguucguaucuguuaagacgagggagcuaaguucucuaugguaaaaugcauuuggauugcugggucuccaugcuucugauuuuacuuccaauuuaaugacauuuuagagcuugaaagguguagugaaugaguuguggcucaggcucacauccaagugcguuucauuggcaugaacaacaguggacugaauggagggcaguguuaggccagguaauugaugacaccugccuacuuuuuuguugugauuguucagagcuuugaaguucugaggaguuuauguauagugucaggaucccuaaguacaaguuaaaucagcagcagcuuuuuugaauguaaguaguugaaaacccauuuccugcugcugcuucugccgcagcagucacugcuccccagggaacucuugcuguugcuuuuggaauuggaaguccacagugguggagcuucacagccuucacuucuguuuuucccgaguauauugccagaaccugauuuuaucaagcuuaagaggaggacauuuaagacuuauauuuuguugugcacucuauggcauugacugaauuguaaaugguuucuggguaguagucauucacucaugauuuaggggccuucuucuuguaaagcaugauauuuggauuucugauauuaaaaaaaaaugaagcaauaggguacugccugugccauguuuaauauaucacauuugaaguuuuguuugagcuuaagauuuuuacauuuggcacauuucuaguuuauuauuauugucaucuuauuuuucaugucggcaaaaaucuuacuguuuuauacucuucagaccacuagaaaggucuauucauagcuuuauuaccuauuugcauguuuucuuuuccaugaauugcugucauauagcuauuuucggugaaucaccauuauuuuuauuggccauaacugaguuauacauauuuucucccagucuguuucugucuuuucacuuuguguauguauggcaucucuuauguaguuuguccuggggagauuuuaugugguguccagaaaccaaacaucuuucccuucccacaggaggaccaugucauuagacuuuggcaguguggcacuaccagugcaaaaugaagaugaagaguaugacgaagaggacuaugaaagagagaaagagguaaguuguuaaaaaaaaaaaaaaaaagagacacuaaacccaaucuuuaacaaguuuuauuucuugaucaaaauuguaucaucuugugucauuuugaagggauuuggauuuuuuaaaaaaaaaacaacccuaaaaucugcuugcuauuuagacugaaaaggugaauaaguggaaugcuucuguuuuugagacaggaauaaaacacaacugugaauaauaccaucagauaaaugguuaaauuuuucuuuucauuuaggagguaaugguuggcuuuggaaguggaagguuaguuucuaggugcuugaaacauugccaugaacaagucugacaaggcucuuugcuuuggguaguuuacauccuaguggaggcagacaauaaacaaguaaacaagugaguaaaguaauuugagugagugauaauuuaucauugauaaaugacagggaaacaaauuggagugcuaugaaagcaauugauaggggauugcuguagaugggguggugagggagggucugugggaggaggcaauauaugagcugagacuugacucaugagaaggaaccagccaugcagaagccugaggaagagcagucuacgccaaaacaccaaugaguguaagcugggaaguugggaagagaccccguguaugccacagaucauguggagcggccagaaggccaugguauuggguauauaugagccaguguugggugguggaugugggugucagaucauggaaagccaugauaagguguuuguauuuuauucuaagaacaaugggaagccaguggaggauuuuaagcagggaaaauugauaucauauuuuugaagaucuuucagaaggcugcauggugaauagauuauagaaggaaaggaauaaaagggagagaccauauuauuuauauguaaaguguuuagcagaauucuuggcacauagcaaauguucaguaaaugguggcaauaguaauagcagcaguaauaguguuauugguggaagucaauuuaguuguuuugguuguuuuuaguguaagucaaauuucuugauugucugugauaaaaggcuucuuuuguccugacgcuauuuuuuauaugacccauuuucuaacauguaaaaaagucuuuuuuaauaguuauuguggaccaugaguauuaacaggaagcaaggaauagggucaguugaccauugcucauguggcuggugguagaauuaaggcagugauagaaaacuggcaacuugcuggauuugguucagacagguauuguugguugcagagugcuuuuaaaaaauugaaucuguauuugaagaugggaaaauuuuaugcagcacugcagagucucuggcuuaucuaaaaaacauccaaagcccuggccacaccuggccuguauuugcacauggcagcaggcgggcuggaacugagcaguggcucuccuuccccagcuggccacaguccccacuucucacacagacaugggcuuaugcacucagaccugccugcuucacucugguaaauucucugccagggcccugagggcauuugaguuuaugacccuggugaggguuuccggauuuuggcagggccccucacaacaauuguggcaaggaugggaaugaggauuuucuguuacuuugaaccugcagcaugagguauucaugacugggcuuggauaguuggcugggguuuagccacugggauucuugagaaggucaguuuaaauaaucacuacuguaaagaagaaaaaauauuuugacaggugauuuuucauugagaaauauauuagagagauaggucugccaguguauugugugguuaaaauuuuagaggggauacuaguuaaggaggcaauuaauucuagauaauauagaaaacagcuauuugggaucaccucuuugauagauuguaugcugggauagggaauuucaggggaaaaguuguucuugaaagaucaaguaucuaagaaugaguauuucuagcagaguggaaggauauauagcugaauugacucuaacaugaugauuaugguuaaauuuguaaaaaacuucauguuaauaaaaauauuuuuacuuuaaaaaauaauugcugcaagggaaaaagugagaugagaggcuagagagguucaaauuuuaguaacaaacuucggaacuguucacaaaucuucagcuguauguauacuuugucacuacaaguuaaaguaauaaauuggguggucaaacccaagcuugaaugcauaucuagaagguuuuuuuuaacugucucagucuuccugacccagcaauagccaaaugguucacagccuuaagagauuaaagaaaaaaagcuguuuuauccugucuaccugguugguagcuuugggacuguggcuuugggauuguggcuagguuauaacuguuagcagugggcuaaugcauauugcuuucucuacuuagugaaucacuuuguguucaaguugcugaugugggaggaaugccuuuaucccugaugaugugcuauaaggcuuaccaggcauaccacaucugacucauagucuacccugcuaaggguuugugagagccugucuugguacaugguuggauaguccugauuuucacugccugggaugaaaggcuaguugcuaauacagcauguuuuuccaagcuguguuuaauuuuguuguuuuggugccaguugggauuuuguccacaugggcccauaucccaaugaauacaccauuccaaccuucaugccauccuaaugagcagcuuuacaauuaugauuuugcuuuuuccauuucuauucucuccauuguuuguauugaaggucaaagggagaaagugccuuuaacauucagaaaaaggaaaggauuuaguaaauacuuuauucaauauuuagaggauauuuagaccaguggaucucaagccagagaccaucacaaauauacccauauuuugggaaaaaaaaaagcaagaauuuuuuagaaacguccuauaauguauuucuaaagugcuacaacucuuaaugguacauuaguaaaaguuggcccacugugagucaaggcauaaaggcauaguagagagguacauaaaccacagcuucucacaguguuucaacugaaacucucaucucuuaaaaauagucgacagagcagauuaggguguagaucagugagagugaugacaucauagagauauguaucgucaguuaauaucaauuaauugucacacauuacuuauguuucuccuaacuaacuggagggcauuauuuucugauuguaccacuugagagcugcugguaauacuuguccuucuugcuaagaaggagauaucauccaaagcaaacuuuucuuuauaaagcugucccagaaaauaauucagaagcucuuguauuaacucacucauaauguaacaauaugacuuugcaaaaaugcuuuucaccuaagucucuauacuugugauugcacaguuggauauuacagagauauaguucuuuuuuuuuuuuuuugagauggagucucgcucuguugcccaugcuggagugcaaucacgggaucuuggcugacgcugccucccggguucaagcgauucuccugccucagccucccaaguagcugggauuagaggcaugcaccaccaugccuggcuaauuuuuuuuguauuuuuaguagagacaggguuuugccauguuggccaggcuggucuugaacuccugacuucaggugauccaacugccucggccucccaaagugcugugauuacaggugugagccacugcacccagccccagauaaaggucuuuuuguaauaggcaugcuuguuauaagccucucaguuguugguaaagccacagcuuaaacaagauugccauuuuggacucucacagucagcuggaguagacauguacuuucugcagugucaccagaaguagcucugugauuguuguugguuccagauaguaaaauuaucuauuuauguguguauauauucuggagcuggugauuuggggcagaaauacuugguaaucuaugauaucaagauaauauuugcugaugauggaucauuuaguguugacgggucauuuagugaugacauauuugaaaaugaucuugaguagaaagguagaugguuuagguagcagguggcagauagaaacuugcacuuggcaauacugacuugguuuuuauagugguacuucucuaauagaauaauaaagcuccauugagcucagcaucauguauuuuagaggcaagguuuccauugcauagccuuucuuccacuuuuuaacugccuuguuugauguaauugcggaagcauuuugauauuuuguuuccacuagagggaguuguaaagcuaguauuuguuuacauuuagcguguauccaugaaagcauuauuuaauaauucauauuugaaaauaucagaaucuuuuuagaagcguacuaagaggucaccuguucaaagggaauaugaccguuagguauuccauuugcuacccuuucucuugggagaagauuauuguaugguuuguaacuugaggccucuugccuucaugaauauugaggauuauaggcucugaagauaaucuguuuaguuaauuuaaguugaaaauccuaacaaaagguuuacauguucucuguuuuacauuugccccugaauguaggcuuuuguauguucuacauggguuauugcaaaguguuuuguuaacaaaguucuuugaguaaaaugcucucuuuuuuuuucuuuuuaagaaagaaacaugaaguagaaaaggaggggaguuuauagaaugauucugaauuuauuucaacugaagccuuagaguggcaaauuaucuuucuuacagggaagguaucuguuaaauuuuuaaacucgguuaauacacaguaauauccuguugagauugcugcuugcugccaaaaagcagucugaugaauuuuaaauuaaugagugguauuaaaucuuaucacuuauaaggauuguuauuucuguucuugaaucuguauuuggaaguuugauagaucuuuaaugaggaaaauuuauaguuucuaaauuucuguauuugguaacaugcauaucuagauacggcaauuuuguguuuuauugcacaagguuagugaccaaagggcaauuugacaauguauaugaggagggcacacuuugauccugggaaauggaaacacuggagguggaauuuuguuccugaauggccuuauuuaggaggacuucauuuagcuuuucucugcccugaaacuuacagaagccagggaauaugacccagcuaugccaaagaacuugauggauaaauuuuuugaagaucaauuuuaaaauguuagcauauauguaaaauaucuugcaagacucugaauacuauagggaugauuuugcuaguugauguuuauguauguauccagaagcauuuugauuagcugauugcuuauacucaaauuaauuuuucucuguggaugccaauuuuguggugucacaaagcuacaauaacugcugaauuauuauguaguuuuuuguuuuugugcggggaaaacaauguacucuucagaugucccugucaaggcgccccugaauuuuaaggcuauguacuugaaccuuacugaagguuuacaagaaaauauucuuucuguucaggagucuuuacuuaauguaaguauaaaagauuuguuuuauuuuuccuuguguaacauguggggguagucuuuuuccuuaaagcagugaugcauaauucuagacaacaaguggugcuacuuuuaaaagaccucauagaugcaacuuuuuucucuagugcauuugugucuuuguagaauugcuuugcuaccuuucauuugaggcaugucuuguacaaauauguugauguguucuguuuuguuuuucauguugugucuuuuguauuucuuguuuuuuauaucucucagucaacucugauauggcuaauucucaaaaugauuuuucaaguaccuugcauguggagaugagcauuuaaugagggucuuguguguuaauguuagcguuaaaagauuuaaagaugaagauaacuuuucauugaagaaaauaucuuucucuuguugcaucuuuagaugacaaauggauugagaaacccuuuaaaaaaaacccauccagugaauaugagaaauaaauauagagugaggaaguauucccacccaccuccaacauacucuguucccauucccaaauuuuauuucaccaaagcucaguuaagaauuuggggcauuccuuucagaccuuccauaaaauauauuuauuuaacuuuuacuauacauauuuuguuuaagaaacuuuuuuuuuugguaauucuuaauauaauacucagauauguuuuauggacacauuccauuucuuuuguacuaaugacagguaaaguggaaaaaaaaugcuauagaccagggagcaucucauuuuuuuuuuccugaaagguuuuacaaaguauuuaaagucuuuaaaauccacuugcacaauguuaugggguuugauuuauguccuuuggagggauuuaaucaagcugucaauuaaacuggugcuuaguuucuuaaagagaaguaauuagaaacaguuucccuaaaaaguauuuaguaacauaauauuugaucuucuaauuguuacauaauuuaagaaauacauuauauugggauuuuuaggguaauauuauuauauuggguuuugaagaaagacaauagcagacaguuauugaaauccuaaauguuauugaauuaugucuaacagacuagcuuauuuacucaucuuuuuaucacauuugaaauuugaaugaauuaauuuugucuaucuaguuuauauaauaagcagaaugcuaaaacugauuuuuuucuagaaaauaauaggagagagaaaucaaacauuuaaugucagauguagugucaugcuuuugcaugugcuaucuauagaaaacagucuuccaacucuucuuuuacucagauguuguaugagagcaggguauuauguaucuuuucaucuuuggaauuagauggcucucuacuaauuagugacucccacggguuucuacauuaucagagcauuuaagagcuucuaggccaccugcugcugcugcuguucucaucaccuggccagagugcaucuggcuacucacauucccugugggaugccuaauugucaauuccccaaggucugauuacugauaaaacaggauucugagacuuagucugccugcccugugauaacauaaugcauugauuguaccauuauugugacuugcuguguuuccauaaaaaaguuuuugaauucugcucuauguguauuuaaaucugagaucuucguuaaaaaaaaaaaaagccuucugauauaaauccuaaaauuaugcauucccuuuuccccaagugaaaugaugaauauaauuuguguggaacuuaagaaguuaauuaaaggagggaauuaugaacuucuuugaccucuacaguaaaaaaccacucguuccaaggcagcuuuggcuuggugucuuguguuuaaguugguaugauauugaugcagaccuuuugacucaguugcagcaguuacucacagaccuuccccaugacaugcuggaugacgaccucuccucuccagagcuccaguauucggacugcagcgaggauggcacagacggacaguaagcaccugaagucacuuucacuuguauauugcaauucuauaagucuuuuucuuuugaugaagauuaauaauuacaugauuauaaaauuguaaauugauucuuaaaauuuugggugaagauuggaaggaaaaagguuaaaaucuugggguucuuuguguuaucuauguacaaauaaaugauacgcuuuaaaucgaaaguauuccuuuuucucgagaccacaucauccugagcaauuggagaugagcuggaaugagcaaaugcugcccaaaucucaaaguguaaauguaaguaucuggugugaugaugacuuuggugagggugggacuggaucuucgugcuuuuguuuuacucuuguuaucuaauagggcuauaaugaaauucagaguuuauaugcuggagaaaaaugugguaaugucugggaagaaaauagaaguaaaacugaagaccgacauccuguguaccauccugaagaagguggagaugaagguggaagugguuauaguccuccaaguaaaugugaacagacugauuuauaucaccuuccugaaaacuuuaggccauauaccaauggucagaagcaggaauuuaauaaccaagcaaccaauguaauuaaauuuucagauccucaauggaaccauuuucagguauuguaaaaacuugacuuucaagaacuugugugugugcacacgcauuugcgugauguuuguguguguucaggaaauguaugugaguacaaugguaagaugauuuaaccacacgaaguucugagagggcacuuauucagguucauggugaauuagucaugguauuuucuguuuacagucuaauacaaucaugaucuuaagucagaaguuuaaaauagaggcucuuuggacauaguugauuaaacauuaaaaguuaagucugccaaagaauaacuauccucauuuacugcugcuucuaccacugcacugugcuucaaugagaagcuguguucaggucucuuauuguaguuuuuaaagcaguaauucuguguagguggcaacauuuaauuuccucaguuuucuugcucaccacccauaacaaauuuuagguuaaacaugucaaagcugauaucucuauuguauggugauauaacaguagacaggaugaaugugaaggaaaaaccaaaaaaccuuguuuuuccugggggggaguuuaaugaaguaagaccucaggauauaguuaguugcuucuuagaauuucucaaugacagcaaauaccucaacagcuagucugugucacgcaaugacaggauggauuuuuuaggcuguuaagugguuauuuucucuuaauucuaucuccguagaauguuauuauucaucccauaagaguuacuauuuauuagauaugaggcaccgugguccauguucauguuauuggauaugugcauuuuuauauucccaagauguuggcauaaucuaaaucauuuguaauaaaauauuucuauauagucuuauuggaauucuuggguuuuauuuauaaaauugccuucauugugugcucaaaaguagaauuuaggugucuauaaauuauguauugcagacuuucaauuaauaguguuaaauaacaauacgugcuacuuuugagcagauauauauauguguguguguguguguguguguguguguguguguauauauauaaacaacuuugaacuguaccaaaaguaaguucuguaacguaacauuaauuuaggugucuaauucagauaauuuuggaagaaaaggccaaaucuuaauugucaguuucauuuguuaucacagggucccaguugucaagguuuggaaccguauaauaaagugacauauaaaccuuaucagucuucugcccagaauaauggcucaccagcccaggagauaacaggaagugacacauucgaaggccugcaacaacaauuuuuaggagcuaaugagaguagguaucaaguuuauauuuauuuuuuaauaccacauaauuggggaaauuugaauacacaaugaauauuugagcacauucaagaauuauuauuuuuuaaguaugacaauagaauugugcuugauauuucaaagagcccuuauuuuuagagauauauacuagaguauuuaugaauaaacugacaugaagucuaggauuuacuuuaaaauaauaggcuguugagggguaauguugggugggaauauagauguggccaaauuggccaugaguucauaauuguugaaucugggagauggguucguggagauucaucauauuauucucuuuacuuucuuauauauuugaaauuuuucguaaugaaaaguuaaaagacauuuuuccaacuuuauauuucagucauucuaguuuguuaagccuuuucuccuuauuuguauaguguuaaguauccucgccuaucauacaggauaccuggacuuauuugaaauuuaaaaaaauuuuaaaagacuuuuuaugaacuuuauauauuuuuuugacugaagccuaauuuggaaaaugaaacauaguuuucaaucucagauuuuugacuauauagaaguguaauuuaauacaucagcacuaucaucaacuuuuuucuuuugauuuuacaguuuuuagucaacucugauauaaauuaguuuauauucagaauuacuuagauaucagguucagucauguggcauuugccaguuuuuuuuguauaguauguauauaaauaugagaaugaaaaaagugcuuauagguacuagagaauucugagaugaaaugcuaguaucaaaaaacaaaaaucccaaaauauaaacccguauagugacuguacugaauuacucuugucauacugucuggcacacuaaauagcuucuaauuauugugcauauugaagagccaguguaauucuagaguguggcagcaaguguuuuuguuuuacuuuuuguuucccuuuaauuaguaggggaaaggucauacuggauauucuggcuuaccugggcuauaccaaagagaaaacuggacuuuuggguugugacuucauauuguugcuuccaucguacacugggacggcaggguaguuacagggggaggcccagaauucauuuuccccugaaggagucaacagcaaauaugaggauggccucucuuuguucuuaaguuuuuuguggaaugaggaaguggacaguguauaugacauaacugguuuuagguugaguaaaugaaccucacagcaguggccugacaucuccuuaguguuuacucuuucaguucccuugaaaaguuguauuuguaucuccuggucuuucugcauauaaaaaccuuuccuuaccuuucuuaacacucugcacuucuucaaguugagucaguuacacauuugucuaaauuugacauuuggaaguuaauuaaauaacuuaaugguagugccaaauuagugauuauaguuucuuagcaacaguaauuuaaaaaauuuggagauggggcuagcucuacuauaagaccuaugaggaguuugacuuguauaaacuuuucagucuuuaauuuucuuuauuuaaccagaucucuuucuaaaaagaggacagaauuauuuaguuagcaagugguuaaaacucaguaaaugcauuuauuucugauuguaagcuaacagaaacauuguucuaguaguaaguagaauauuuaucauuauguaguugaagcauaccuaccaauccuuuuuuccauuuuuuuucucuuuuuaaagugguccccaaaugacuaauuguuucuaaaagaagacuucaaaaauuuuuuuuuaaauuauguauucguggaguagauuuggagguuuguuauauggguauauuaaauaaugcugggguuugacuucuagugaacccaucacccaaauagugaacauaguacccaauggauaguuuuucaacccuucuccccugcucccuccccaaaauucuugauuaaucuauucacuagcuaauuaauucaguuaugugccagcaucaauauaaauauaauauuuuccccacuccugccuaaaauaaaauauuuugaggcugucuagaaauuuucuuuaaaaaugauuuuauagaagcugauguacuuguuuuguuuuuaauuuucugacagcauauuacuuuauuucauugcaguuguuauauacugauuuuuaacuggcuaaaaugguaguuagugauucaggguuauaacuuaaaccagugacuuucaaacuuuccuaucagugacccacuguaagaacuauauuuuuuuacauugugauaugguguacaacauguaucuauaugaacagguauauauaaaugaaacaaguuucacaaaauaagacuguuucuuacuacaugaugcacucugauauauucucucucucuuuuuuaauccuagucacaauucacugaauugauuucaugaugcucuaaaagguuguagucacaguuugaaaaacacugcuuuaaaugacuauaaauuuauauuuugguauguuuuuaucuaauaaauugucuuuaauucccagacucugcagaaaauaugcagauuauucaacuucagguucuuaacaaagcaaaagagagacaacuggagaacuuaauugaaaaguuaaaugaaagugaacgucaaauucgauaucugaaucaccagcuuguaauaauaaaagguaagaugcuggaugcugucauuuaugagguacacugaguuagauaucuuguuuccaauaaccucagauuacauacgaagcuuagagaguaaaaacacuuggucagagggcucauagugagugaggcauagcaaaacaaaacccaggauuucugaguguuggccuuggauuacuucucuuuggaacacgcuguuuuggagaccaggcaugguggcuuacgccuguaaucccagcacuuugggaggcugaggugggcggaucacuugagaucaggaguucaaaaccagccuggccaacauggugaaacccugucucuacuaaaaauacaaaaauuagcggggcauaguggcaggcaccuguaaucccaucuacuugggaggcugaagcaggagaaggagaaucaccugaaccugcaggcggagguugcagugagccgagaaagcgccauugcacuucaggcugggugacagagugagacucugucucaaaaaaaaaaaaaagacacucuauuuuggagucccuauauuuucccuuuucucacuuaggcuuuuagaaucauugaacauuauuuaacuguacugauggcauucuguccuaaaaaguuguugauuccuuaugucugauuccuuaugucauuacucuggaugaaguauuccagcuuucagagugauuuguguuuaguuugcacugcagcguuuccugaggcuacaaauuagcauaaacguuuuaauccaaauaagaguuagugauugugaagugccaugucugggauaaacacacagaguaaauacagauucaaauuauaauugcuuacuccuugugcuuucucuaguuuugguccacguugaacuuucauuugcagaauacuuuugugauugaacucuagcucauuucaaauuuaauugaugguaaaaaugucucuuucuguaaugcucauaacauuuauuuugagagaagaacuugugagcuguuauagcaaaguaugugggaagaauuuaacauuaggugaauuuaagaguucauuccaagugggucgggcacgguggcucacuccuguaaucccggcacuuugggaggucaaggagggcgggucacgcggucaggagaucgagaucauccuggcuaacauggugaaaccccaucucuacuaaaaauacaaaaaauuagcugggugugugguggcgccaguagucccagcuacucaggaggcugaggcaggagaauggcgugaaccugggaggcggagcuugcagugagccgagauugcaccucugcccuccagcuuggcgacagagcgaaacuccguuucaaaaaaaagaguucauugcaaguauguguaggauaauuaguccucagauaacuucuuugauuagcagggauuuguccccaaaagggaugcaauaauaguuuuaaaggaaguaguucugcuucucuaaaaaaauuuuuuugguaucagguuuguuuuuuuuuuuaauuuuuaauuuuuaauaauuuauuuauuuggggcugggugagguggcucacgccuguaaucccagcacuuugggaggccaagguggguggaucacuugagguuaggaguucgagacuagccuggccaauauagugaaaccccaucucuacuaaaaauauaaaaauuaucugggagugguggcaggugccuguaaucccagcuacuggggaggcugagguuguagugagccaagauuauaccacuguacuccagccugggcgacggagugagacgcugucucaaaauaaauaaauaaguaaguaaguaaauucuuuauuuaguuuucucuaaaucaacuaaaguucauuuuucugaauuaaauuuaauucaacaacauuuauauaugauacagacgugacaucugauugggauugugacauuggggucccucuacaggaacauuauuuauauaaacauuuuuaauaccguagaugaaaaggaugguuugacucucagccuucgagaaucacagaaacucuuucagaauggaaaagaaagagagauacagcuugaagcucaaauaaaagcacuggagacucagauacaagcauuaaaagucaaugaagaacagguaccuauuuuaacuuauguaugguaaaaaaauuaaaaguuuaguuauuuaacaaaacuuuuuguaggguaggacuaaauuuagaagaacuuugaaguuauugacaaagcauuagaacuuaaauuuccugacugcaauaguuugcuucagaauugguaucccgagaagcuuuuauuuuuauuuuuccugcugcuucuccauuuggagaacuguuuuuuaaacuugaguuuaaaguggugacacauucacauucuuugauuaaugagauagccauuugauuuuuggaaauagucauaagucauugguagcuaagccugguggugguugauucauuuuuuggcagggggcaggguuaaaaaugaaagugauggccggaugcaguggcucacgccuguaaucccagcacuuugggaagccgaggcggucgaaucaccugaggucaggaguuugagaccagccuggccaacauugugaaaccccgucucuauuaaaaaguacaaaaauuagcugggcgugguggcagaugccuguaaucccagcuacucuggaggcugagacagcagaaucgcuugaacccaggaggcggagguugcagugagcugagauugcuccauugcacuccagccugggggacgagagcgagacuugucugaagaaaaaaaaaaugaaagugacuaugaaauaaugagcuugguuuugagugagacuuguagcuaagucugaggaugguuuaaugaaagaguuuaaacaguguugucucaugucuggcuucuccucauccuucaggucuuagcuaaaaacaauuaccuuuucagaggacuugcuauucacuuuauauguaagguagcccauagcuccauccuccaacucaccuucaucaugccauauucuauuacucuauaacuaucugaaaugaucucauuuguuuacuuguuauuuauugucucuucccacuagaaaguaguaagagcuuagaccuuuucuguuuggucauuauguccuuagugcuuagaacccugccuggcacaaaugaucugugucauucaguggauggaucucuuagccaugaaagcaguauuggaauaaauaggcaaucucuggaauagaaugaagaauaauucucuugaaauuuuaauuuuuguauguaauguagauuauuuuuaacuuuuugaaaaccaauaguuauuagauuaaaaaguuaaguugccuuuauguaguaaaagguuauaacuuuguaaucuuuuuuauguaagcagcagaaucaccaaguguauuaguuuccuauugcugcuguaacagaugaccacaaauucagugguuuaaaacaauacaaauuuaucucacaguucuggaggucagaagucugacauggaucucacuaggcuaaaaucagggugucaacaaggcugcauugcuuuccggaggcuuuaggggagaauccauuuucuugcuauuuccaacuucuagaggccaccuguguuccuuagcuuguggcccauuuccaucuucaaagccagcaaugaauggcugauugagucucucugguucugacuuuucugccuuaguuuuucucauuuauggacccugugguuacauugggcccaccuggauaauccaggcuacucaccuuauuuuaaggcaaucuaauuagccauauuaauuccacauacaaucuuaauuuucccuugccauguaauauaacugauucacagguuuuggggauuaggacacggucauuuuggagggcuaugauuuugccuacaauaccaacugugcaguuacagcuuugaaaacuuuguuuuuaguaagugaccauuggcagguuucaucagucuuucaaggaacaguugucauuuuucugugaccuaacaauuggguuaccccacacuuuggucauagagcaaugcaaacagcacuggggccaucacggcaucagcagauuccgugccugauagccacauccaucaugcugcgcaaaauccucuuucacuccccucagguaucuaccaaauguauuuucucagggaacauuguuuccaacaacuaugggccuggagggucccagcuaggguuguuuuaaggagcuugagccaugaugagcggagaccccuucucuacucucauuaaaacaugcuugaguuuuauuuuauaguaaaaguaaaaguuuauagacagcacagagcuaaaauacucuguguauauuuuaaacauggauauccuguguguauuuacuagaugaucaagaaguccagaacaacugaaauggcucuggaaagcuugaagcagcagcugguggaccuucaucauucugaaucacuucaacgagcuagagaacagcaugagagcauuguuaugggccucacaaagaaguacgaagagcaaguauuguccuuacaaaagaauuuggaugccacagucaccgcacuuaaagaacagguugggaugauuucaaaugagcaacuguuaucaacaaguaaagcugguuauguuuuguaacugauauuuuaugguucaucauauagaagucuuggauguuuguaguaaauguuagauugugugugaggugagugaaacuuaaaagccagugauauuggcuggacgcaauggcucacgccuguaaucccaguacuuugggaggccaaggcaggcggaucaccugaggucaggaguucaagaucagccuggccaacuuggugaaaccccgucucuacuauaaauacaaaaaaaaaaaaaaaauuagccgggcgcaguggugcgugccuguaaucccagcuacucgggaggcugaggcaggagaauugcuugaacccgggaggcagagguugccgugagcugagaucgcaccacugcacuccacccugggcgacagagcgagacuccgucuccccaaaaaaaaaaaaaaaaaaaaaagaagccagugauauuuuaaucugagaauacauccuaaagguauacuuuuggaaacccuacuucuuauacgauuauuaguacuuucucaacuuucacauuacuuguccuuuauuuguaggguauuuguguauguuguuuauaugguccuagaauaaauccagaccaaaacaaaugagucugccagcggcuggcuagaacuugagagguuaccuuggaagcuuaaccaguagaaaaccuuacuugagucucccagcauuugguaauucaccugucaauacagcaauacagucuguugagaaaugauucuugggaagagaguaaauuuugaggacaguauaauuuauaaaauaagacagucugaucuagacuuaaugagauuugcaucuugagcauauugcacagugaauuuuuauuauuuucacucaagggggaauaaaauauugaaagcuaaaugugagucagguggugaguuugcuugugcuccauaacucuagguaaucacuugagugaauaacauuucagaauuuauuuuucuuaauguaauuucaaaauugauuuaacuuaagggaaggagagaagaaaaaucagaugugaggguauggaaaauuucaccacacuuaaaauucaugcugauuuggguuauuucugaccuauauagcugccucuaauuuuuccaugcuuuuagguagaacuauauaagagugcauuacuggcaauaauuauuuaucauuuuauuuuauuuuuacauguauuuauguguguuuuuauuauaucuauuucauuauguauuuauuuuauauaaaaaaauugugaauuugaucaauguggaggauauauaggaguagggaaagaugaaggccaguuacgguggcucaugccuguaaucccagcacuucgggagguugaggcagguggaucacuugagcccaugaguucaagacuagccugggcaaaauagugaauccuugucuuuacgaagaaaaaauaacaaauuagcugggcaugguggcaugcgccuguagucccagcuacuugggaggcugaggugggaggauugcuugagcucaggaggucgaggcugcagugagccaugauugcaccacugcauuccagccuggguaacagagugagacucuuuuuccagaaaaaaaaaaaaaaaaaaacgaaggcuauaccaaauuauugaaaagucuacuuuauagaauauuuaaacagaauuugagauguagcuucauaaauuuuuauuuuauuuuauuuuaaaguuaguuuuggccaaacauaggguaacauugaaguuaguuggacuuggacaguagcccuucuuggaugacuggagaagaguggauccugguggcuuuuccuuauuggguugggggucuccauucucuguugacuuaaacacaguuucauuagggauggauuggaaggaauuucuaguguuuucuaccccugugcccacugcauuacucuguuguccacugccccacccccuucaauagaagaacucuacaguaaagucagaacaaauucuugauucugugcuggguggguuucagaccccggaauccauaaauugaagguguuaaggucuuuucccacuguuacguucuuugccuauuuuuacuuuguuuuauuauuauuuuuuuuaacagagcauggcacugauguuaggcucugcauauaauugcauagcugcuuugcaaaguggugauuccaaagcgccuaacagaagcccagaccucggcaucaugccacauauccauguaacacaccuauacacauauccccugaaucuaaaauuaaaaacaaaaugucuguaauuaguauauuuugagaaauuuauggauuguaaaauuauuaguguuuuucuuaagacagcagcuuuucuggguagaaaagauuguaugcacucacaacauauuauaauaguucuuuuuuuuuggcugauuuucccuugaauuuguuuagugagacagaaaaggugaaagaaaugggcuucuuggagcucauaguguuccuccaaugucauaauucucuccuaguaaacuaucgccuggacucucuccaccaaacugacuuuuaccuccucccauucauggaagugucauguuaagaucucugauuaucuccuuguugguauauuacuuuuuuccuucugucuccuugaaaacuucagcuuuuggugaagucauggacuuugguuucuaugucauaaccuuuuaccuuuucuuuaauguuauauuuaaaggcuccacuuugaacacuuucuguuggcuuagagacucccacagacuucucugugugugguccaguccucauuuuccugugugcuagaacccuguccaguucuuuuucccucccacagauucagcugucaucucuaucaucucucucucucucucucucuuuuuuuuuuuuuuugagauggagucucgcccuguugcccaggcuggaguucagccgucaucucuuuaucauuacacuugucucagucuugaaaaaugucugcccauaucagacuugaacuacucaagcuaaucauggcaaacauugagcuacucaaucuuuuuugauuuuugguauuaaaacuuuaaacuuuaaaguuuuaugaguaugaucuguuuuccugaacuugucaauaggauacaccauaguuuaauugauuuuuacauaaaaucaaauuauuggcagagucugccuuuucuuuacaauuuuuuuauaccuaccuuuucuuuaacuuuguuugcuaguucccagucccuuguuaacacuauugugaccuccccagaauauaaauauuagcugucuccccaccccuucuugcugucauuacugucaugcugucauuaauaugagcucauucauuguuuuugccacguuacuuuggcgcuuuagaaccagguuucucaagcuggccuggaauucgcagcagugugccaggagguuugcagugcugaauaaacauggacuaguuuccagaagcuucauuuugcucaaaaauuuaguagaaaaaauuuaaagcaaacacagcuucauuaugaaauagaauacaaaauucacauggauuuuuaagcuaaaaugggagacuucagagucucuuugcuucaagguaguuauguauuggugcucuuaugggauguaccuuguguuaguauccuuaagguauuauugggcuuuagguuauacuacagaucaggcagcaaaagccuaaggccuuuucucuacuucaaagcccuuucucaguauucuucuuauuucuuauuuucuuuagguuuucuuggguaauuucaguuaaucaacuuaacucauuccucugccucucccaugcucugccauuugccuggaauucagccuguguagccuuuuuugaaagaaaggugaugauuucgacaguguguuuguucuaccuggacucaggacucccgugguuuauuacacccaaacauauuuucuuuuggaagaaacuugaguauauugcauacacacucuauauuuuauguaaucccauauaguuacacacaugcacauacacauuuacccuauuuuucuuugucauuuauuuuucaaguguuucuuacagcacuugauaugucuaaggcacugcagaagcaccuucaagggggcuauuaagagaaauaagacaucuaaaagguggagaaagauaagaaagaaacagaucaaguuuaaaagaauuucagaggagggaaagauuauuuuuuggcugcucuuaauggaaugaacuuuuggcugcuuagaauacagugaguuuucauguguuuaucuauauccuuacuguuuugggauacaaauagcaugauucaaaguagucugccuaaauauauauacauacacuuauacugacaauauaaaauacgcauaggaauguaauacauuuucuuuggcuugaauaaaaucuaauuuuugaauaacucauugucuugugaauauagaguugaaggagacuuuagaaggcaccuaauucaaccuuuauuagcauaauuacaaaagaagaaacagacugaagaguugaagcuucacccaagcucuugacucccaguucugugcacuuuaccuuguaaaagaggugaugcucccaugugaugaucuuguguuugacaucaaaucuaauuauguaucauaauuuuuaguuuacucuuuauuaaaacucuuuaugaaaaugacuuccugaacuuuuuuucuauuuaggaagacauuugcucucgucugaaagaucacgugaaacaacuggaaaggaaucaagaagcaaucaaguuagaaaagacugagaucauuaauaaguugacaagaagucuagaggagagucaaaagcagugugcccacuuguugcaguccgguaggugucugguagguccacugucuccccagaagguugguucaauaugcagaaagaauguaguaggauccaugacuuguaaaaauccagaagggacagaaaacacaaucagcaauaaauuucuuuaaaaaaaagaaauauauauuuuuauauauauacagaaggcauauauauauauauacauauauauauauauacauacacacauauauaaaaaaauauauaaagguuuaguuuguuuuuauuaaauaauuuggaagcuggagaccaguauaaaguaccaaauaaaaauaaccguaauucuacuacugagauaauuauuguuagcauuugaauguauuuccuucaaaugaaaugaauguacacacauagacaauguccugcuucuuuauguaaugcauuucugaaaacauacuaaagcugaacaugcaaaaauugaacaauaaaauacauuauaggguaauuucuaucccugaaaacuaaaagugauuauaaaaucccauuauauuuugcuuuuuuaggcccaauauuugaucauauaguucuauccuuuguauaacuucuuucauauuuuuccccucauaauggaauagugacuuaccuagucaguugaggccagagaguuacauuuuugucaugcuucagauuucuaauauggucuuuauaguauuaaguuugagacauaugcuuccuaucauuuuaguuucagcaguuguuuuauuucuuauuaauuuuuauaaaaugauauuagagcaaagaacaauaaaaugaucacguuuguacaaacaccgcuauauagacaaaacuucccuguuugcugguaaguagcucacauugugaaaacaggucaacaguuauucauuaacugauauaugaaagucacacuuuggcauaugaaagguaauuuagacuguugguacaauaugugaaagggugggcuauucaaaagcugaaaauacuaaagucaaagacugccuaaauguauguguauauaugucuugauagggggcaaaauuuggauuaugcuuuauuaagggccccucccuguuuaguuuuauagccuuuguuuucauuuggcauuacuuggugagccuuuuuccuggcuguuaaaugcuuugaaaauauuauuuucuuuaugccaucauugcuucacuuaaucauuucccagauggucauuuucuuuugaaaccuaauaaugucccuuuuaaauugggaacaguccccccaccaccuugcccaguacauuuaaaauauuagguuucuaaaguuucagaauuauaacccuaauacacuucauuuacauguggagguggggaugcuggauagaaaagcaucuacaaagaaguuaaaggcagcacgguauaguuuucuuauugcaggguagaaauggguuccaaagaauuuuuucuuugacuuaccaugaguuggaguguuacgcuccuauuaaaggacuuccggaauguuaaggucuguaaaugugacugauuugauucauaaaaaggucauaguagcccaugccuuuaacugcccaaggucauaugggaugccauacuaaaucugggaaaugucuggcccagaccuaugccuucugggucccaugggcucuauguauucuaaagagacaguaguaguaaagcagaacuuuacuuucuguagccucaguggauucaagucuucuguagaucauaagcacuuuguccccuuaauuuuuucaguauauccuaugguucuuuccucugcagggucaguacaagagguggcucagcuacaguuccagcugcagcaagcacagaaggcacaugcuaugagugcaaacaugaacaaggcuuugcaagugaguguugccacuuggaagaggcucuauggguaucugaauuaggcaguaguuacaucaccuuuuugaaucuuggguuucucuguauaauagaggugguuggaccaccuucaaaccagcccaugggaguuguucaccaucuccuucacacaguuggcaagucaaacucaggucugucuaauugcagagccaaggcccugcacuuccugccagcuugccugccaccuccuucaaguggcauguccuuucaucuuuggguguaucccagagaucaguucaucuauggggguggggaauguugaauuuugcugcaauucugucauauccuccuccagugcuauuuacauuuuccacuggagggggaggaaaauaugggagaagaguuccauuauuaccuccaccuuuucaccaccggcaggcuaaaguacaaccuguucuuggcaaaccagcguacuuuguccuguacucuaguaagccagaaagcgccgccaucagcauuuaagcccaaggaacacaccacuuuccauggaggacaaaaucuaagagacagagaugugagaggaaauccuuauguuuguuuucucauucauuuauucauuuaggcuuuacuugaaaaccugauauaugccgaccuuuauaaaguauaauguguacuaauaauauauuugaagaaguuuuuuugccuccuguugaucauuaaaacaaauuuugaaacagaaugacugauuacuucauauaggaaaauagugaaaauuauuuuuaauaauuuuguguuguaggaagaauuaacagaacuaaaagaugaaauuucucucuaugaaucugcugcaaaacuaggaauacauccaagugacucagaaggagaauuaaauauagaacucacugaaucguauguggauuuggguauuaaaaaggucaacuggaaaaaauccaaaguuaccagguauggaaagaauauuuuaguuuacuguagaagaaccaacauuaguaaugcugaugaugcaugguaucuguuuuaaggugagagcguauuauuuucauauguuaacacuguguauugaaugcagauaccuugcauuuaucagugauaguauaaaaaauauacauuaauuuuuccuagaaaccuuacuaugaccuuacuuuuaaaguagagauucugucuuuuauauuacugcuuaauacagauauuuuagcaaucucauaguaggaaguauuuuaucacuccugcuagagacugacuagggagggaguaguggugguuguagaaggagaauuaaacacuuaaaggacuucagaagcacuugcugcguggaaggugcuauacaaggcucugggaauagaguacaaaagaugagauaggaacuguccuucccacagggagcuuacguguuuucuggucagggagaaagaaacauuguuggaaacaacuaagugcuaugcauucaauguuauguuugauguauagaggugggauuuacacauuuccuguacugguuuuggauagggaagagagagauacgguguuuggaaaagauuguauuuagguuaagaaaagauuuuuggaugcguuuggcccuuaccaccacccuuuuguuuauaguuuaagauggaguucgucaucauuguugaauuguaguuuccagagaguguuuaauacauguuguauuucagguauuacacaacuaaauacaaauauauaaauguccugaaaaguuugcucuacgauagguuuuagaaguuacauauuuugagacugugaucucauuuuaagaacaguaagaugagauucaguaaguagaaauauaaagugaucaggugauacugugaaaguagaugguauuauucuaguuuaguaaggcuccauuuaucuagaggucugucuucagggacucucaucccuacaaaucacagcacugcuauccagaaggaagcaaagaagaaaauaucagaacuggauuauaugauguauuuaguaggagccaccuucaaguucuuaucccaggaccauauugacuuagauuuauuuguacuccaugaauugucucauuuccuaaccaacugcagagggcuagggcaaggguugggaaagacaguauccauccuucggccagcagcucagccuuagcaaggagaaaacuauggaaacccaacaggcuagaguugcugaguaucacagcaaauagcucuacacauuuacguguguuugauccacaucaaaauguccacaguuaugaucccaaguugucaaagaaaggcuuccaguuugguuaguaaauuaaagcaaaaaacgaagugcauuauaucuuuuuuagacagauuuacauaaaauguuaauauagucaccuggaaaauucacugcugugaaugccucauuuccugcuaaugccagauuaauucuaaggggcuacugggaagagcgugggcuuuagauccagauuguuuugaauaauaguuuugccauuuuauuaccagcuuugugagcuugggcaaauuucuuagcuuuucugagccuguuuucuuaucaagcuuaaaaucccuuggagguuaaacugaggaauaaaauaaugaauauaaaaggccuuauguaacacguucuaacauauauuaggcaucauuugauaaaugauggcuguuacuauuguuauacaguagaugguugauuaaaacauaucacugaucagauuuuauauuaagucacaugaauuuuguauuaauucaacacauacuuuguaaauguucuugauucucaaccuugugaaaaauaucaaauccaauaucaacaugugagaguuggaaaaaccagagugaacuccuuugcuuaguaaggcagacaauuaguagcagaaccaguacuugaacccagacuccugagaaaggcucgguugucugucuguucauauuuacaugucaguuaaaccuuuuugccuuaaacuccuuucuucaugucuuuuauuuuugaggauuaaagauguaguucaugacaaaaaagauuuuucuccaauuugugauuacuuuuaguuucugcucuaguuggucugggaauuggauaaauaauacauuauguauguuuaucuuuucaaauaguuacuucuucaugaugucuauuaaaacauauucugcuaccuuuacacuuucuauuuacuuagugcucauagccaaaauccuguauucaucuuuuuuuuuuuuuuugagauggaguuuugcuuuuguugcccagaccggagugcaauggcaugaucucggcucacugcaaccuccaccucccagguuuaagcaauucuccugccucagccuccugaguagccgggaauacaggcaugugccaccaugcccagcuaauuuuguauuuuuaguagagacgggguuucuccauguuggucaggcuggucuugaacucccgacuucaggugauccucccaccucggccucccaaagugcugggauuacaggcuucagccaccgcgcccggccuccuguacucaucuuaaagcacauuccuauagauaauaaaccugagacaccgcaucauuauuauaguaaaaggaaugauggacgcauucagugggaaagugaagaauaaagcacagugugauuagucacugaggcucggcaaaaagacauccagugaagcacaagauaagcgaagaaacguuuugcuuguagucaucccacccaccagcaguuuauuagaugauauuuuggcuucguggaaaacuaaaagcuauuauacucagaucaaauucaaaggagauaaaggagagaagauauuugucucuuuccccuggucuacugugauuccuagaauaaggggaagcaauaauuuucauguguugggaauuuuaguucuuuguugacuugggcugcuuucaaaucacugacucaaauauugguggcuacaagcuuuuauuaccaacuaccuccucccucaagcuacugccuaguaaauuuuaaggguuuagccucaauguucuauuuuacauucauggaauuugaguagcuaaaucugcaugcagcuugcagacagcuuccucucucccuuauuauaguuggcugcuaagcucaaauaauaaacauuuaacaaguggaaugccuuuucccuuuggucuucucagcaggcuucauaagggacuacaguuuauuuggauuuaggagaacugacuuccaugggacucaguagugagccuuuuucaggauuggucacuaccacugauuuuuuuccccuuugaggaaagaagagaaaauuauuuuagcaagcacuuucucucucugacuuggcucccucuaggaguacaggaugugcuauuucaguggucagcauucaguaagaaaagaaauuggggaugcauaauuuguuaaccgagcaaaauaaucauucugcuuaagguuaguucaccaugucuuauggcacaggaaguuauauuguaaaauauuuuauauuucuuguaauuuauauuuucuacuucaauggaaauagaagugguuuaaaugagaucuauguauauagacagacuacuuacaaaauauauauauauauuacauauacaaauuugcauuuuguauugcaaaagcuccuuuuauaacauuaaaaagccuaccuaauaguuuguucauuuucucugucucgcacacccauacacacagacacacacacacacacacacacacacacacaauauucuaagauuuuauuuggaaucaucuaaaacugaagaacaguaaacauuuuaacucagguaguauuuuuguuucuaauaaagguuuuuuaaaaauauauuuuuggaacaguuuuuaauuuacagaaaaauuuguauuacgcagaguuccuauauacgauaugcugcacccauuuuucccuacuaauaccuuauguuaguaugguacauuuguuacaauuaaugagccaauauugguauauuauuauuaauuaacauccaggguuuauuuacaugcccuugguuuuuauuuaacauacuuuuucuguucugggaucccaaccaggcuaccccauuacauuuaggggucauguuuccuuagauuucucuugacuuuacuuguuuuugaugaccuugacagucguaaggaauacuggccaaguauuuuguaggaagcuugucuauuggaauaugacguuuuucuuaugauuacguuuuucucauggguuuuguggagaaagaccacagagacuuucaucaccucaucuuaagggcagauacugucaacuguuuauuucuuuucaaaaguaacuuaauccuccauuaugaaaaaauuagaaaauacagacuaaaaaagaagaaaauagaagucaccaauaaucucaccuuacuucccaugaagaaaaccacuuuuauauuucaguauaaaacuuccacaucaccuguuuuguauguuucuaaaagauaaaauaauauugauaauauuucuuuauaaugucauuuuacuaguauauucugaaaucuuugaauauuagugaauauuuuuauagauuacuuuuagugacuauguagaugaaugaaccaguuuagcuacuaaaucgcuguuuaaaaguuuuacuuauaaauaaugcaauaucauuguuauaagcauccuuguagucaagucuuuauucacaucuuugauuacuuccuaaagaaguagaauaauugucuugcuagagggugugcacuuauuugagggcuuugaugcauauuacuaaacagcccuaaaguuuacauuauuacccacguccugaggcugucccuauuucuugguaaccuagccaguauugagaguuaucacuuuuccuguuuauaauuuuuauauaguuagaucugucacuguuuucauuuaugguuucuugauauuuaaaaauaagguauuucucuaguacuuucuauaguuuuauuuugcuuuuuaaaucuuucaaauuaugaaauauaccauauaaaaaacauggaacauaaauauauagcuuaaugaauuauuugaaagugaauauucguaggaccaccacccaggucaagaaguaaauauugccacgagcugcccauauucuuucuuauuguaaccuugaggcuaacuacuaucuuaucuauuagggcaaucauuuucuguuuuuuuuuucccuuagcuuuuuaauacccaguuauucacaccuaagcacuacagauuauuagauuugccuucauaugaaggaaacucauacguuagguguuuggguuuucuuuucuuuuuuuuuuuacuguuuuauugagauauuauuucacauaccauaaaagacacccacuuaaagaauacagcucagugguuuuccguauauucacagaacugugcagucaucaccacaccuaauuuuacagcauuucaacauccccccaaagaaacuccaugccuauuaccagucauucccauuaccucuuccugccuccacagcuccagacaacuaaucuacuaaucuacuuccugucucuauggauuugacagcucugugcauuucauauaaauagaaucguauaauaugaucuucugugaauuuucuuuaccauuucuucucaagcaugucugcugcugacagagucuguuuccuuuuaugaaaauauccuuauauuuguuuauuauacaauuccugaccaauuguucuucuauuucagcacauuaaagcuauguugguccacucucucuggacucaaugguuucugugaagaaauucauuguuauuugaauuaguguuucugucaguaauguauagguuuuucuuuugcugcuuuaagaauuuuuuucuuuauauuuaguuuuugguacuuugauuaugauauguuuaaguguguuuuucuuuaguuuaucucauuuuggguucucugagcuucuugaauauauaaauuuauuaugucuuuuaccaaauuugugaaaaugucagccauuaauuuccuuaaauaccuuuucugucucugugucuuuguucucuccuuuugggucuccaguuacauguauguuagauuuuuugauauuauacuacaguuucuugaggcucuguucauuuuuuucuauaguuuuucccuuuuuauuuugcauaauugcuacuggacuauuuucaaguucacuccuuuuuuucuuguccucuauacucuauugagccuaucuagugaagguuuuguguguuuuuauuuuaacuuuuguuuacuuaauaacauuucuauuuuguucuuguaucacuuuucuuucucuguuaagaauuccuguuuuuuuucauucacuucaaguaucuuuuucuuuacuucauaaagcagagauauaauagcuacuuuaaacuuauaaaacucuuuuagugacaguuccagcauuuggaucauuuguugauugucuuuuaagauuuggccacauuuuucugguuaguugcaugucaaguaauuuuagauuauauacuagacauugugaauuuguaugaguguuuuaaaucuguuugguucuccaagccuuugccacauugcuuugaauccaaccuguguaugcaucccuucggguuuagucauugugagacuugaaugugugguuuaaauuucaguuaaguuuuuaaaaucuuugauaugcugguuugaggguugcccuguacaugcauaguucagggcuuagacugaggcuuguacaaauuuauacacagaauucaggauuccuuucucugguucuuuucucuccgggagucuuccuacacucucuuuuuaucacuggguuucagcaaucugacauuggugugauguaugcugguuuucuuuguguuuauucugcuugagauucaccaaacuucuggguuuugugggguuuucauuuucaucaaauuaggaaaaauuuggccauuauuuuuucaaauauguuuuccaucccucuccucuucugggaguucaguuacacauguuggaaaauguaauauguucuguguauuucuguuuuagucuuuuuuaucuuuguuuuuaauuauauaguuuuauuucuauaucuauguguucacugaucuuuucuucugcaguuuuaaauaugcuauuaaccccauccaguauauuuuacauuucagauauuauaauuuuuucuauaaguuuaauuugagucuuuucuguaucuuccauuuuccuccacauauucauaucuuccuuaaccuucuagaacauaugaaauauauuaauucuauugucugugucauugauggguuaguuucuauugauugguuuuucuccugguaugguucauauuuuuuuccuacuucuuucuaugccugauaaauuuugauugaaugcuagacauuuugaauuuuguuuuggaugccagauauuacuguauuuuuaaaaauacuguuguacuuuuucugugacacacaaguuacuuggaaucaguuugauccuuucaaggcuuucuuuauaggcuuuacuacaucagguuuagaaaaggcuuuaaucuggggcuaauuuugccccacuacuaagguauuauuugaugcccuuuaaauuaggaagucuuugcauuauggcucauugaaacauaacauauucccagccuuauucauuuccuauguuuuuuucccuagccacucauacagaacagaucuccagagcucuuuuucugugcagcuucuuuuuccccaguauuucuucccuucauauucuagccacucuggacuccccaaauucugaauucuuucucugaaacucagugagauuacugggcucuguuuggguuucaccucccugugcuauggccuggacacucuccaggcagaaagcugggguaaucuuagagcucaccuuguuugcuuuccuuuucucaggaaucccuggccugugcugccuguugucuagugauugaaaacuauuauuuuauuugcuuuauuugguuugcuaguuuuuuaaggaggaagauaaagguuagucuuguuaauucauuacggcaaggaagcagauaaucucucaaucuuuaaauuuauugaaacuaaaauuggguuuaaauuagcaugguuuuauuuuuguguuuuucuaguuacucagauauucacccagacuuguguuuuaguaaguugaaaaaaauaacagaaauuguugguuaggauggcuaguguuuaguauucuuuucuuccuuaauauuuauguuguuucuguuagagucauaaagggcauguauauacagcaugcaguuuuccaauaacacaaauguaaauuaugucaaaguucacauuucuaagcuacuuacagugagcagcaggacuaagcuugagaaggcucuuccugugaauaaacguauuucuguauauagagacauggcaaaggugauaauccuuguguaugacaacauuuaaaauuguuuugaaauacuaguauauaauuguauaggugacaaaacauguucaccacuguggucagugcuuuuagggaauaaccaugucugauuuauuacuugauuuaauguuaaaaaucacaauuucuccauuagcauuguacaagaagaagacccaaaugaagagcuuucaaaagaugaguucauucugaaguuaaaggcagaaguacagcguuugcuggguagcaacucaaugaagcgucaucuggugucucaguuacaaaaugaccucaaagacugucauaagaaaauugaagaucuccaccaagugaagaaggaugaaaaaagcauugagguugagguauguaaagccuauagaguuaaaaaaccauuuuuaaaaggcucaauaaagaaaacuuuuacacuuuuuuuuuuuugagacagggcgucacucugucuuccaggcuggagggcagugguggaaacauggcucccuguagccucaaccucccaggcuaaagcgaugcucccaccucagccuccugaguagcugggaccacaggcgcacgccacuaugccuggcuaauuuuuaaauuuuuuguagagacagguucccacaauguugcccaggcuggucucaaacuccugggcucaagcaauccucccaccucaaucucucaagguguuggauuacaggugugacuaaccacauccagcccuuuuacauguuuuuaaauuaauaaaccuuuggcuuucaggaguuuauuugacauuuuuagaaauaaaguuuaaagaaggaaaugccauuuuuaaagggauacugacagucccugacuuaggaugguuugacuuacaauuuuuagacuuuacagugguggaaaaguuaugugcauucaguagaaaccauauuucaaguaccuguaaaacaguucuguuuuuuacuuucaguacaguguucaauaaauuucaugagauauucaacaguuuauuauaaaugaagcuuugcauuagaugacuuugcauaacuguuggcuauuauaaguguucugagcacauuuaagguaggccaggcuaagcuaugguuuuaauagguuagaugcauuaaaugcauuuuugacuuaaugauauuuucaacuuauaaugauuuuauuaggugauaaacccauuguaaguugaaaagcaucuguauguuuuuucugguuacucuuggcaccuaguaaaugagauaccaauuagguaaaauuccuuuaccauaaauacaaggaaguauucucuguaacaaggaaucugcauuucuuuaagauuggcuuuuaccaauagugcucuaaaaucuaguuaaaauaaauccuccauagaaauccuguaguauuuucuaugagauuuuccuggcccauguucuuacaacaaaagucauucuauaugaggacauuaauuauauagugaugaugguacagauauuauauaguggucgugguacuaugggaaaguacacaaaaucugguuuugucagucauugaaauccaccucuguauucuucaguucggaaaaugaagcuggagcacuuugugacacuuuugaauuuacagagccaauuucagacaaauugaaacuaaacacaugacuaauaaguaagucaaagauauuucuguaagaucaugcuaucacagagaucuuuagggcugcucuccuuuauagauccuuuuuuuuacccuuccauauuucacaaaucaucagccaucuauacucccaauagaaaauaauauauaaaacaccuaauaacuaagaaaagcaaaagaagagggaaaaggaauguggguaguauacuccuuuuccuccuggguggagauaauuguuuacuuccuucuuuaguacuguuuuaucuccuauuuaaacuaggaguuguguucauuagaacaguucugcuaaaguauguauaauauucugugcuaauuauuguggaauuuugauugugguuaauuuuuauauuuuggaaaaacaguguuuuugcuaucaaaaucuuuuccagccugauucccucuucugaguaacuacauuugaugacuaaaacauagauuuuaauauuaacagcaaaugagagagacuccuccccgcccugcccccugcacauuuaacaucuuuaaaucaagcuguuuucauuguugcccuacauuucuuuaaaaggaugggaaugaaagcuuguuucucaauuugcauuaagacauuagaguuuauuaguuuaagcauuuuggugggagugcucuaggauuuaggauacuagaaaccugauuuugagucugaaccuuagcucagauaucuuggugcuuucuuuguucuguauuaaacuugcuaauggcauuugcuauacagauacacuuuaucauguguagcaguagauaguggucaugcauuguacuguuuuuuagccuucccauuuuccucuguagucugguugaucaauagaucaaaggaauaacuaucucaucuuugaguauucuuuuuguccagcuacucuauugccauagugaauucucgguaguguacaucuaaacuccaauuuuucucaaaguuacuucagcuguggacucaagugaucugcccaccuccaccucccaaagugcucggauuacaaggaugagccacuguguuguggcaaagagcucagaguccagguacacaacaagugaaacggaguagauauauuuuuaaaaucuuuguaacccccaucaaugaauaaaaagaaaaguagauaaggaaaacucucagaggaaaauaugcaaaguuaaaugaacagauaaaucugggaagguggaaaaacaaaugaacaaugaagguauauaagagguuccacuuugguggugacacaagaaauacaaaugaaagcaauuguuagauauucuuuucccaucaaagauaauuauuuaaagauaaucacugccauuggaggcaaagagagaugggcagacccauguacuaccugacaguauacauuuggaugacauuucuggaaggcaauucgccaaagucuaucaugagucuuaaaaauuguauguauugaauaaaauauauguccgugagugaaugcugacauaaaugaauacauacagaaauagaauaaaugcuugaucuuaguaggagaacauaugaugagaaauaggauauuuguauugucucaaaguauccuauaagauacuuaucauuuauuauaaaacaaaaaauaguaaguuuacaauggagaugacagaucccaccuucaauugauuauuaccaguggugagacauagugauaucaugugucuccugcaaagagcacauaucaguucuugacaugcaugccaaagaugcauaaccugauuuuaauaaaccuaaaaacuccaaauugaggaacaucccacaaaauaacggguuaguauucuuagaaaacaucauggguuugaaagacugaagagcuguccuagauuggaggagacuaaugaaacaugacaacuaaaugccacucagaaucauggauuugaucuuggaccagaaaacagacauuuggggcaaauuggagacauuuguauaaggucuguagauuacuugauaguauugcaucuguguuaauuuacuaguuuugaugauugugcuguaguuauauugggggaagaugaguaaaagcuauauggagauuauuuguacuguuugcaauuuuuuuaaaguauggaaguauuucaaagugaaacuuagaauuuuuuaaaacuuguaaaacuuuugaccuuuuaauauucagacuaaaacagauaccucagaaaaaccaaagaaucaauuauggccugagucuucuacuucugauguugucagagaugauauucugcugcuuaaaaaugaaauucaaguuuuacaacaacaaaaucaggugauuaaaaauauuuuuuauauuuuaugagaauuuuuauuuccucauuaaauacaaaggauauaauagaguuuuugcaaauaaagaggcaaugugaguuaguagacaaguauauuagcaggugauuaugaguuccaguuacuucccuuugcuagugaacuguugguuaguaguuucauuggaagguaaguuaguguaguuccaguucucuuucucuaugguagcauggcugacagagguauucuuuccuccuuagccagcucuugacccagaaguaaaacuuugcuuauuuagaugguugcugaagauuauugaauucugagacuuauuuuaaggcaucagcuagccaauacuucucugguuaaauauuuucauuuuauauauuucaaaguaaauacaaaauuuaaacguuuaguccugucagaaaacuacuugucaaauaaaugaaucuauguucuuaucaaagcgugaagagacuuuuucuuuugcagaauuguaaaaauaauaugucaaauauuguuauaggggagagagaaagcauagaaaauauuaaaaaauaagacaaaaucaaucagugaaaaugauguuuauuuucuguaaguacuaaguuuauucuuuugugucuaggaacuuaaagaaacugaaggaaaacugagaaauacaaaucaagacuuauguaaucaaaugagacaaaugguacaagauuuugaccaugacaaacaagaagcuguggauagguaaggucuauauagaugccugacgacugucuccuggguacccuuccccucuaagucccugcccuucccugugacaaaaagauucaaaaugauugagugauuucuacccuguugagaucuuggauuggcagagaugagucccuggcuucucaaauuagaauuuggaacacauuuuccauagaaacaguguuauguaguggguuggguucuauaguaucauugaaacuguaguucacugaaauauuauagguuaauauuuuuuuaaagacucgucugggaaacuauucuuuauaaagaaaaaagucugugagagggaauaugucuuccaaauaccaaaucauaaacuuggaaacagacuucuggaacauaacuuacuugugaguuggggacugcuaguauuuguguuuaauauagaugacuugaaauuuuggagccacacccucaauuauugccauuaauuuuuuauaaacagaaguccucaacauagauuacuaucucuauuugaaggacuggggcagucucacauccaaguuucuaauuguucucuagaaacauuugaagaaagaaaauuuugaagauucucauaagauuguugguuauuaauuaauuauuaccacuuucaguuggggaaaaguuaucugaccucaauuauaauuugcauuagagggaagaggugaggaggaaggaaggaaaccaauucauuuugguguucguagugagacugggcauugccuuugauuccgcucuguuuccaggugugaaaggacuuaucagcagcaccaugaagccaugaaaacucaaauacgugaaagccuauuagcaaagcaugcuuuggagaagcagcagcucuuugaggcuuaugagagaacucauuugcaacugaggugagaauaaagaguuuagcugccuuuuaagcuguagagacuacauuccccuauuccauaauuuagaggaaaauuguuuguuaugcagcucuuguauuuuuuugugguuaaaucauuuaguugcugguuuuguguauccaaggucugaguuggauaaguugaauaaggaggugacugcugugcaggaauguuaccuagaagugugcagagagaaggauaaucuagaauugacucucaggaagaccacugaaaaggagcaacagacucaggagaagguacaguacaaguuuauguuguaucgacauccuuucacucuucaagccucaguauuaucauuuaaacgaauacauuuguucuagagaagugaauggagaagguauucauauguucucuuuacuuuuggcuguaucacacucauauagcucacaaauaaaauacaguaauuacugaaaugauuauuaaaaccuuaauguacaauggcauauagauaggagaaagugauuuuuuuuuucuugcagauuuauucuaaagggcaaaaaaaaaaaaaggaucagugucacuuuaaaucugaaaaucacagauccucauuuucgguguugacuguucaggaaacccuauguaguccugugagcgcugcacggagcauucguucagagcccuuuuucucggauccauuucuuucucacuaccucauugucauuuuauucuucuggggagaagaguaggaauuugaauguuggucucgugauagggaaagugaugauauggaggauauggacagcaaggucagcaucuucguaugaccuccuucagggaagcuggaggggcuagaguagauucuccaacucugccugauucuucugagucacucuuggugaguguccaggaguaaaaucacauguaaacagucacaccuccucuuuucuucccuguccuggcccagugccuuaacaggccugacuguccuucacacuuuggaccagcggcaaaccacaguuugaaagcuaucugccucaagauuagaaaauauuuuuaaaugcuuaaauaaauguucuauacagagguuuuugaauaaguuauguuaaagcaagcuauuacuaccacacacuuaaaaagaauaguaaagagcaggcgaggaauucaguucauucaauaucuugauuauuguugaauagauuaauauggugaaaaaugugccauguauacauaucaucuaguggaaaaagaacuucuaaagggagcuguuuuagguagggauggcaguauaaaagugagaaaggaucuuauauuaccuugaaauugaggacuuagcuuucaguaauguuuuaaaaauuaaaauagggaaaucacuagugugauucuuuuauauguauaaaaauuggcggccgggcacaguggcucacgccuguaaucccagcacuuugggaggccgagacgggcggaucacgaggucaggagaucgagaccauccuggcuaacacggugaaaccccgucucuacuaaaaauacaaaaauuagccgggcaugguugugcgcgccuguagucccagcuacacgggaggcugaggcaggagaauggcgugaacccgggaggcggagcuugcagugagucgagauugcgccacugcacuccagccugggcgacagagcgaaacuccgucucucaaaaaaaaaaaaaaaaaaaaaaaaaaaaaaaaauuggcaagaacauaagaggaauuuucucaaagaggucauuccaggaauauuuucugauacuuuuaauagaaucaauuugacuauaaaauaugaucucauauaaugggucaguuacaauuaguaucugcuauugacugauauuuuggcucaugaguguuuguacacaaguccaagaagaaaaguuaaacugcuauuugauccuucaaaaaaaaaccaaacuuagagguuaaauuuuucacguguaucccaaaacuuaaaguauaauuaaaaaaaaauuuuaauuguuauacaguaaaauugacuuccucccaccacugggcguauaguucuauaaaccuuuaacacguuuauaguuuugucaggauacagaacaguuuuaucacccuaaaacgcucccuuuugcuaucuuuuugugguuacacuccuccuccaaacccaccccucacuuaaagggccaguguacuuaaagcauuagaaguuuaauuucuucccucucugggaauucauuaguuuuuuacuauagaauuauauaagcccuuaguaguauaagccagucagaacugaaacaucuuuauauuuaggagacugucuaaucuucucacauuuuucagagguaggcaaaaauacaccuuuuuuuuuuuuuuaaaggaaauguuucacauacaugggagaauguuacuaaacucuagaacaagugagggcacuucugggguagcucuuccaugcaggacauaagccauuuuacugcagcuuagcuuuagguagggaauuuaaccuggauacagaauauaugagucagguaacaauaagaguuaaaggguguuuuuuuauguuucaugcauuguuuucugaaacacuugcugagucagguugcagguuaaauaggagcucaauuccaaguuuuaaagcuuuuaguagcacacagaacuuuccucacauguuaaccuggcucauugagagaaagggggaaaaaaucauauacacggaauccuucagguuggguaguaaucagugaagccuaugaauuugcagacaaggcaaagauggucaacauucccauuccugaugccauuucuaugcacauuaaggcuuauuuauacaauuguaauaugaguuagguaggugcauuuuagaaguuagagggauuuuuuuugcuauccaagacacgcacaacaaguucauguuuuaacuuggagacuguuaguguuguagagagauguuuauuugaauuuuguuuaaagagacagcuauuggaggaaagagaagaauauguaagcaaacugcagguggaacuugaaaaaaaguaccaagauacacuuaugauggaaaagagcaaguggcugaaagaucaagaaacugauauuaaacagcaaguugaaagugaagugaucuuagccaaagcacauugggauaaggaagagcaagagguguggauuaaaauuucuuucuggucaccacauuuuuaaaaugugguacuaacuuuagaagacaauucuucuugaaccagauacguaauuuuuauuugccaggcacuuacauaaucauccauuuuaccuuuuggaauugagcuauuagcaguuaccacaccaguuuuauuuuuaggaauuuagccaccucuugacuuuucgacccaacucaggauauaacaaguuuuuugggcacuucuuugauuccucaaaaugaaaccaugaucugauuucauauuguggaaugauuauaacucuagacuaauauuuauaacuaacaaauaagccauaucauggauuagaaacaaagaaguaaugggcagucucagaagcccauaauuuguuaccucuauuacuuaaauagcaaaugagauuaggaaaugcuaauaguucccuagcaaguuagggaacaaaguaugauccuaaaagcuuauuuagaaaugaaaacaaaaaagaauucucaagcuuauuuaaacuaaauuuuuuuuuuccuuuuuugagacggagccucgcucugucuccaggcuggagugcaguggugugaucucggcucacugcaaccuccaccucccgaguucaagugauucuccugccucagccuccugaguagcugggauuacaggcaagcgccaccacacccagcuaauuuuuauauuuuuaguagagaugggguuucgccauguuggccaggcuggucuugaacuccugaccucaggugauccgccugccucagccucccaaagugcugggauuacaggcaugagccacugcaccuggccucaacuagauucuuuuaucuacaaaauggcuauuaauugcuauugaucugguagccagggaaacaguaggagaacuucagauacccagguggugaacagaaaaagggaaaaccaaauugugcaguuucauaguuuugccuaagacuguguuuagcuccaccucacuguacuguuaaaguggaaaaaucauuaagauguucuuccaauaauacugccucccuuuugaauguagucuacuuaguaaaauuuaacacuauaacaaauaagauucuaauguguucaagugaguaaaacuauuuuuuagauuguucagguuuugguucguuaauuagauuuacucgguccuuuguggagagcaugguguugauggcaaaacacauuaacuguaauuuuuuuuuuuuuaaauccugccaucuuuguaguggcaauaggaaagauuccagaagguuggauauuaagagcaagauauccugacuuuacacaacauacuuaaaucuuucaugugauuuuugucauauaguuaaguucaaagaguaacuuucaaguuuuacuugagaguguauuuuaauugacuaaauuucuaaaccuuuuauaauuacuacaacaauaucuagaugguuuucaaacacagcugugguugcuuuucuggcuagcuuuuaauucuaguuuuuacuuauuugaaaauuguucuucucguaugauuuuucuucugaaaacagaucaaagaaaaacucauucaacagcuugaaaaggaguggcagucuaagcuggaucaaacuauaaaggcaaugaaaaagaagaccuuagauuguggcagccaaacugaccaaguaaccaccagugauguuauuuccaagaaagagauggcaauuaugauagaagagcagaagugcacaauccagcaaaacuuagaacaagagaaggacauagccaucaagggggcuaugaagaaacucgaaauugaauuggaacucaaacauugugaaaauauuaccaaacagguaaaaggcagauuuauucuaguaaauuuauuggaacugccugucucuuaaugaaaacccauacaaugcuaucauugaacucguucauaacuuuauacuuuuaagauuuugugcauuucuaggauagaaaaccugucauguuccuaaauuuuucuucauaauauuucugucauaaagcugccaccccucgguuuuucuguauauucuuucgguuuacaaaauauuugcuccuuugagauuagucuaagcauuaagaugcccaagguuaaagagggugcuuuuuacaucugaaugaaucacaguuuaauuauuaaucuuucauaucuaauuuuuuagaaaauauuccacuaaggugguuauagauaaguaaaccuaagcacauaagguauuuaacaacauuguguggagacuugaugugguuggaucugcaggcgugcccuuaaauggaacuuuaucuaucauucccaucagcuuuccaaaaguggugccaauaccuuuccuuugaggcacucacaaaacuagcuuuuaacugacacaguuacuugauuugaaagaaaugucauacugagaaaaguacagccuauugugacagaauaaagaugaguuaucuguuauaucuuucuuaccuauuacagugauucucaaaauuuuggucccaggacuccuuuacaauuuuaaaaauuggggacucuaaagagcuucuguuugugugguuuauauuuacacuauuggaaaaucugagaaauuuuuaaaaaacaaaaauacccaagcacacauuccacugacugucagaacaaugacaugaucacagcaugcagcuuuuggagaacugugcuguuuaugcaugagagaacagcaauaaaacagauagugucuuaauauuauuuuggaaaaaguuuugaccucacagacuaccugacaggguuucuagccucaagaguuccuuggacuuugauacauccguuauguaguuauuuuaauuuuauuacuuauuauaaacucuuaaacaagauagcacucaauguaaaguuuuugaaaauacacucuacuuuugauaaauacuugaaauucugcuuauuuguuacauuguucuacgugauuuuacagggcaccuuuaaagucuggaaauacaggcaaauauauguaauggugccaaggauaucuucaguuaguuuaccgaaauguuuacugaaggggguuucaaaagaguuaagaaaacguuccacagacaaaaaguugaguuuaaaggugcugcuuugguauuuaugaaauuauuaaucuuaaauagcauaauacagcagaaaggaaauauuucauaauaacuuuuuaaguagauaaauuucuacaggagcuuuaucuuuuccccauuucuuaacuccuuggaguuuguacguagacagaguuuacacauugacauauuuagcacuuuaacgagaaauacagccucuuauaucaacccugcuuuuguguuguauguacguauauauacauauaucugcauaucuguguguauuuuaaaauaaaggaauaagguaaaauuauuuaacauaaucuucugguaacuaguggcagauuuacaaccagaugacccucauaauuaaucaagucuuaauuuuuucccuucagagguaucacccucauucuuuaguauaaacucauucucgacaguaggaaaguucgcagguguagggcucuaaacuagaucaguguauguguucaugcacauguguagagcaugaggagucaggaaggugguggguguagugauuagacagcaguuggcaccaagcaguccuccaggaggccuucucuuucccaggauaaauaggaguuguuagaaaugguaauugguaccucguaugacacuuucuaagauaguacuggucaucaaacauucacagauucccacuuccucuguugcauuuguaugggaugcuaugggaaguuuacaacaaaaggauuagaauccacuguuugggauagguaggguacuugcagucaguuugacuuuauuauguagugauauacaguauaaaauacugaaaucauaauugcuguuuaaaaaugggaucuuuuuuaaguuuuauacuucccuuuaccucuuucuuuugcaauguccuacagguagaaauagcugugcaaaaugcucaucagcgauggcugggagaacuaccagagcuggcagaguaucaagcacuugugaaggcagaacagaaaaagugggaagaacagcaugaggucucugugaacaaaaggguaagagcucuucugcaaagacacuucaggaggcugucuuaccugaccccuucucuuaucucaguccuuggaauuuguaccuacucauagaauuguugaaggauaaacauguugauacauguuaagcaauagcucaaagccuagcaaguguucuugucaucaucaaguuguucuuagagaaagaauguauuuuccuaugaggauaacuuagaaacuauuuaauaacucccauucuaucuugcccuaucuuuagaugaaauugagaacagguauauauuuguuuauuauuagcuauacaguauccuuucacaugcuuaaagauuguuuucucuguuguguuaguagucuuguaacauucuucuugguaaauagccaguucuccuuuccagaaaugucauguuucuugacuggaaaauacagauauuauaaccauguguacucuuccaacuuaauuacugguuuaaaccaauucuaaucaaaaugccaacaaacugaauguauuugaaguugacaaaauaauucuauaaaauguuuuuggaaaaauaaaaggacuagauguuuuuuaauguucuggaaaaauuauagucaagcccuaacacauaauggaauauauuggaaagcaacaacucagacuguauugagucacaaaaauagaauucauuuuaauucagugcaauacagguuucagagguaggcccuacuauaaauaaaagcuuaauaaauuguuuuaaaacaagggaaugaggaauuauuucauaauagucuuaugauagccagguaacacuuuggaaaaauuaaguuuacccaacguguaucacaauaaauucuagguuaaugaaggaguuaaacauuuuuaaauaaaaguguagaaaaauuaaaagaaaauugaagauuucagaucuguaccauaauaacaacucaguuuugaggcaacauauccaauagcaaagauaaaguaauagguugaaauauguuuuguuuuuguaguaaaaaguaaagggaauaauaaaaauaagaaaaauggauaacacaugauaaauuauaaucuauauuuuuuaguaugucugaaauauuuuaaaaggaaauuuaagagggagagagagaagaaacaauaugauugugaggauaugugucucagagcucagaagucaaguagaauaguaaaguugaguacaauguagaaaauaaaacaggccaagagaucuuuucauaagaacauagaaggcuguauguuugugaaagcagacauauagaaaugagagaaaaguguuuuuguugcuucucaaacuucagcaggccugagaaucacuugcaggguuuguuaaagcauagcuaucugggcuuuccuccuagagauaaugauauaguaggucuggaggguguccugggaauuugccuuuuuuuuuuuuuuuuuuugagauggagucuugcuguguuucccaggcuggagugcaguggcacaaucucagcucacugcaaccucuaccuccuggguucaagcgauucuccugccucugccucccaaguagcugggauuauaggugcccgcuaccucgccuggcuaauuuuuguauuuuuaguagagaugagguuucaccauauuggccaggcuggucuugaacuccugaucucagaugaucuugcccaccucggccucccaaagugcugggauuacaggugggagucaccgcaccuggcuggaauuugcauuucuaacaggcucccagcuggucuuuggacuacacuuggauguaaguagcacuauuccagauaauuauaucagccacaaaaaauaaugucaacauguugugcauccuuccuccaaaccaaaagagguccagaaagggccgguuccauagcauuggcuauagaguuauuuuaagauuagagugauuaguugagaucugugacagugugaagacaguuucuagaauucagaaguaguuaaguugguucagugguucucaaacuuugcugcacauuggaauaacuugaggaucuuuaaaaaauacuguugccuggccccuacccuuaaacuuuguuuuguaugggcccuggccugggcaucaggauuuuuaaaagcugcucaggugauucuaaugugcagcaaaguuugggaagcacugaguugaugaaugcugucaaauucucuuuguaaaacuucacaugagaaaaugcacauuuugguaagguugggcagguuauaaaaauucuguggaauccaucaccucuauccgagucaccugggaaugacuuccaggcauccauugcaacaugaccuguuuucucuaaaaacacuauuuaaacauguuucaaaucacuacugaauuauucugcugguagcaaaggaauuuugcagugaauucuuuuguaaagcucaccuuagauaguggguuccuuuagcagaaaauuuauuuaguagguacucuaucccaucaucccagccauauauauaguauugaucaaugguaaccaccauugucuaggccaagccuuuggagaugcccaguucugucuuuugacacuagugcguccuugugccuucuuugaauucaguuaggaauucagucaggaauauuaaaagugaaagggacucaaggccauuaucuacucuacuccuuuauauaggugaagauguuagugccaaagagauuaagugacuuuugcaaggccaugcauccaaaaguaauaacuacauaagauuuauugaguccuuaucaucugccaggcucugggcuaaguacuuuaaauggauuauguccuuaugucauuuaauccuaaaggaugcuaucaaauuggcauuguaauuauccccauuuuauagaugaggaaauugaggcucaaagaaguugaggaaugggccuuuaguucuucagcugguaaguuaauuccagcaguuugucuccagauucuguucuguuaagcaucugugcuaggcuuccucugcaaauuggugucaggauuggagcuuagguuuuuugauuucgcuauuacuuuuuaguuauguacuaccuguuuuuuucugugauccacuaguucuauuauucugucauacaaacaaauuagacuaaugaaaaaugacuuuuucuguuugguauuguccuuuaaugaacuguucuagccacuaaaagugcauuaaaauacaguuacacuuaucagcaaguaauuaugcaggugugugcuauauuccuaaguaauaguaaaaaauccuuaugaguccgcuuuugcuuuagguaaaagauacuuaauuuguugggggcacagauaaaauuugagauuguaucuguauuaagaaaaguaauaugaaauuuuuucucacauuaguuuuggcuaauuauauaauuauaugugugaguguuuaugugucuauacauacauauaaacauauuuauguauauauuuugaccaauuuuaguguaaguauaguuuuuagaauaaugucuuaucuaaaaucauguuuccuuuuaauuuugauuuuacauuuccuagcuucagagguuaaccaaaauaguuaccuuaauuuuuuugcgaaggaggagaaucauaaagacuuucaaaaugcauguuguuauguucuuuagauaucauuugcuguuucugaagcuaaagagaaauggaagagugagcuugaaaauaugaggaaaaauauacuuccuggaaaggaauuggaagagaagauucauucucuucagaaggaacuugaguuaaagaacgaagaagucccuguggucaucagggcugaguuagcuaaggcucggagugaauggaacaaagaaaagcaagaagaaauccacagaauccaagaacaaaaugagcaagauuaccggcaauuuuuagaugaucaccgaaauaaaauuaaugaggugcuugcggcagcuaaagaagacuuuaugaaacaaaaaacugaacuacuucuucagaaggagacagaauuacaaacuugucuagaccagagucguagagaauggacuaugcaggaagccaagcggauccaacuggaaaucuaucaguaugaggaagacauccugacuguacuugggguucuuuuaagugauacccaaaaggagcacaucagugauucugaggacaagcagcuuuuggaaaucaugucgacuuguucuucaaaauggaugucugugcaauauuuugaaaaacuaaagggcugcauacagaaagcauuucaagauacacuuccucugcuuguagaaaacgcugacccagaauggaaaaagguauguuccugagagugagagaagguauugaacaccaagaaugauuauagaaguuguauauaguguuuuuuccuuuuuuccuuuuaaauuuuaguagauguaagucuuauguuuuugucagugguuuaaaaaaguuucuguagcgaaauccaaagguuugcauguuucguugccaaaaaacuuuacuacuucauagugucacaaauacaagacaagauuuuagccucuaaauaucuuuuuccuaaagaauauuuaggacaaauaccuaaugcaugcggggccuaaaaccuagaugacagguugauaggugcagcaaaccaccauggcacauguauaccuauguaguaaaccuucacguucagcacauguaucccagaacuuaaaauaaaauaaagaauauaugcuguucuuucuaagggccugagauuucagaaacugaaaauuuuuuuuucaaaauucuguuuucugggccugaccacuucaugaaauaugcauaauaagaguuucuuaaaagcuuguaaagaguuuggaagccuauuuauugcccucaauaaauuuaugucucauuuaggcaaaaaaaugccaaccaaguacaaagguauugauauagaaacaagcaaauaaauacgacucacucgcauaaaacucugaagcccaguuucuggauguacuauauaugugcauauagaauuaauuauauucuuuuaguuauauaaguacucucugagaccagcuuuuaauuuguaugaaaguuucaguaaaaccaaauucuugcuaccuuaugaucaaagcaauuagguaugcaugaaagauccagaaugauauucugagcauggugauuagccaauuucaacauuugggauuagaggcaggaaaaaaaaaaaagccaguauuauaagguuugucuaauagaguugagacuuaagagugaaguuccaucaaaauauugugauuaaggaguuucaaggccaggauugagcauuugguauuaauaccuacuugggagaguuauaaacuagaaaaaauaaccuugaguuucaguuccauauucgaugauaacuagauuauuauauugggcaaucacauaguugcucacuggaaaaauaaaauacaaauccccggccuaauuccuuggguuuggguaggauaugcauggcacagcuuagccuuucuggguccugcauuugaaacaguauagaauuuuagagccagaagggaccugaaagaucagcucacuccauccuacuucaccccaguugauauuuuuauccuugaccucacaaagauguugcuaccgaguaguugccuucaauguaaaauuuacugggcaagaucacuucccaugaauacugcuucacacuuaauugagauuuuuuggagaaaauaauuaaaauaacuuggagaaaacauauaauuaaaaaauuauagcagauuuggagaugagaaaugaugggaaaaucauguuuacaugcuuucguuuguaagcauguuucgauuuuuauaacaguuauaaaaucuguuauaaaaaucaagaaacuaugacaccuuucuccuaccauuaauauauacauauaaaaucaacccuggagucuuuuuacagggcuuauaauugugcaagcaguauaagaucaucugugugacuuaaugaggcucauaagucuauggagacagaaucacauaaucuggcuaagaauuuagauguuuacggcuuuuguugggugggucagauuccauuccugagaaaaggauggcuuugaaaugccuaaucuggaauuugucauagaaguaauacuugaccuucugccauuuucgagcuaucuucacucaggaccuugagguaaagcuaugauuauagagcagugauuuuaaauuuguuacauaggugcuguaaaugugaggaacuauaauuuauaauuuauuaacucucuaguuuuaaaaauuguucauggaaauuaaaacaaaagaugguuuauuaauauauaaaaacaaguccucauuaaaauaacugagacaaucaaaaguuuuuuuaaauggagaggaugcaaugaaugaaaaauauagcuuucaagaaaaugaaugccauaucaaaauauauuaauacaguaguucauaacagauaaaacaaauaucaaauggaacaaaauuuucaagcaaacuuaaggauguauguugucucuuuuaccaucaaagucaaguuaaaacugagacaaaaagguuguugcuuuucucccuuuucuguuaucuugacuuuucuuccccaguuuugaguaaaaacuggaagcacugacugcauuuugguucagcuuuuccuacuccuuuugaccucaaacccauagcuucuugauugccucuucucuauaauugcuaaccucugcuucuguuggacauuguaaguagguuuucugacagucaauuaagugguuucucauaaucaaaaucaaggcuucuagaaucaggcauauauaguauguuuuaaauaaucaguaagacuacuuucuccauaccaccuauucuguuccuuuccgauuuaguagucaucuuaaaucugaaaacauuaccauaaaaauccauugauuuggcugagcgugguggcucacaccuguaaucccaguacuuugggaggccaaagcaggcggaucacgaggguugaggcaggagaaucgcuugaacugggagguggagguugcagugagcugagaucgcgccaaugcccuucagccuggccgauagaggaggacuccaucucaaaacaaaaaccaaaaaugaaaaauccauugauuuaguagcuguauugcugugacaaggacuggaacauaaaaacguucaauaaauauuagugaagaaauggucuugugcaagauguuuaauuuagcuaagccucaguuucuguccuuaacuuuggcauucagcuggccuuccuuacaaaauuacuguguauguuaaaguauuuagaagcauaugaaguacuauauaaauuuaaaaugauuuuuaacuguuauuuucaauucauaggaggcagaggguuagcauuauacuugcuaauuaacuuguuccuugcuguaguaaaaauguucuagauuuucaagaacaauucugauuuuauauugucuuucaugugguuuaaucacguaaaccauugaaaaaucucaaauucacauauauaaugugcaaaccauaucuucugucugucucauagcugcccaccagucgccugucagacaguguucuuauuuggaaaguuucauaggaagcuaguuccuaguacagugacaguacuuauauaacacccuaagaaaaauauuggcgauagauaguucaggcaagauuuuuuucagguaguguuuucucuuuguauuuuuaauauuagcauuuuaaauauaaaauuguauaaagauuuuuacuaagcauuaacuuugaagauacuuuauuucagagaaauauggccgagcucucuaaggauucugccagccagggcacuggccaaggagacccuggaccugcugcuggacaccaugcucagcccuuggccuuacaagcaacagaagcagaagcugguaauuggauuuuguucccaccagucuuuguagcauccauaaucacccaucugaaggguugcuuugaggauaaaaggagaucauagaugugaacaaauggguaauaaucgucugacuuaauguccccucuuccuagauuucauuuuguauuuagauaagaggguuaauuuaggcccucuucuucuauuuaugguuuucccuucauucacaacugauucuuguuacaaggagaaucaugagaguuuuaauggagaagucauguuuuuauucccugaaaucaaggguuucacaucagagaauugccaaguaauacagacuuuuucauucaaauuacugaaacuaauuucaaucacuuuuuaauggaaaucuuucugaaauguauuagauguuuucuaauugauuugugaguuuuucugagggccugggcaguguuuuuaaucucuuccuuuccaacguauggcagagugaugaauuaauaguuuaacuuuuccuuaaugacuuagacucuucaucaugacaaaagaauucuuauacuguacuagagccgcuuguauucagagcuuacugaggaguauaggacuuauauugccuauucauggagauuucagagcuagaaauuugcaaauccuuuauuagcucccaucucuuuuagcuucuugacccuuugcagccuacuccuuuccuccccacacaaacgcaacagccucucucugcugcuuauuugcuguuucuaauguaaccuggaaaagaacuaauaauugccaaggccagucauaccuacuaaguaaauaaccucaguuugcacacauuucuaauucagaaggcaauguuaccagaaucuuagagaaucucugccuauaccaucucugccuuucucauuguucacaaacccuuuuccccuacuucuagguucuagguggcugagaauaucuuacugccaauucaguggaugauaauauuaccuuaauuuguauuuugcauuguacuuuuuaugcccuguuuggaauagccugagaauucuaucuuaaucugugaaaugaauggguagaaacaaguuuuggauguuacuuagcuuuaggaaguccuauaaauauaaaagcaauuaguuuuggccaaagaaaaaucagacuauaaaaauauuuuucuuuagucuuuuuucccuuaaaaacaaacacauuaauaaauucauuagaaaggauuaaauaauacaaaacauguauuaagugauaaaguccuuuaaaauccuaccaccagagaguaccacuguuggauguuugguuauguuguccuaauaucucauuauuauuugaaguacuuaaaacauuaauuaugaaauacuuaguucauucaaagaauauauguaugcaucuguaaguuaugaagccuagcaaccaggaacccauuauucagcuuaagguacagaacaucaccagugcuguugaccacaguucuaugccugcaaccucuccccagucugagcuaacaaauauucugauuuucaaaaauuacugucuuuuuuaauguuuuaauuauguguauguacccucaaaaaguuguugccuuuuuguguuuuaacauuauaaaaauaguuuaauacucuauauucuuuguaacuugcuuuuuuccuguuuaacagcaugcuacuaagauuugucuguguugaugcaauagcucuaguucauucauuuucauugcuacauaguauuucaguguaugaauauacuaugaguuaucuguucucuuguuagugguauuugcacgaguuccaauuuuacaacaguauccuagaugaaaaauauaaaugcaauuuaugguaccauugugauguuucauuaauccuuuaauguucauuaacauaaauggcaccacuuaaaucaaacuaaaaugucaggagagagcuaagaauaauuuugcuggaucaaugacuuuacaguaacauuuuggccccugagccugugcuaacuuguauuccugcuuuauuauaucacuuauguuaauagucuacuuuuuaaucauuuuuguauauuuuaauuuuauaaauuuuauguauuacuaaugacaaugucuguuauuuauuguguacuugcucugugccagcuacugugccaaacaguucuuauauauuuacgucuucuaaaaguuuuaaaucauuuuuuaaacuuggaaauaauuucaaacauauagaaaaauagcaaaaagaaaaauaguugcgaagaacauucacauacccuuuaaugagauacaccuauuauuaacauuuuacuccauuuugugcucuuauguauauauguguaugugaauauuucauuuuuuuaugaaccauuggaggguaaguuauauauacauugugacuuuuauggcuaaguacuucagacuguauuuuccaggaauaugaauauuuucuuguuuaaccuuaguacaguaaauuuaacauuaaaguauuguauuaaucuacuguuguauucuaauuuugucaauugacccaauaaugucuuauagcauuuuuuuuuucucuuccaguacagacguuugucuagggucagcuguuacauuuaguuguaauguaucuuuagccuccuuuaaucuagaacauuuccacagccucucuuugucuuucaugacauugacauuuuugagaaauauucucugcuuccaccuucauuuuuuuuuaacagaacuuuucucauuugggguuugucugguguuucuucaugguugauucagguuguguuuucucagcuggagcacugcaaggggugauauguuguuacaucuaaaaauugugguguccauaugucuuauuggugagguuacuuuucauuaccuagugaauauguugucuaauuucuucacuauauaauuacuguuuuuuuuucacccuugcuuaucaguugauaagcaaucugugggagacacuuuuuaagaccaugcaaauaucuuccucucaugaaaaccuucucuuauauuuggcaaccguugaugauucuugcuugauccagucuuuacuauggugguugugaaauuauaauucuuccaacuuccucccucuauuuaucccaguuggcacuaagcauguugaaucaagaauccuuuccucucauuuguguauuuauuuuaucucucuguccaucgauccaucuaccuaccuacuuaccaacccacuuaccuaccuaccauucauaaaauuauugguaugacucauaaauuccuauuuuuaauacuuuauaauucauuacuauauuucauuagugcucaaauugucccagauucagcuaguggagcuccuucaaacuggcuccuauguccuugugacaugccuguauuuuugaguacuuucuuacuuucuggcauaggaagauauuucagucuuauuuuguauauacccuccccaguacuggagucagccauuucuugaagauccuugacucccuuuaguagggaaugguauucaauaccaagauccagagcaauagguuucaugacuauuuuuaaaguagaugguaguauccaguagugccuuagacaaguuaauuaauaugcuccaagucacacagccaguaagcagcagaaacaauauguaaacccaugucucucuaucuuaagcaucacacucuuucagucgugcuguagccuuuagucaugagucaucugcuuuucuuucugucuuuuuuuuuuuuuuuuaaugauaguucuuggucuaaacugauauaaaaguuuucugucauuuaauuuuugcagauaagaaaaagguccuugaaauuaaggauuuaugcuguggacacugcuuccaagaacuugaaaaggcaaagcaggaaugucaagaucugaaaggaaaacuggagaaaugcuguaggcaucuucagcauuuagaaaggaagcacaaagcuguaguggaaaaaauuggagguuagcauuuaaaguagcacugcuaccaauaugaauuucuuugauccuuguugaaauguucaaaugugacauuuuaguuaaugugugcacugauccucuuuugggauuaauauaaacuaauuuggaucuuauuuuuacuaaucaaauuauuauuacaaaacucaaaagaggaagauuucagcucugauuaaaaggucacauuccuuucuuccuuucuugauuaaacagauauugagggcccaguauacgucaagcaggcuucuaagcacuggggaugcagcagugaauaaaucauacaaaauuccaguucugguggagauguguucccuuccuucaagaagcuuuugguuaagugaggagaucuaacaacagauuaacaaauaauuaaacguugaaugcuguuggcaguguuuuccucagaaagaggauuguuaauucuaccucuuauuaaaguuaagaaagguuugacuaagccuugaaaaauagagguguuugccaaggagaacaacguuugagauagagggaaaaggcauaaacaagggcgugagggucuggacuggccuccuucuaguccauucaucacaaugcugugagacauuuggaaagggauauuuucuaccauuucccagugccccucugaagaagggaaguuuuggggcuuagaucgcugcucccucuucuuaccuuucacuaucgcuuauagccuauacgcuauacucuacauuugaaaugcuuccgauuccugagcugguccuauuucuuuuacugcuggaccuucauugcauaugauguuuguauucuguccuguacuuuuccccaacauucuuuuuagucuuacucucauccuuuaggauucaacucagaagaugcuuuaucugcaaagcccuucuugauuuucccuagucagggugaagugggcugcucuugugcggcccuguagcauuggcucuuccucuauuaucaccauuaccauucuguauuguaauuguuuggucacuugucagauaccuucuccaaauucuccaagaauuuucugaggagaaggaauaugccauaucuuguucauccuaauagccauggugcccaccacauaccagauaauaaauauuuaaauggacaaaaaacaaaaugccaggguccuaaauaauggugucauucagaaaagaccagguuaauaaguuuauuuuguacauccacuucuuucucuugccuggacacuggcaauaauucccugacucuuuaugcuucuagucuagccccucuaauccauucuccauaggguagcuggagcaaccuuuuuaaaaagugaauugaaacaugacacucuuguuuaaagcucuucaguggcuugccauggccuucaguauaaaaccaaaaacacuuaguuuaacgggguuugaaaaguucuugauccagcaccugccagccccuucaaccuugucuucccccagcucucuuaauuucucucaguagagccauagcauggauuucauuguuuucucccuucaccaaaacauccugaucucauuuggcuggcuaacuccuucucaucuuuuccccaauacauuacuuccucagggaggcuuuccuaaccacugcagaccuguuuaguccuccuguuauacacuccccauaguuccuaugcuuuuuauaacauucaccauccuuguaaucauuugcugucuguacuucccuuuggaguguagucuuuauagcaauaaggaucaaguccuguuccagcacuuagcacaccuggcaccauagcacaacucgggaaauacugcuaaaagaagccaccuguaacuaccacugacugcuuauuacuaaggcacuuauuacucuuaguacuuauuacuaagagauagauaauaauuacuuuaagaccagaaaggguuuuaagaauuuugagauuaaaaauuuaacaacugcaauucauuuugugauuacuuagcucuuuaguagaggccaggagaguaaaugaguuauuuguccaacuguaguauauuuaaaacauagauauguuaaaauaugaugaaaaccaagacaauuuguuuuacagaauauggcgauaagggcaguuggauaugacuauuauuuauaaauaauaauauuuagcaccauacuauucuacacaguguuuuuugaagcugauaucuucuaaaacucguagacuugcaaauaaucgaagaaaguugauauaucacucaaaacaaugaguugauacaaagggucugggucagaauuuaagucaauaguuuaauugaaauuuuuucuuaauauaacuuuaguagguuauuauaucuuugcuauugagauugcuucuuuguuucuuaaauucuauuuuuccacuuucuugguagcguuuauuaaaaaauagauggggugggagugaguuguuuaaaacaaaaaguuauauccaucaccagggggaauagaguaauuuuguuccucaacuuacggaguguugagaggguagcaucacaggaaacacgagaugccauguucacauuuauauugguauuuccaggccuuguguagguguugugcauuuguuguuuuauuucuauuauaaucuguaaguuaacaugugaagaaaaguucagaaagguuaauuuuuccuaggcuuaucaaccuuguaagcagcaaaguuagaauguaaacugaugucucugacucugaaauucauguguuuuccuucauaccacauggacucuuaucaguuuccucauccucuuuuuaaaaguucaaagaauuguaaucuccccacccuuaagaagguucuuuguaacucuccccacccuugagaauguacuuugugagauccacccccugcccccaaaacauugcucuuaacuccaccgccuaucccaaaaccuguaagaacuaaugauaaucccaucacccuuugcugacucucuuuucggacucagcccgccugcacacaggugaaauaaacagccuuguugcucacacacacacacacacacacaaaguucaaagaauugaaaaucuuacauuauuucugaaaaagacaccuacuuaagguuaacuuucuuuuuguuuuauaucgaggugcauguucaaugaucguuuauaugagcauaaacugucuaccaggauccauagggaacauggaauuagaaaaccuaguagguuucuacagagcuucagcacaguuggaaaacaaaacacaggcaucugaaacaguugaaacccaauuccaggacaguguguaacccaaagcaagaagaagaugggauacagauuuuaagugcugagaaaacagagcaagggaauggucugaguaggguuucuaaggggaugaacguuacagaaaagcgacuggaaauugcacagucucuucuauaaacauuuguauugggaacuuaagggaaaagaaggcuuaaaaaauuuuuaacugucuaauauacuauaaacuuucuguuauagaagagaauaauaaaguuguugaagaauuaauagaagaaaacaacgacaugaagaauaaauuggaagaauugcaaacacuuuguaaaacaccaccaagguauacuuuuacuauuuuaaagugcuauuuuaaagaaaucuaaguacaaguaucuuuaaauuuuuuuaaguaucaauuuuuuuuguuauacagcaaaaaguauaaaaaagaagaaaaucccccaaaaccuuauuuccugaagauacccucuagugaccucuuguuuuauaucauuuaagccucuuucuacacauacuccacaugcacaauguguuuuuaaaauugaggcuauaguauaagguauuuuauaacuuuuuauuaauauuacuagauaagcauuucuccauguuauuagauauucuccuacauauguuuuucaauaccugcauaaauuuucauguggauuuacuguuauuuauugaagcaaccauaacauuuauguuguuuccauuuuuccccuauuuuaaauaacuguauaguggagauuguucuagaugagauuuuuagcacuucucaguuaacuuuauuagaguauauggauacauauauauuuuucaaaugaaauuuuucacuuaccauuucuguuuuuguaaucuuugguuuguuuuuuaggucauugucagcaggggccauugaaaaugcuugccugccaugcagugggggagccuuggaagaacuucgugggcaguacauuaaagcuguaaaaaaaauuaaauguaaguuuaauucugaagauuuuaaggauggcuugggccuuuuuuauuaucacuguuaaaguaaacucagaguuuaccagcaguaguucuucuagggaauuuuccaaauuaccuuuuucuucaaucuuaaaagagauuauugauaccuuuucaaaauuauguagucauugaucauuuuucccaaauaauaucuuuuggaagugaugugagaaucgucuuauguuuauauuguugauuuucuuguuucuuuuuggacacuaguauuaaacugaaaaguuaauaaucuuacaacuuaacuaauuuguaguaaagaaaaugucacauggguuuuaaaugagcaauuaacuauuacuuccuaccauaaacuuuuuuuuuuugagacggaaucucacucugucaaccaggcuggaaugcaguggugcagucucggcucacugcaaccuccgccuccuggauucaagcaauucuccagccucagccuccugaguagcugggauuacagacaugcaucaccacacccagcuaauuuuuguauuuuuaguagagacaggguuucaccguguuggccaggcugaucucgaacuccugaccucaggugauccacccgcuucggccucgcaaagugcugggauuacgggcgugagccacugugcccggccuccuaccauaaacuuuuaaggacuguagaaguggaucuaguuagcaauuguucuguuguuucugguuauuauuucucauagcuauaaauuuaucaaguccuugucaguaccagguugugccagcauauccuguagagcauucuccugauguguguuuucccuguuuugaauacuucuugguuucuaauucuaauaugcauagaauggauauaugucccaaaacaauaaguaguguuuauauaggaaaaauguauauuaacuuccuaaaauuacauuucuuuuuaacaaaaagagcaggaaaagucugaaguuucaaauauaauugguagauucagaaucacguguagauguucuacaaagcucauucgguauuuauaagggaauuugcuucuccguuguuacuggugcuaauaaagggcauauugcuacaagcaacgcaacuuuuuguuaauaauguauuaauugggaaguggaauuuuaagcauguuuucauccuaaugugauaacuuguauguauguguguauauuauguuuuaguuauuuuuuagaaaguugguuggagguuuuguuuugacauguacugcauuucauuuuccauuucaaauaaugaaaaacagucucccaguuaguauuuuugcauagaaccacuaauuuucagaugcuuacugacauuaacaggaagauuccuguaugaauugguauccuuaauauaacagagauggugaaauucuagauguaggauguagucuuggauuuauuaaaaaaaaaaauaaaaguuagccuuagcuaauaguaguccuaaucaaagauauauugaguuaaaaaaaaaaacuugaaagcugugggcuauguuuauauguaaauuucagaggccaacuauaagucccaucacccuccuuguagucucauuuuguacauaucucuuaugaauuguaauauuauauuuaguuagaugcucaaaaagugcugcugaaagaauuuucaauaaauaauggaacguaaauuuucagagcacuagagaagaaugagucucuccagcucauacugccuccuuuucuucugucuuuguguuugcuuuuuccuuucuuucugcuuaaccuuuucucuauauuuuauuuuucucuuuuccuaacuggacauaauguacaauugaaauacuaaguuucuguaccucauauuuacaguauuuucuucgcuaaguguuuuagaauaugacaaaauuuagcuggggaauaugccauguuuccuuacuauauguagcugucaucauuccgaaagaacuuauagaguacuucucauuugagucuaccaaaaugaugaucuaaaauauuccauuuuaaugacuguggaaaguauaauguuuaaacuauacuuaaaaucacuucaucuaccagaaaauugaucugaagucugccccuccuguuucugaaaaagugcuaauaaacauacauucugugggcauuuucucacuucccuauaggugacaugcuucguuauauucaggagaguaaggaacgagcugcagaaaugguaaaagcagagguacugcgagaacgucaagaaaccgcccgaaagaugcgcaaauauuauuugauuugccuccaacagauuuugcaggaugauggaaaagaagggugaguucagucugaacaauguguccugagauuaccaggacaacauguuaucauuuuuaaagcauuuuccuuaaccacuaaauuaacuauuucuacaugaucagccauaggggguuaagagagguuuauggcugugcuacccuaaauguuggcagagccaauaggaaaacagaaaccauggggcuaaggcaacucauuuuuuccuuuaaacuauauuuuuaauauucuggaauuccccacagggcugagaaaaagauuaugaaugcugcuagcaaacuugcuacaauggcaaaauuacuggaaacaccuauuucuaguaagucccaaagcaaaacuacacagucagguaugucaaagugagucgccaaaugguuuuucuaucuuuucuucuuuagcuauuuaauauuuucaguaugaagaaggcagggaagguaaggagugagaguuaauuugugaaguuuuguauguuuuacuuaaacuagaaguuuacgcaaaaagaguacacaguuuccaauuuaaguaggcagacugagcaugcccaucaguuuccuauugcugcuuccaucccucgaaaugauagaaaagauuuuaaacagcaaauaaagaaugagaaaaagaagaaauuauaaguggguuuuaaaaaguugcagugggccaggcaucauggcucacaccuguaaucccagcacuuugggaggcugaggugggaggaucccuugaucccaggaauuugagguugcaguaagcuaugauugugccacuguacuccagccugggugacagagugaggcccugucucaaaaaaaaaaaaaaaaaguuugcaguggauagaccagaagcuacaagaaaucccugagagaaagaagacaguauaggauggaagauggaaaccucaguucaaaaccaccgggagaugacuauugcaauuaggagcaauaucaaaacuguuccacauaugagggugauauguuccaggagaaauagagggccuaggggauaugaaugggguaauuaguugguguucuaaaccaacagcaaccaggugggguuaauccucucuuuauuucuucuucuccccuccuuuccccaaccucaauauugagcugggcaacaacaacaggaacaaagaaucugggagcagggcagugcuccagguggcuagccauaucaagcaggaacugggagccgacuugccuugggaggcugagaugggaggaucacuugaguccgggaggucaaggcugcagugagcugugaucgcaccacugcacuccagccugggaaacagagcagacccugucucaaaaaaaaaaaaaaaaaaaaaaaaaaaaguaagaguaaccaacaaaaacauagaacguauaacuuuaaaacugguaaaggaaaaacuuggaaaaaaacauuuucaaucuaacaaaaucaggaaagaggaaaaaaaccuagagagcguggguaaguaggacauaauaguaguuugaaacaucaacaaucacacuaaauauaaguagguuaaacucauauaaguuauuaaaagaccacaacuuucaaauaggguuuuuaaaaauguggaaauuugcuauuuuuacaagaagaacaucuaaaauuaaaaaucaggggauggagaaugauauaccaagcaaaugcaguguugauauuagauaaauuauagagguaaauaaaagauuagauaaauuagaguuagcauuaaaagggacaaagcugauaguucauaaugauaauggaauagucucccaagaaacuguaauuguuuucuuucuguagaucauacagcuuuauauaaagcaagagcugauagaaauacaugaaaaagacugguaaauucccaaucacacugagagauuuuuaacauaucaguggggaaaugggguucuugaaccucuggaaaacuugaagcugagauuguucagggguccaugagucugauguugguaaacauuccucauguacaagccaaagauuauuuguauaaauuuuggaauggugaugugaaccuuagguaugaaaaggcaguaacauauaacaagaaaauaauuuucuagaucuggggcaacagugugcaaauaauguccccaguagagaagcaaauccuuuucauggacucuagggcuugcuacucugagauacaaugccucuaauuucaugcuauguggcugcuuugucuuugaucagauuuagugucuuagguaauuaaaucagaaagucuauuuagcuauucuagaaguguauguguagguauugggugggugggguucuuugagcgaacuugucagaaacuccauucuuaacaucagaaucagggcaggauugaaaacauuguggcuggaucuugaaauugcuauaacaucuauugcagaaaaugauaggucagauggauagcaauaauaauuauauaucagaucuuaguaacaaaauuaccaagcuuuaucuaguggauauauguaaaagaauauuuuuaaauguccagcauugauguauuuucuuuaagaauuauuacaguauauaagcauucuuugggaauacaguauaaaaacauaaauuuuuucuuauuuuuaauuuuuuuuauuuuuuuguucaaggaugaaucuucccuuuaaauauuaauuuucucuuaauuucguguuuccuugcacauaauagcacugccccuaacuucagagaugcugauugcaguuaaaaaaucaaaaagaaaugaugugaaucagaaaauaccauguuguauugaaagcaaaucaaauaguguaaacaccaucaccagaacucugugcgaacaagcucccaagaggagggcagcuuguaacuuacaaaggcuguuagagaacucagagcaucagagcauaaagcaugugggauccaaagagacacauuuggaauuccaguuuggggaugguaguugcaagcaccuaaacaguuugccaaggaauguuucuccugaguuuguuccuugugaaggugaaggaggcuuugguuugcacaagaagaaagaccuacucagugauaaugguucugaaucacuuccgcauucagcugcauaccccuuucuuggaaccuuaggaaauaaacccucaccuagauguaccccugguccuucugaaucaggaugcaugcauauaaccuuucgcgauucuaaugaaagacuugguuuaaaaguauauaaaugcaauccacuaauggaaagugaaaaugcugcaucugagaaaagucaagguuuggauguucaggaaccuccaguaaaagauggaggggaccuuagugacugcuugggcuggccuuccagcagugcaaccuuauccuuugacagucgugaagcaucauuuguacaugguaggccacaaggaacuuuggaaauaccaagugaaucuguuaaauccaaacaguuuucaccauccgguuaucuuucagauacagaggaaaguaauaugauuugucaaacaaugaaaugucagcguuaucaaacuccauaccugucagaagaaaccacguauuuggagccaggaaagaucagugugaauuguggacacccaucucgucauaaggcugauagauuaaagucagauuucaaaaaacugagcaguacauuaccaucuucagugugucagcagccuucaagaaaauuaauuguuccgcuaucuagccaacaagauaguggcuuugauagcccauuuguuaaucuagacuaauuaugguacaguauuuaagaagaaucauuaauauauuaacaaaaauggaagggaagaccucauacugaaaaaaauugugagcccugccucuuuugagauguuuuaauaacaucuguuauauaaguaaagcauucuucuaaaauugcuugagauauuuauguugccuuaauauuccaaaggccugaugguguauguauaaucugcuuuuguguggugcuuauuuuugguuucuaaaccaucuauuuuuauacuuauaaauugacucacucugcaguguuaacuuauuuaaauaaacuugcauauggucugua

SEQ ID NO: 191233 - RNA, 69529 nt, Homo sapiens
uucauucauucaauauuuauuuauugagggcuugcuauauguauaaggcaaaaauaaacaaaaugaaaauacuacgcacuuucauucuguaucaaaacaauacugucaguaauaaauauaaaagacaaaaaaaauugaauuuauuuuggaugacugcggcaaagcacaccggguaaaagacuccuuacuucuauuucugcagauuccacccgguuuucaauuauuucgauacauugucucuuagcuggugguucuucacuuauaacaguuucuucagcaaugucuguugcugguacuguuaauacuaaaaugaaaaaaaaauuauguauuacuucauuuucagagagauuuauuagaaauaaaacuagucuugacauuguugaugcuacucaucuaaaauaacuacauuccaaaacaauaauuccaaaucauugauuugcuuuuuaugagacuauccauauuugucuuuuuuauuaccuucuugcuuuuuuacugaaaucuacuuauuaaaguaccuacaaauauuuuuuuaauuauauagauaauauauucauucaugacucaaaacaucaaaauauuuaacgagcauauuuugagaggccucaugcccaccccugcuaacagaugaucauuuuauuaauuuauuauguauuauccuuauauuaauuuguuuaaaaauuaguauacauucucauuuuccuuucuuacauaaaagguagcaucuauacaauagauauauuguucugcaucugcuuuuuucacuccaaauacuuauaauaucuuacaucacuacauagagagcuucuguuuauuuagcugcauaauauccacuaagugcauauuccauuaugagcacugauaguucauaaacauugcuuguuuuuguauuguacuguugggcuuuuucucaauuuuuaguagcucuuuauauaaaugcaauuauauagagaggcuguccuugcuuugcacagcacuacaggaacauaaaaaugacugugcaagcugaaaccaugcgaagccauuuuaauaaucacaauggggaaaauuauaauuguuccacggccuuuaaaauuuuuugccaaaacaugaaaaacucucuuagugacaguuauaaauguaaauaaaaauuuaaaaauaguaaaacuaauauuuauuuaguacaauguaauuuaaaacauuagaaauauugagaauuuggguuuuacuucuuuuuuauucaugacauaaauuaccucaggaaaaaaugagaauuuaaaucuguuuauuagacugucuguaaagucuacauaauucacauguaaacuauauauuuuuaauucaggaaggcuuuagaaguuuuuuuuaaauauucaguagaacuuucucaugguuauucuuuuccagaguuuuccuuauucuucuucccucugccccaucaacauaaacuuuagaagccauuuggcuaauuacagaaaaaaacuugguauuuguuaugggcugaauggcacucccacuccccaaauucacauguugaaguccuaacccccaguaccucaaagugugacucuauuuggagauaggguccuuaaacagauaauuaagguaaaaugagauaggcccuaauccaguacuacugguguccuuacaggaagaggagauuaggacacagauaacacaaauacugagguagaccaugugaggacaggccacaagacggccaucugcaaaccaaggagagcagccucagaagaaaccaaaccugcccaacaccuugaucucgcacuuuuagccuucagagcugugagaaaucauuagucuguauaaugauacggguuuuggaaacaauguuaugucugcuugauacaaauauuuuuaaaguuuucuucuuuucugaaaauuagaauuaguucuuuaaugcuuugugaaagcaucugacccuaauccaaauuucagaccagcuaucagcagaagauuucagcagagugggacagaauggccuccaggcuucagaggucaaggguuuccucuccuacugcuacagcaacaaacuccuuucuugaaaucuggucucuguucaaugccaugccuccucugucacucaaaaccaaaccugguuuaggcgaaguucuaccucaagcccugcccuucacuggccaugaaaggcacacgcucuacaauccuacucauuuucuuucuuucuuuauuuuuauggagacagggucucgcucugucauccacacuggagugcaauggugcaaucauaguucacugcagccucaaacuccuggguccaagcgaucuuccugccucagccuuccaaguagcugggacuacaggcucacacuaucauaccuggcuaauuucgucauuuuuauuuuuguagagaugaguaucauuguguugcuaagacuggucuugaacuccuggccucaagcaaucaucccaccuuagcauuccaaagugcugggauuaugggcaugagccaccauacuacuagcccuagucauuuucucaaagauuauguguggacacuucuuuuagggggagacaagguacagggcaaugcuuacuuaggcacuuucuacagcuucucucugccucaguauucaugcccuauucuaucucaguccugcaugcagcacuuccuacugagucuggggcccuauccuucugagagagcauguuuauugcugagcuuaaccccuuuucuuuccuugaugcaccaguguggauuucuaugagaguccucuugcccuggcuguaauggcuucagaugcuuuuggcggcacuuaaaaauguggaauucugagguuuuucucagccuuuuaguuucacugaaaauguagcugagacuuuuguuucaucuuguuagccuuugugguuuccaaaaggagaaaaauguuagaauucacaauaaagcugcuaaaaugugcuaccauauuccuacuacaaguccuaaguccaccuuuuuuuuuuucuuuuucugagaaagaguuucucucuguugcccaggcuggaaugcaguggcaugauaauggcucacugcagcuucaaccuccugggcucuagcaauucucccacuccaggcucccaaguagcugcgacuaucagcaaaugucaccaugccuagcuaauuuugaauauuuuuuuuagacauggggucucacuauguugcccaggcuccaacuucuuuuuaaguagcuuuuucuuauaugguauuuuuaaaagcucacaugguaauugaauugcauuaaaugaucuaggaaacuacuguccaaugcugauuugaauuauuuauuuuggauauuauuuguguugacauuuaagcucauuuuucaaccagaauacuuuggggccaauuucucuuuccaccaguauauacucagagaaagcaagcuaauuugaauuuuaauuagccuaagcaaauaaaauuagguaauuaagucuauugcaaaggguuauacaaauauaacucaaggcaaaaauacauucuuuggaacacauaccacaauuuccugagaauuaaaaauaaacacaaucuuuuuggacugcagggaagacuuaaagaaaauaaaaauuaaaaaaaaaaaacauacaaacuuuauauaaaugucuacuacuaaccuuguuguccaucuggcauggucacaaugaugggcugaccaauuccacugguuggaauagagugcaaauuuccaagcugaauuccaucuguaacuauugugaugacuugcugacccccugaacuaacuacuugcugaauggcaccauccacagauucugcaguaacuacuucuucuguggccacuacuggaaaaaaaaaaaagaaaacucagcaaacauauguaacgguaugaauagaaaccuauuuuugcuuugucugcuacuuuugcuuucuaugcuucuuucuuuucuuuuuucuuuuuuaaauagagauagggucucacucugaugcccaggcuggaggguaguggcacaaucauggcucacugcauccuuaacuccugcacucacguaauccucuugaaucagccucccaaguagcugagacugcagguauguaccaccauaccugacuaguuuuauuuuuuuuagggauggggucuugcuauguuggccaggcuggucucaaacuccuggccucaagcaagccuccugccuugaccucccaaagugcugagaauuacaaacaugagccaccacaccugguccccugcuucuuucuuacccaggaaaacuuguacaugguuuuaaaacucagucgccagagguguuggagauaucuauguaaccaguugauuacaagucucucauaauuuacaauacaucaguuccaacuaucuuuacaugugagugguuaaacaauuucucauuugguuguaugagguacaaaauuuagaucuaauaucaugacaaagguuauaucuguuucguaaaaccucacaauucagucgggugcugguggcucaggucuguaaucccagcacuuugagaggcugaggcgggaggaucacuugaggucaggaguucgggacuagccuggccaacauggcaaaacccugucucuacuaaaaauacaaaaauuagcugggacugguggugcaugccuauaaccccagcuacucaggaggcugaggcaggagaauuauuugaacccaggaggcagagguugcaaugagaagagaucaugccacugcccucuacacugggcaacaaaacaagacccugucucaaaaaaaaaaaaaaauccacaauucauaagaugaauuugaauaugauuauacuccauuuacauuuaugugugaguugacauacagaauaaagaguauucucuuuuuggauuaagugagcaaggauuugccuugauaauaaguggcauacagaugugguacuaugugauaguaaauaguguauguuaacauuuccacaaauaaaauccccaaauaugcucuuaauaauuuaugaaagccuuagagaggauucuggcagcucaagcagcaccuguggccuugucuggguagagaaaucacaaguuaauacugccaaaauccuuucucacaggcaauccuacacccaacuacugaucccaaaagacauguagaagaauauacaugguagcuuuauucauacuaguaaaaaacuacaaacaacgcagauauucuuugauaauaaauuaacaaugguagagucaaacacagcaauuugacuauaugcaaaacauggaugaaccugacaaaaaacaaaacugagugauguaaaccagacacaaaagaauauguacugucuaccuuccauuuaugaacugagcaauguuuacacaauguuuacaauuauccuauguaaacccuuugugauaauuccucaaacuguacacuuauaaucuauaaacauuucuguacauuaaaccucacuucaauaagaaagcaucaaaaggaaugauaguaauggauuacuauccauugaauuuuuuuuuuuuuugagacgaaaucucacucugucacccagguuggagagcaguggcgugaucucagcucacugcaacauccgccucccgaguucaagcgauucuucugccucagccucccaaguaacugggaauacaggugugugccaccacgccugguaauuuuuuuuuuuuuuuuguauuuuuaguagagacggguuacaccauauuggccaggcuggucuugaacuccugaccuugugauccgccugccuuggccucccaaagugcuaggauuacaggcguaagccaccacgcccagccugaauuuuaaaaaaucuuucuaucuggcucaugccuauaauaccagcacuccaggaggccgaggcaggaugaucacuugagcccaggaguucaagaccagccuggguaacacagugaaaaacugucuacaaaaaauuuaaaaauuagccagguuugguguuuuacaccuguagucucagcuacuugggaggcuagggugggaagaucccuugagccugggagguugaggcugcagugagcagugaucacaucacugcacuccagccugggugacagagugagacucugucucaaaaaaaaaaaaaaaaaauucuaucuauaauaauaccucauaaaaaggagagaaaggaggaaaugggaaagauauuccugauagaaagacaucuaguuaacauuuaaaaaaugacaaguuaagauaaaucauugcggccgggcgcgguggcucaugccuguaaucccagcacuuugggaggccaaggcgggcgggucaggagaucgagaccacauugaaaccccgucucuacugaaaauacaaaaaauuagccgggcgcgguggugggcgccucuagucccagcuacucgggaggcugaggcaggagaacggugugaacccgggaggcggagcuugcaagugagcugagaucacgccauugcacuccagccugggcgacagagugagacuccaucucaaaaaaaaaaaaaaaaaaaaaaagauaaaucauuguaacuucuaauguaauaauucauucaagcaaggaucgguagugggugcuaaaagcauugauaaaaucuuuuggggaaacaggauauucaaauguucucaaaguaucccaccaaagauuacuauuaguugcaaaggggaaaaucuaccugaaaagacccggcagucaucauucuaccaaguggucauuaucaggaugggcugauauuaugagccuccuuacgugauacacugggagguuacaaaaauucacugguguucuuccuggaaaugucugaacuaaaucugacuauacacgacauuuggaggacaacuugaaaauggaccauaugucagauaauuuuuuuuaauuaauguugauguuuuuagaaaauaaaauggagcuguggauauguagaaggccauccuuauucuugagagauacaugccaaaguaaaggugaaguaucaugaugucuccagccuacuuucauauaacuuagcaaaauaaaaguguguauauguguguguguguguguguguguacaugcacacaugugucagagaacauaugggcaugccaagauguuaacagcuggugaauacaggugaaaguuauacagguucauccuccaauuuuucuguggguuugaaaacugucuacauauaaaaaaaaaauuauaacuaguucaaaaagaggaaugacauuaaaaauuauuucuaaauggcaugguuuuuaauguauuuacacauuacaaaagugcaauuacaaaaaguguaauuuuacaaaaaguguaauuaaauaaaaccacucucuacuaaaaucaagcuaccauccauauacacaguugcucugaaauaugcugaguuucuaucaacucacaguauggcaucauggauaucagugaucacaggauuuacuaagacagaaaggccauaaauauaggaacugcuuuuuuuuuaaggcaggaaaaauacuaggaaacuaguuuucaagauguacucaacaggccuggcuucaacucuguuacuguguuacuuaguaaucaaggaucacaauacaaaccacagaacacucaaaaugcaaacaaccuuuguuuugagcucucuuguaauuuuuguuuaccuuaaacuauaauuagguuuuaucaccaagcacuuaagaaaauuucaggaagauaauuacaaaaugaaauguaggacauaaaauaguaauauauucaacagagcuacuacuaggauuuucaaacgcauuaaguauugcuuugauuuuuucaaaaacuauccauaugaaaaagaaauauucacuugaacugaaugcuaacuacagauaguaaauauuuuaaagcauaaucauauguaagaaauuucuaagaucacacacaaggcacaauucaagaacuuucaucuuugcacuauuugcaaugacuguuauuaaaauaauagaguucuugccuuucaucuaaaaagcuuucuuuuuaaguugugcuaugguaagauauuuaagaaaaauuaaaaggaaacaaauuacguaagacaaagugccccccagaagccuuaagaacaaucuaacaguaaaauguugaaacacuaaaagagaaagccuaaaaacucuuaaaagauuauugauuuuaaaaaauagauuuauauuccaaaacauaaagcucccuggauaaaaaauaacuauaacauaaauauucauugaucugauucaaaagucaaguuguaauauuuaaagaaaaccuagauaaucugcagcaccuuugacgacaucugagaucucuuguucaauaagaauucugaauucagaugccauacaaaugaaauaagggaagaaaacugucuuugaaauguccuaaaagauugaaaauucuacauagaaacauuuaaauaauaaaauagaaacuauggaccgggagcagugcucaugccuguaaucucagcacuucaggaggccaaggcagguggaucacaaggucaagagaucgagaccauccuggccaagauggugaaaccccgucucuacuaaaaauacaaaaauuagcugggcgugguggcacgugccuguagucccagcuacucaggaggcugaggcaggagaauggugugaaccugggaggaggcagagcuugcagugagccgagaucaugccacugcacuccagccugggcaacagagcaagacuccgccucaaaaauaaauaaauaaaauaaaauggaaacuauauucauugaagaaaaaauaaacuuuucgaagguauuaugguggcaguuuaaccugaaauuaaaaacaaaaaagcaaaaacaaaacaaaacaaccucaugaggccccauacauaccccuuaaagccaauugaguuguaucacccuauuuuugauauagaccaaaaaacaaugugcaaaacagaccugguucaaauuucacuuuuagggagaaaaagaaggaacuuuuuuauuuuuauuguuuuucuuuuuuuaaccccuguuuugacacauaagaaaagagggaacuuuuaaagccaccagaugcauuacaccuuuggaaaaaccacuuuauuaguaauuaccagaaguugcucuaaagacaaaaaagaaggguggucacugauguguauuuaaucaagguauuauacaguuguaccacaaggaagaauaaagcuaagcaaaggaaaguugcuauaggacuacaggcuagagcuacaaaauaagagacguaugaaaaaauauuuuuaaagggccagauaacuacacuacagauguaaggccuacaucuuaaccaaucacagcuucuaauucuauaucccaaauaacccucgaaucuauucaauuauugucucugucaaaucuucauucaugcuaucauuaugauaacucuucccugguugacugcauuagauuccaaacaaaacucccuuccaaagcauucuucuaaaccugccaaagugaucauuuuuaaaguccuauauaaucucaccuucaaccaccuugagugacucuuccacuuacuggguuuagaugcacuggccucuggguccccuaaaaagucaagcucuuuccugccucaaaagcuucacaugucccucuugcuaaaauguucuuccccaaacuuuucccuacuaacgccuacuuuaauuuucaguuuaaauguuucuuccucuaggaagauuccaugacacuagaguggccuguaaaccuuagaagaaagacaggaaaaugugauugcuucuguauacuaauaaauaauguacuacauggugguaguuuuccucauaagaaaauacauaucuguaauucccaaaaaaaaaaaaagcuuucacuuuuuugucuauucauuuuggaaugacuuucaaaaugaaaaucacacaaaaugguaugaguuggaaugaguuccaaaaaaucuaaaucuuacccauucuuuagggcacaacucaacacauuccccuccaccacacccacccccaacuccagcuaaaaguaaucucuuuccagugaacaauaacaguaauucaaugagcuauuuuaaucaucaagcacugacaaccugcuguuauauuugcuuauaacaucaagaaaagacagagguaucauuugauuucucaaugaaaauauuauaauagacauuguaagguucucauaggacuaccauuaaaaugugugguauaugucaaaaaugguacuaacgucauuuccauuuucuaauggaaagucaauuccauuagacaugaaggugcuauuuaaagccauaauuccugagugaaauggcaugguacccuggacuaucacaauugccuucucuuuauauauaggaccaugccaaccagcuaguuuccauuuaaaauauaguccaucugcugcuacauucuggcuguuuuguaaccaggaaaaauguguauuguaccacuuagcuaguaaaagaaaagaauaugagcaggaacaaugaguguacugauggagcuuacacuauauuuuggucaacaucauuuaaaaaggucaaaaaaguagcagaacacuuauuucaacagacuaccuauuacuagaaaaagcuauagaaacagauacaucccaaaaguaauagcgacgcucuugcuuaaaauaagauaaaaugaaaauuacacaaauaauucaauauuguguaauucaaauaucucaaaccaaauuauaaacguucuaaaagagcccagagaucaugugaauaaacugcauaggagagaugguacauuauagaggucacagacauauaccuugggaaucagucagacugaccaaauccuccuuucucuacuuaauagccauaugcccuuugauaaaauuauucaaccuccacaaccuccaauucaaccuguuucauuauauauaaaauggaggucccacuaauguauuuuccagauucuaacaagcccuugaaaagauauauauaaacauuucgagaaucaggaugagucugacgauagauuuuaaagaaacuggacagccagaaaucagagaaauaaucugugguagauuuagcuuugccugaguaugugcaaauugagcuuuaaguuguuuacucuggugguaacauacuuaaacuuuaacuuaauucuuuuuuuuuuuuuuuuuuuuuuugagacagagucucccuguguugcccaggcuggagcacaguggcacaaucuuggcucacugcaaccuccaccucugagguucaagcgauucuccugucucagccucccgaguagcugggauuacaggcauacgccaccacauccggcuaauguuuguauuuuuaguagagauggaguuucaccauguuggccaggcuugucuugaacuccugaccccaaaugauccacccaccucggccucccaaagugcugggauuacaggugugagccacugagcccacccauuacuucuuuuuuuuuuuugagauggagucuugcucugucacccaggcuggggugcaguggcacaaucucggcucacugcaaccucugccucccagguucaagccauucuccugccucagccuccccaguagcugggauuacaggggcacaccaccacacccagcuaauuuuuguguuuuuaguagagacaggguuucagaaacauguuggccaagcuggucuugaacuccugaccucguaaccugcccaccucagccucccaaaguacugguauuacaggagugagccugcgcucccggcacuucuuuuuaaguaagcuuuuaaaauaucuucaaaaagauuccacuaugggccgggugcaguggcucacaccuguaaccucagcacucugagaggccgagauggacagaucagaaguucgaggccagccuggccaacauggcgaaaccccaucucuacuaaaaauacaaaaauuggcugagagugguggcgugugccuguaaucccagcuacucaggaggcugaggcaggagaaucgcuugaacccaggaggcggaggcuucagugagccaagaucacgucacugcacuccagccuggggugacagagugagacccugucuccaaaaaaagauuccacugugaugucauauugaaaugaaaaauuauugugcucauagaagauuuuaagucacaugcaauaaaaacuaacugaaauuacuaauucucucagacuagaccaaaacauuuucaaagguuaagagaaguuagagaaauugguguggccauuucauggagucacacauuuaaaugucaaaauuuccagcugacuuagaagaaaagccguuuuacuuucagauauauguguuuuuguuuucguuuuuguuuuuuuguuuuugagacaaggucuuggucugucacccacgcuggaguauaguggcgcgaucacagcucacugcuaccucugcuuccaaggcucaagugauccucccaccucagccucccaaguagcugugaacacaggcaccugccaccaugcccagcuaauuuuuucuguagagacaggauuuugccacguuguccaggcugguuuugaacuucugaacucaagugaucugccacccuuagccucccaaaguacuagaauuauaggcaugagccaccacacccggccagagguaaguuauuuaauuaaagaaaagaaauuuacaaguuuaaccaaauagaaaccaccaaugaaaucaguuuucuuugcuaugcuucugcaauuacauaaguauuaaauagauccaggcauagguuauaaaagcagcauguuaguaugaugaugcauauaacugcuaauggccaaaagugauucauacaaaucuuaagacucccaaauauaaaggcuuggauucaaacuuagauuauaaugcuacagaagcuaaagaauggauaaauguuauuuucaaaaagaggcugggcacaguggcucaugccuguaauccuagcaccuugggaggccgaggaaggcagaucacugaggugaggaguucgagaccagcuuggccaacauggugaaaccccgucccuacuaaaaauacaaaaaauagcugggugugguggugcaugccuguaaucccagcuacuggggaggcugaggcaggagaacugcuugaaccugggagauggaggcugcagugagccaaaacuguaccacuguacuccagccugugugacaaaaugagacuccaugucaaaaaaaaaaaaaaagaaagagaaaagaaaagaaaaagagaaaagaaaaagguagcauucccccaacuccuccaagucaagaauauuacaguaauauccaccuuaaagcuuucuggugaggaauaaaugagauuauaaguaaaauauuuaucacagugccuagcagagagaguaagcauuugaugaaauguuguuauuauugaucaaauuuugaaaaaacacuaauuuaaaaaaugaaugacaaauuauucuuugcuuuuauaagcacugaaccaaauauaauggcuuaagcuacagaaaaauauuuucuuggaauuuaaaaaauuuccuaauuaaauuuuaccgacauaauaauuacaucaagaaguauuuugguuaaguauaaagguaaaucuuguauaaaccaaauguucaugaauacuguuugucaucauuuaacaacagguaacccuuucauuucuuuuugagacagaguuuugcucuuguugcccaggcuggagugcaauggcgugaucucggcucaccgcaaccuccaccucccggguucaagccauucuccugccucagccucccgaguagcugggauuacaggcaugggccacuacgccuggcuaauuuuguauuuuuagcagagacgggauuucuccauauuggucaggcuggucucgaacuccugaccucaggugauccacccgccucagccucccaaagugcugggcuuacaggagcaagccaccgcacccagccagguaacccuuuaacagugguuucuguauacuauuuccuaguucuaucagucauuaagauuuuauaacacucuaguagagcugcuaaaaauuaaaauuuaugaaaaaaguguuuuuugguuuuggguuuuuuuuuugaggcagggucucauucagucgccuaggcuggaaugcaguggcaugaucuuggcucauggcaaccucugccucccagguucaagcgauccucugaccucagccuccugagcagcugggaccacaggaguggaccaccacaccugacuaauuuuuauauuuuuugguagagauaggguuucaccauguugcccaggguucugggcucaagcaauccaccuaucuuggccucucaaaguguuaggauuacaggugugagcuaccaugcccagccaaagugaguuguuuaaacaaaaagucacaaacuaguaaaucaagagccaaauuagagacagggacauuuuuuucugugagccacacaaguuuuguuuuucaauuaguuaccaagauuuaauguucuuuuaaaauccagauucacagcuuccuauuaaaaaacagaauuugggaauacuggacugaugacuauaaucagcuagaguugagucacagaugccucccugcccuugccccauucuucagccggguguaaucucaauccugcccacuuuagccuuuuauugucuuccuggccuuuguaaauauuugaaucugcaacuguuuuugguuuuuuuuuuuuuuuuuuuuuuuugagacagagucuugcucuaucacccaggcuggagugcaguggcacaaacucagcucacugcagccuucaccucccggguucaagcaauccuccugccucagccucccgaguagcugggauuacaggccaugugccaccacgccuggcuaauuuucuguauuuuuaguagaaacagaguuucacuauguuguccaggcuggucucaaacuccugagcucaggcaauccacccgccucgcccucccaaagugcuaggauuacaggugugagccacggcacccagccugaaucugcaauuuuaauguacacauuagacucguuuuucuaaccuggaguuucugaagaauuggacaauggagcagaugcuucagcuaaggcagcuaauguagcuaauacugauguagaagaguuuccaaacugaacagcagauacacccguuucaucuguaagaaaaaagaaaauagauuugaauuucuaaggagcuuaauccaaugcauauuucugauauucuauuuaucuuacugacucuuaaacaaagcuuggauagcauuagcuuuugaaagguaauacugcaguaaauuuuguaauaucaccuuucuucagauuguuuugucucauaaaaaucuuuuugccaguuauaccaaagaaaacaaagguggcugauagaaucuuacccucauucuccaaccguccuuucuuacaaggaugaauaccuacuaaagcauaaaaucccaaagccuauccuauaugcaucucaauaccuguugccuuggaugaauuuucugaagauaccagaccuguuagguucaccaccccuccagguccaaugauaaacugugguguugcagcauguauugucacagugucaggacucucuggguuuguguugauuugguucugcauagcaaucuagggaaaaaaugaccacaguguuuucagaauuauaaccagaacauauagcacaaauucuccauauaauacaaacacauauaaaggaguauucucuaagaagaaucacauaguacaaguggaaauauuugucuaagguccacugacaguguaggggcacaucauggguauauauuuauaucccaagucccccucuuagguaaagcagcaaaauccugggagaggagaaacgaguaucuaaaagguuuuuaacagaacacagaacaacuggacauuaagcuggcugagguggcaggugccuguaaucccagcuauucagggggcugaggcagaaggagugguuaagcccaggaguucaagaccagcaugggcaacauagugagacccccaucucaaaaaacaaaaacaaaaacaaaacaaacaaaaaauauuucugcccuguagcuauaggaauuuaauuauuucuucuacguuuggcaauacauaauaccacauauauaaagcauguccuucucaauuaauuguuccccaucuucaacuccaacccccaaacugcacucuuaggaguaaaaggaaugaaaagaggcaugguagaauucauuuuccugaacauaaaacaucuuuuaaguaacuaguggaagcucaaaggagucagauagucuuagaaaagaagaguucuacugcugggauugggaacaaacaggcaagaagaggcaguaauuaaagaagauaauuuauauuaugucaucuggcugaaaauaagagaaguaauguugguuacuagaaaaaucuucccaaaagccaaaaacaacagauauuuuugaggaugcugaaagauaaaagaaacaaaucaaacugcaucacucacucaaggaaugauauuaugguugcuaauauauauguuuuuuaauuuuuauaaagucauuuauaguagacuuggaaaaaccauauaguaucaaaaugcaacaaaaauaauagaauaaaaugucuagggccaggcgcaguggcucacgccuguaaucccagcacuuugggaggccgaggcaggcagaucgccugagcucaagaguucaacaccagccugggcaacaugaugaaacaccaucucuacuuaaaacacaaaaaauuagccaggcauggcagcaugcaccuguagucccagcuauuugagaggcuggggcaggagaauugcuugaacccaggaggcagaaguugcagugagccaagaucgugccacuacacuccagccugggggacagaucaagacucuggcucaaaaaaaaaaaaaaaaaaaaaaaaaaggucuaaagggaaauucagaaacuuaaaaaacagaaaguaaucaccuuaucuaauguuaaugaagagacuggccuuauaaucaagaaaaugaauaguaauaaacaaagaggaagugaaagagaaaaaggccuauccaaaauaacuaaguccaaaaugaaaggcuacaaacaauaguuuaaaucaugcacaauauaagagaucccucuacugauaaggcuucuuuuucuuuauuuucuuaaauuaaaagccaaaaguuaccuguaauaucucugcuaaaucuucauuuccauugucuauugaaauaucaaaugcaguuuuacaaaauuuacuuugcguguguacaucagcaccauauuugauuaaaaguuccaccaccucuugaugauuguguucuguggcccaauggagagcugucaucuuuaacauguccuuugcauugacaucagcaccaugcuacaaaaauauuucaaagaguuuacuaaaauaugaaauaucacauaaaaaauuccugauaugaaauuauuaguucugugcuuuaaagcaagaacaaauaauguagucaauuauuuauauguauauguuaaauagauguuccaggccaggugcaguggcucacgccuguaaucccagcacuuugggaggccgaggcgguuggaucagcugagcucagggguuugaaacuagccugggcaauauggcaaaaccccaucucuacaauacaaaaaauuaagggccggacaugguggcucacaccuguaaucccagcacuuugggagcccaaggcaggcggaucacaaggucaggaguucgagaccagucaagccaauauggugaaaccccaucucuacuaaaaauacaaaaauuagcugggcaugguggugggcgccuguagucccagcuacucgggaggcugaggcaggagaaucacuugaacccaggagguggagguugcagugagcugagaucgugccacugcacugcagccugggugacagagauucugucucaaaaaaaaaaaaaaaacaaaaagaaaaaaugcuguagucccucaucauaagauagaccaagguccaagaaaucaauuagcugauuuaacuaagaauauaccuaaaugaaguuuugucccucaugaaaugaaagcuauaagacaauuuucauuuaaugggcuuauacacacaaaaaaugaaauacuauagauaaaauacuaaguaggcauuuaacaaaaacuaguucccucuccuucuuauaaaaccguaaaguauuuuaaaagcaaagugcaaaaagagaacacauaccuuaaguaaaaccucuacuaugcuggcauggcccucagaagcugccauauguaaugguguucgguccacuuugguucuggcaucucugcucacaccagcucgcagcaguaccucugugguggaauaaugaccauacugugcugcuagaugaaguggagaaguucccagcuguaccacagaaaaaaaaaaaaauccacauuuacauuauuguuacuacacuucuguuuauauaguaaacagauuuucuuuacauuaucuguuuacauagcaacucaaaacucaaaagaaaugccuagauucaugcuuaucacauccucuucauagacaucuugaagaauucccaaacacucucaaugaagaagaaaauccaguauuuccuuuaauucaaacuuucuuucuucauuauuuuuuaucagauaaacugccugaacaaaauuaauuucauuagaaauuaagauauagaggccgaacgugguggcucacgccuguaaucccagcacuuugggaagccaaggcggguggaucacuugaggucaggaauucaagaccacccuggccaacauggugaaaccccaucucuacuaaaaauacagaaauuagccaggcgugguggcaugugccuguaaucccagcuacucaggaggcuaaggcaggagaaucgcuugaacccaggaggcagagguugcagugagccgagaucgcgccacugcacuccagccugggugacacagcgagauuuuggucuaaagaaaaaaaaaaaaaaaagaaaucagagauagaguuugagaaauuuuucuguguauuagaauguauuccucauaccaaucacacaaaacuugcuaaguuaacuucgucuguaaaauucaucucaaauaaauguaacaguguacauuuuuacuuuaaguggaucaaaauuguuuuguaggucuuaaaaaauucacguauugaaacaucucagugaucuuuuuaaagggauuuuuuucaaaggaaaaaucuuaggugcauuugccaaaguugaaucaggacaaaaccaaaacagagcccaauucuccugaaauugguuccauguggucuagucauuaaauugacauccacaauacacagagggaguacuaaaaugugagggaaggaagauuaaguucuaucacaugcauuuaaaggcacagaaaaucccuauaacccucugauuaccacaucacuugauauuccaaagaacuaagauauuuggacuaaggaaauuuacacauauaaacaguuuauuauguuaugaagagauuaagugagauauauguauaaagguccuuaguccuaucucucuaucuaucuaucuauagauagagagauagauauauuuuuuguuuguuuguuuguuuaauuguuguuuguuuaauuagagacagggccucacuguguugcccaggcuggggugcaauggauauucauagguacaauuaucacacacuacagcuuugaacugcugggcucaagcaaucuguccaccucagccuccagaguagcugggacuacaggcacacaccaacaaacccagcuaaaccuuacauuuuuaagagaaggucaucccagcagaucaaagaagauccuuaaacaauccuuucuuucuccaugcuuugucaauuuuucuuuaacuagccuuuucuauacucuuaaauuucaguauuuaaugaaaauaucucaacagcccauuuagcaaccaggagcuuugcucaguuugacauuaggaucuacuuuuuuauuuuugucuucugagacuuucccuucuugguuauugacacaaaauauauauacauauaugcaggguuuuuuguuuuuuucugagacagggucucacucugucacucaggcuggaguccaauggggugaucacagcucacuguaccuucaaacuucugagcucaagcgauccuccucccucagccucccgaagugcugggauuauggauaugagccaccacaccuggccauguaguuuuuguagcuuuuuggguuuuuuuuuauucauuuuuuuagagucagcuucuugcucugucgcccaggcuagaaugcaguggagcuaucguagcucacuguaaccucuaacuccuaggcucaagcaauccucccaucucagccuccagaguagcuaggacuacaggcugagccaccaugccugacuaauuuuuuucuuuuuguuugagauggggucuauguugcccaugcuggucuugaacuucuggccucaaauaaucugccaccucagucucccaaagugcugggauuacaagcguaagccacugugcucagccaauauauguaguuuaaggcaaacaccugugaaucaacaccauagucuagaaauaaaacacugccaguaauuuaaaaucuggccaggcgcaguggcucacgccuguaaucccaacacuuuggguggccaaggcagguggauugccugaggucaggaguucgagaccagccuggccaacauggugaaaccucaucuacuaaaaauaaaaaauuagcugggugugagggugggcgccuguuaucccagcuacuucggugccugaggcaggagaaucacuugaacccgggaggcagaggcuucagugagccaagaucaugccacugcacuccagccugggcaacagagcgaaacucugucucaaaaaaaaaaaaaaaaaaaucuucccacaugccacucccugaucacaagccccucccccagccccagagguaacuaauauuuugaauuuugugacaagcauuacuuaguuuucuuuguaucacuuaucccuaaaaaauauacuuugguuuugccuguuuugaguuuuauuuaaacagaauuauacugcauguauuucucugugacuugccuucuuuugcuugacacuguauucaugagauucaccauguuaauaacuguaaguauagcuuacuaauuuucuguguucuauaauauuccauugaaugaguaaaccacaauuaauuuaaccaaucuacugaugaacauuuagauuguuuccaguuuuuguguuauuaugaauaauguugcugcuaaauacaguagucuuguauauguuucaggcacaugaacaagucuucucucgggaauagucuuagaagcccaacugcuacaucauauacuaugcacaucuccaaauuuacuaugugcugccaaacugucuuccauaacgauuauaccaauuccauacuuccaccaaaaauauuugagaguucccaccaucuccucaccaagccuugguacugcucaacuguuuuugcuaaucugguggauauauaauaguauuucaugauuuuacuuugcauuugccccaauuuuaauguaguugaguaucuuuucauguuuauugaucaaacuuucuccuugguaaagcaccauauccagucagucuucuauugccuugucuuuuuauugcuaacccaugggaauuccuuauguauuauggauacuaauccuucuuaagaucuuucugucuuugggaggccgaggcgggcugaucacggggucaggaguucaagaccagcuggccaacauauugaaaccccaucucuacuaaaaauacaaaacauuagcugggcuugguggugggugccuguaaucucagcuacuugggaggcugaggcaggagaaucacuugaacccggcaggcggagguugcagugagccgagacugaaccauugcacuccagcccaggcaacagugugagacuccaucucaaaaaaaaaaaaaaagaucuuuuugucuugagguacuacagcaucacuaugauauaucuagauauagauuaguuuuuaaauugauccugcuggagauuuguuaggcuacucaaaucugugggcugccaucuuucaucaguucuggaaaauucucagcaauuaccucuuugaauuauuucaucccuauuuuugcucuuuuuguggaucuaugaucagauguuagacuuucucacaugauccuucaugauuccuaacaucucuuuuacauuuucuaucuauuuuuaucugugacauagucuggaucauuuuuuuuuucauaccuuucaguuuacuaauuuucucuuuagcuguuucuaaucuguuacuaaaauuuuaucucaaguccuuauaggucugcuucuguugacaguuguuuuagcagauuacuguccaaauuggcauguguucauguguuuaguuauuucugacugcucacuuuccuuugaauuucauuuguggauaugaagccugggaugaaggcagguuccuccagagcagauauucauuugcuucugucaagagccugggguaaucccuaguccaaagaucacuucaaauucauuucucaguuuacaguuuuuuagacuacacaaguauuuaugaguucaggcugcaaguguguaaaaaggaugccuugugauuccaaauucucaccaucagauuguuuuccucucuccauuugaugucuugguucacaucagcuuauuaucuuugcagcaucacggcaacaggggcaagggcaggagcagacaggaggagggacaggguauuccugcuuuaucccuacacugaaggugcagcucuuugggauuccagaauuaugagauaagaucuccuaucagacuucucuccaugaacacucucaggucuuuagcuuuaguaccccaagccagugagguggaaaaaccaccagacaagugugaguucaccuaauguucuuuaggguaaaauuucucuggguucuugccuucacuuaguuuuucagguugauaaucucuuucuuucuaauucagcaguguacuuaagaagacuuucuuuaaaauauuucaucaaaaagucuuuauucuuuaaagauuuauuuauucuuuaaagaaacauuuauggauaaaaugauauggucccuggaauuugcuuuaaaauaauacagaacaaaaaauaauacaguagacagaguuauagaggaaacaauauucaucaugauuugauaauuuuugaaguuggguaaaggguauuacagggauaucguugauauauauuugaaauuuucuauaauaaaaaauuuuguuuuuucaugaaaaauguaaaaagagaaagaaaggcaaaaacggcaaaaucaaaaaucuggaauuuuuaguuguuaccaaugggcagguuaauucagauuccuagcauuccauauccacaagacaauacuuuuuuauuugcccccagaauuaaagaguuauuuuuuuuugccuuccccacaacuaccuucuuuccauaguugucaagaucucauucccauuccuuucuuccucuuucgucaugucugcaacaguuuuacaaguaauaauugaaacauaaacuuguuuuucuuuuaggagugacuauuaacacuaacuccaaucuuuaucaguaucuuucugaauuauaaauucuaccugugcuauuuauaaggccuuuaaauuaaaucccaagcagauacauuuuuauauucaugccacauuaaugcacuccacaguuugaaagaaaaacucuuuguggaugaaauauuuggauaagguuguccaauaucaaagaaaauaauauaaaccacuucuuuuaggacaguuauaauucuaaaauaauaaacacauuugcaaaaauaauaacuuuuuaccacuuauaaacacaauacugacuacauuuuucucugcaaaaacucaaaaaugagaaggaaaaagaacacacaauauuaaaaucauucuuuacccagucuguaguaaagggagcuccauuugccaucaaaauacgaacuucaucaucuugaccugcucgugccgcuucuaaaagcuucuuucccaaaucuaccagggacaucuaaacaaaacauagaugaacugaacaucaaaaucuccauuuauacacuaugacaugacauuuucccuuccugucuuuauuaauaagucaguucucaauuaucccuucaaaagagugugcuaugguuaauuuaaaauuacagaucauacaaaagcaauuuauauuuggauuuuagaauccauuuuccuuucucauuaaguuuuuacuuagaauaaaaguaguuuaaauucuccaaauacaucugguaaaagauagaagagguaaguagcagagaaaagcuggccuaaauuuuuauuuauuuauuuuuuucuugacacagagucucggccugucacccaggcuggagugcaguggcacgauguuggcucacugcaaccuccgccuccuggguucaugugauucuccugccucagccucccaaguagcuuggacuacaggcaugcaccaccacacccagcuaauuuuucuauuuucaguagagacaggguuucaccauguuagccaggcuggucucaaacuccugaccucaaaugaucugcccgccuuggccucccaaagugaugggauuacaggcaugagccaccccacccagccaagcuggucuaaaauuuaaaacuggcaacuaauuguuuuuacuggaggguuugcagcaauaaaauuuuucauaaaaguaaauaaagugcaagauauugucaucuguuguuggugcaaauuaaacuaaacuuagcauaaauuuuuuugcaauaguaaauguguucaaaauuuuaaaaaacaaauuuucugcccuccuacaugcaauguauauuuaaguucuugcagaaaguaaacaauucacauucuaugaaaauacuaaaaacaguaauaguauuacgaauagacugucucauuagaggcuagaggccaggugcgauggcacaucccuguaaucccagcagucugggaggcugaggcagguggauccuugaggccaggaguucgagaccagccuggacaacauggugaaacccuaucucuacuaaaaauaaaaaauuggcugggcaugggggcucacaccuagggucccagcuacucaggaggcugaggcacaagaaucacuugaacccaggaggcggagguugcagugagccgagaucaugccacugcacucuagccugggcaacaaaguaaacucugucucaaaaaaaaaaaaaaaaaccaggaaagaauaucuugugccuugaauuuaauauaucugaaaaggcuaaugucccagccugggaugugaggugugcauggguguguauguauuugugucuucuugaauaagaaauauugaaauauaugucagaaaaaagauuaugacaguagaauauagguaaauuaagauuugaauguaucacaaacauucaaauucaagggaugacaguucugagaagaaaguuuccaaacccagaaagacuauccagcuggaagauuacucaauuaugucauacaguauccuaaguaaggaaaagcagaauuuuaggcccauggggaagggaauauauggaaucccugagauuuacaaugaaaaaaugugccugggguauaaauuuaucucaaaaaaaguauauacucugaggguuagguaaguagucaagagaaaauaaauuauaaagagaguaauggcagguugauuaguguaucucuaccugguaugaacaacuauuacagguugaguaucccuaauccaaaaaucugaaaucugaaacuuuuuaagcaucaaaggaaauacucauuagagcauuucagauuuugcauuuuugcauuagggaugcugaaccaguaaguauuaaugcaaauauuccaaaaucugaaaaaacccaaaaucggaaacauuauggaccuaaguauuucagauaagggauacucaacuugcacucaauaaggaagagaaaggagcguaugugugagaaggaaguuggcaaauggggcuugaaaaaguuauuucugccagaaagaaacaaaauguucuacaucauuaaaagggauaagaaaucuaaaagggguaauuauaagaaaagcuguccaugaaaauaaacagaauuaugccuauaauuuuuaguagauuagcuacgaugggaauaaccaagcacagaagagguaaccagggacagauacuaauacuuggaggcuugcacaauaauuaggugagauauacauaucccaaacaggccuucgucacaaggcaagaaagaauuucuuagaauuguuucauuuguaaggauaaaaauaaucuauauuauggcaaggcgcagcagcuuacaccuguaaucccaccacucugggaggccgaggugggugaaucacuugaggucagguguucgagaccagcccggccaacagggugaaacccugucucuacuaaaaauucaauccagccugggcaagagugagacuccaucucaaaaaaaaaaaauaaucuauauuauauccuguaguaaagaauaggaaaaacaaccacauguacuugugggauuuauauggguuuuuuaaauacacuucucugugacacucgcaacauuuucauccuugaauuucugauuuccuuuccuuuuuuucuccuauucucucauaccuugauggagucacugaaagccaagauacuccucaauccugcuuaaagacgcuaagaucuauagagauuacugaucuccaaugaggcauuuuuuccuagauaauauguaacugcuggacaguaaaaauuaacaucauauucaacagggaagaaaccugcaaaaauaauuuccuauuaaaggcaggauaaagcaaaaagaaaccgaccucucuccuacagaaguacgguaaaaucuaaacuggucacacuaacaaauacagcauuuauacucugaaugauauaaauuuggcuuuacgaugaaauuuaucuuuccaaaaaucuacauuuuuaaauagguuuuacacagguaauauaaaaucaguuugcauucauucagcauacauacugccaaaugguuuagauaucugaguaucuuuugugaagugagaguuuagggcuuuuccccaccuuuugaaacuggguugucugucuuuuuuuuauugauuuguaagcguucugacauauguucuggauaugaguccuuugucaaauauaacaaguauuauaaauaucucuguccagaacccugaauuuugacugucuuauguucuuucuuugauaacacauaguauuuucuauggguagauaacuguugagucucauaaaaaugugcaacuucuacauauuaaaauaaucaaaauaagaaauggcaaagaaauauauuuaccacaaaaaugacuagaagaaacauucauguuuuacuuauuuaaaaggucugacucaaaaugaaaaggugggggaaaaguaaacagcaaggacccaacacaucaauaguuaaaagacaggaccauauguuuuacagaaaagaaaauagaaauaauucacaagggcaaaaaaugcucagugucacuguuaaucagguuaacauaaaguaaauaauuuuaaaguaauuccugaugcagccaagaauuaagugaaacugaugcuuugauauauugacaacucagauaugcugauaguaauauaaguggaucagcuuuauuuuuuagucaacugggcaaauuuaacaaguuacaaaaauauccaaguccauugacccaauaagugaucccacuucuaagaaucuauucuaaaggaaaaauauauugaaacagauuuaucaguaaagauuauauaugcauacacauauauauuauauauaacucuucuaaugugaccaaucuaaagguaagaaaaugauugaauuguagaaucuaaaggaaaaaaaugcaguaauuuaaccuaauaguuuugaagcuauauaaacaacaaaaaauuuaugccacauuaugaaaagauauaaaucuuuuuaacgucaaaauaugcauauaaaguauaaaauacugaaaaauauuaacaauuguuuaggaugguaugauuaugggaaauuuugucauuuuacaaaguuucuaauguuacuauauuaccuaauuuaaaaaauuuuuuuucaaagggacaaauuacauuguaugacugucaacuaagcaaaugauaacauuaaggaaaguuuuauguuccugacuuacuagagaggaugagcggaaaaaacaaagaaaauguauaauguugggaacuuaaaauaucaaucauagaucugcuuacaugaauuauaauaaaaucaugaagcauuugaacaaaucgacuuuuaccauaauuauucaauugucuuaauuauucaaaacauaucacaguuuaggaccuaauauacuuaaguuacucugguuuuaaaauuccaugagcaauacagccauacgguagauuuauuuauuuauuuauuuauuuauuuuuugagacggagucucgcucuguugcccaggcuggagugcaguggcgugaucucggcucacugcaagcuccaccucccagguucacaccauucuccugccucagccucccgaguagcugggaguacaggcgccagccaccacgcccggcuaauuuuuuguauuuuuaguagagacaggguuucaccguguuagccaggauggucucgaucuccucaccucgugaucugcccgccucggccucccauagugcugggauuacaggcgugagccaccgcgcccggccgccauaugguagauuaauguagauggauucuuggaaaucagugguucucauugguagcagcacugcccccuucagggcccuuuguauguuuauagaggcauuuuggagacugaaggugaggaugcucugcuagcauuuaaugggcaagugccauggauacuagagguccagcaaaggagggaauaauccuguaggacaaagaauugucacauguucuagauaauuuucaaagauuccauugaaaauauaucuacggcuggaauauaacauguaaacaaaacguauuuuuccacaguguuaauguauuccaaauauucuagaaugcagccauacuauaaaucuauuuuguuuuguucagaaauuuacuaagaguuguuuaccauuuuggaaaucaugucaaugccacuuuggcaucugcaucaccaauaucacguaucaaucagcuuguccagcuaucacauucacagugauuuuaugugcugguauaaguauuuuacuaccucacugugacaucuaauguagugugcucaaguauuuacauauuuuaauacacaauuuauuauaaauugcuuauuuucaaauuauccuuuauauuauaaucaaaacaugauuuuuuugaaauuaugcagaucaguaacauuaacuaugauuuucuuucuuuucuuuugagauagagucucucucuguagcccaggcuggaguacagcggugagaucauaguucaccacagccucgaccucccaggcucaaccgauccucccgccucagucucccgaguagcugcaacuacaagaguacaccacuaaacccggcugauuuuuguauuuuuuguagaaauggguuuuugccauguugcccaggcuggucuugaacuccugugcucaagcaaucugccuacugcagccucccaaagugcugggacuauaggcaugagccacugcacccagcaacuaugauuuucauuuaaaguuagcggaaggggcaauacaaaauauuuaucauaaaaagguggcaauggggcuaauaagauugaaaucaauggaagaaaauacacaugagaucaagcaagacaaaaaucaaagguccucugauuuucuugucaagauaauuaguaaaguuuuaaauaaugaaaacaaaaucguagcauuuucacuucugauucucaccugacagggaccacacacacucaucguaguuuuugacccuuagaagaacucaguuguaauaagacaacuacauugaccaaggggagcauagcuccaggucaagucacuaauuuacucaguucaauaucuauauauuaaaauucuggacgggugcagugacucaagccuguaauccuagcacuuugggaggccgagaagggaagaucacuugaggccaggaguuugagaccagccuagccaacauggugaaaccccgcccaucucugcuaaaaaauacaaaaauuagcuggguguggucccagcuacucagguggcugaagcaggagaaucccugaacccaggaggcagaggcuguagugagccaagauugcuccacugcacuccagccugggcaacagagcaagacugucucaaaaacaaacaaaaauccucagacauaaagugcuagauuuuuaaaaaaucauuuaguuuaacaacaaaaauauauugcuuuucugcuguggcaaauaaguucuuuacuccaauuaaaauguauguuaauaauaaaucuauuauacaaacuagcuacuuuugcucaaaguacaugccaagauggccaucuagugguaacaggaauuacuaccaauaauuacauguuaaagcuuagucuauuuuguuuugaauuuccguaauuuacagcuuauagaguuguugugaggauuauggcauguacuagacaggaaaacucuauaaaagcauaaaguacuaguuccacgugaaugguuacuagcacucuuaaauaagaauaugaauuuuuaaaauguuuacaccuauuauauuuaauaagccuuuacucacauuaaaaauuuaaaauaaacuugcuauauaauucuuaugcucaaugaguacaauuauaaauccaauauaaaucuccuaaagauuuucuccacuccaauuuuguauuacacacacaucccuacacacacccagucuuuaaaauguucauacucuuugaccuaguaauucuacucaaauaaacccaucauaaggaaacuauucaaaaaucuaaauauaucaauacuaauguuauuuaaaauaaggaaaaaaacaaccacaaacaaugauuaaagaaauuaagauaugucauaauggaauacuguagugauuuauuucuuuuacauuaugaacaauuuguaguauauauaaacuagacagucauauaauaaacucccacauagccauuuaguuuaauauuaucaauuaauggcugacucauuucccaacuccacccauuguuuucaaucaaguguuagacauuauauaauauuaucucuaauauuucaguacagaucucuaaaagauaaaaauauuuuuaaaauaauacuauauauauucauuugaaaauauuuacaaacaguauguaacaguuuaagaaucaggacucuaaguuguauauauaccaugaucuuaauagaaaaacacuuggagccgaguguaguggcucaugccuguaaucccagcacuuugggaggccgaggcagguggaucaccugaggucaggaguucaagaccagccucgccaacacagugaaaucccaccuuuacuaaaaauaaaaaaauuaaaagaauuagcugggugugguggcugacgccuguaaucccagcuacuccggaggcugaggcagagaaucgcuugaacccgggaggcagagguugcagugagccgagauucugccauugcacuccagccugggcaacaagagcaaaacuccgucucaaaaaaaaaaaagaaagaaaaaaaaaaaccacuuggaaacaauacaccauuguaaugaaaacuaugaauuuucccuuuuuucuacuuuuuucuaaguuuuaauuuuuuuauagcaagcauauauuacuaauauaauauuaaaacuuuuauuuaaaagcuuuuuuucaaaauuagguuacagauaagcuuaauaaagccuuuaaugcaccacauuagauauugaggcugggcgcgguggcucacgccuguaaucccagcacuuugggaggccgaggcggguggaucacgaggucaggagauugacaccauccuggcuaacauggugaaaccccgucucuacugaaaauacaaaaaauuagcugagcguggugaugggugccugcagucccagcuacucgggaggcugaggcaggagaauggcgcgaacccgggaggcggagcuugcagugagccgagaucgcgccaccgcacuccagccugggcgacagagcaagacuccguaucaaaaaaaaaaaaaaaauuaguuauugaaagcauuuuucauaguaaaaguauguaaaauaugacuccaaguaaaauuuagcauacuauaaucauguguacguguaugaaaauauuccaaauuuaguugccuacagucucauaagaaaacaauuucaauaauaauaaaaacagucccuagcaucuugcucuuuaucuacauugucucauuuuaucuaaagggccuuaacaagaucauuauugucuccacuuugcagaggaagcaaguaaaaaguaaaaagauuuaccaaagaacacuaguuuugaucuuaaaaucagacccuuauucucaauucuuccuguguucuaaguugaagaacacuaggaaucugcugggauauaaagggcauguccuccaaggauuuaaguuuagugucucccaguguaauuccuuugaaacgaaaaaucaucacaugaacucugguauauuuggauuuuuuccuccaugcccauuuuaccuaauggaguuuuuuuccccuuuauuuuuaaaauaaaugauauuuucaaauauuauauccauauauguaucucccauauaccccuuuuucagaaaaccacuagaugacguguuccaccaaaaccaaaaguaaacuagaaagaauaaucaagggcuucaggaaauaaagauccaacauagaauaggagagaguacccaaaaugauggugaagggagaccccaagacaacagcugugacacagaccuagaaggcaaacccagaugggagccagagaacagaguuccaggaaggaggucuccaaggaaaagacaggcugguaagucuccuaagaagagaaugaaugucaguggagaguuugggaugcguuaaugacggauacaagaaaacuaagaaaagaaaaaacuagacuauuuuucagaagggagaaaaaaacuauaccauaaagguauacaugucucuuguacaguuuuuccuuuacacacacacacacagagauaugcacacgcauuuccuuugugguauaggcguggauuagcuaagaauaauaguuccugggguguaauguaaagcaaaauuuucaguguaauccuauugaaaagauaaauggugagggaaaauaugcauaggaauagcuuaaaacagcugaagccucaucuuccuaaguagaaagucaaaagguaucuaauguggaaaaaaaucaagaaauagcacacauuuguuauuuagaaauaugaagagcuaaucauaaaauggagaccucugggaaagaggguucuggggugggaagaaauaacacaacugaguguaggauuuucauaagaaggcuuauuuuuuuacuuuuucaacuaugugcacauauaauuuuuucuuccuuaaaaaaaguuuuuauuuuuauagauucagcagguacaggugcaguuuguuacacguauauauugcaucguggugaagucugggcuuucaauguguccaucaccugaauagugaacacuguacccaacagggaauuuuucaacccuugccccucugccacccuccccgcuuuuggacucccuagugucuauuaucccccuccguauguccauguauaaccacuguuuagcucccacguauaagucagaacugugcauguauacuuucauaaaaauuacagggcugggcacaguggcucaugccuauaaucccagcacuuugggaggcugaggcgggcaaaucacgaggucaggaguucgagaccagccuggccaacaugaugaaaccccgucucuacuaaaaauacaaaaaauuaucuaggcauaguggcaggcgccuguaaucccagcuacucgggaagcugaggcaggagaaucguuuugaacccaggaggcagagguugcagugagccgagaucacaccacugcacuccagcccaggcgacagagugagacuccgucucaaaaauaaauaaauaaauaaauaaaaucacaauaaacaaacacauguuuacuguacauaagaauuauacaguuuaaagucaucucaacacauccuuguguucucagaaguaaccacuaucuaaauguuuagugugcauccuuccagaucuuuucuaugcauauuagaaacacauacacacaaugcuuacuucuuuuuaaacaaaaacacacaaaggggucaggcgggugggcaaaaauaaaaaauuaaaauuaaaaaacacacaaaaaggggaucauacuaaauuguuuggcaacuugccuuuuuccccauucacaagcaauccucuuuuuuucauuuuacuuuuuugagauggaguuucgcucuuguugcccaggcuagagugcaauagcacaaucuuggcucacugcaaccuccgccucccugguucaagcaauucuucugccucagccucccaaguagcugggauuacaggcaugcaccaccaggcccggcuaauuuuugcauuuuuaguagagaugggguuucggcauuuuggucaggcuggucucaaacuccugaccucaggugauccaccugccuuggccucccaaagugcugggauuacaggcgugagccaccacucaaaggcaauccucuuguuuuuucagugaaaucuuccugucucuguacacacagucuuuuuaguggcugcacaguacuauggagugugacaggcugaauaaugcucccccaaagaugucuagauacuaauucucagauccugugaauaugcuaccuuacauggcaaaaggaacucugcagaaaugauuaaauuaaggauccugacuagggugguuauccuggauuauccaaguaugauguaaucacaagacuucuuauaagagggagacaggaggaucagaacaggagaugugacauugggagcagaaggucacagucagggagaaggaagcagagaucagagagagaaugagagagauuugaagauacuaugcuguuggccuuaaagauggaggaaggggucacaggucaagaaaugcaugccuucuuuagaagcuagaaaaggaaagaaaacagauuaucuccuaaagcuuccagaaggaacaguccugccgaaauccuaauuuuaggucuucggacuuccagaacuauaaaauaauaaauuuauguuguuuuaaggcacuaagguuguaguaauuuguuauagcaaauaggaaauuauuacacgauaggaauaggaaacaaauacacacaguauacuaauuauaugauccuguuuuaauuuuucaccuuuacaaauagugcugcaauacacacgaguuagcauuguucuagaaauuauggugagaagcaggauugcuagacuuguuuaaaaucacauuuuaguuguaauuagacacugccaaauuaucuaccaaaagauuguagcaacuuauacucccacuaucaguguacaagaauaacugcuucuccauaaggucuccacuccccacagagagaaccuugaucucagagcuagaucuuccaaaagucaagaccacuuccagugaaaucauacucacaaagcugaugaaaaacuuccuucuaggauaacuuucuuucaguaaccauaaccugaggacaucccaccacauaaggagagaaagacuuaagaaguaaaagaugcggcaacccuuuuaucgcuuuuaaagucugcauuaaaagggcauucuguuagccaggcaugguggcuggcaccuguagucccagcuacucaggaggcugaggcaggagaaucacuugaacucaggaggcagagguugcagcgagccgagauuccgccauugcacuccagccugggcaauagagcaagacuccgucucagaaaaaaaaaaaaaaagcucaauaaauauuaauccauugaaugaacaauauuuggcacacaguagaaacuccagaaauacuuggaaccaaaaucgucauaauguuugccuuuuuuaaauguaaucuaaauuucacaaacccuaggaaauaucauaauagaaugcuuacugaauuccuaagucagccuuguuguaacaaaauuucuuauaacuaaacaaggcuggaacuugccuggauauuaucuuuuuauuggcagcaacucaaauuaacagaugugaccaaaaaaaaaaaaaaaaucugaggucaauucgguuuucuagucaaaagaaaaaauugugaacauaauaaauguagauauuggcuuugucugagacccucagaauuacucuuggaccugcccaguuagcauagaaaaaucuaggcaggaagccagaacuugucuaauaacuagcaauaauauuacaaagcaaaaucagcucaggaccacccucaaugacaguagaucaaaucaguacaccaaacugaguucaaagguuucaaauggguauauucuaaaacugagguguccaggcugggcacagugacucauaccuguaaucccagcccuuugggaagccaaugccagaggauaacuugaggucaggaguuuaagaccacccuggccaacauggugaaaaauacaaaaaaaaaaaaauuagccgggcaugguggugcaugccuguagucccagcuacucaggaggcuaaggcaggagaaucacuugaaucaaggagauggagguugcagugacccaagauugcgccacugcacuccagcuugggugacagagcaagacuccaucucaaaaaaaaagaacugauguguccaguacaguaaccacuaguuauacaaggauacugggcauugaaauguggcuaguccaaauugagaugugcuauaaauauaacauaccagauuuugaagacuugcuaucaagaaggaauguaaaauauuucauuaauaacuuuuauacugauuaccuguugaaacaauauuuuggaagggccaggcacgguggcucaugccuguaauuccaacacuuugggaggcugaggcggguggauugcuugagaccaggaguucaagaccacccugggcaacauggcaaaaccuggucucuacaaaaaauacaaaaaaaucaaccaagcaugguggcacaugccuguagucccaacuacuucggaggcuaagaugacagaauaaccugagccuaggaagucaaggcuacagugagccaugaucgcaccacugcacuccugucugggcaacaggagugagacccugucuccaaaaauaaucauaauauuuuggauguaagggauuaaacucuauuacgaaaauuaauuuugcugggcacaguggugugcaccugcaguaccagcuacuugggaggcuaaggcagggaggucacuugaaccuaggaguuugagacuguacugcacagcggcuacuagaaauuuuuaaauuaaaucuguggcugcaggcaccacugcagaggaaugggaagcugcuacccuaggaucaggcccaugggggaaaugggaaaccuugguacugcaguaguuccugcuagcccaucauuuuuaggagccaugacaacaaaaccaaucauaauuaauagaaugcacuacucucacuacaggccccagaagacaacauacaugcccuuuauuuaucccugccuaagggaaagaaaaaaaacacgugcagaggcaagaaguggcugaggacccagagugaggcagggagaggucacucagccuuucuacgccucaguuuacacaccuguaaaaugagaguaauagcacaaccucucucacaggguuguucugaggauuagaggcaauuagccaggcacaguugcuuccaguauuuggggaggcugaggcaggagcaucccuugagcccagaagcucaagaccagccugggcaacacacagagagauagcaccuuucccuaaaauaaaauaaaaaauuagcuguaugugguccugucuuccuguagucccagcuacagcuacucaggaggcuggggcgggaggaucgcuuaagcccagaaguuugaggcuucagugagccaugacugugccacugcacuccagccugggcaacagagucagauccugucauuaauuaauuaauucauaaauaaauaaauaaaauuuaaauuuaaaaaaauggcuggguguggugcucaugccuguaauccuagcacuuugggaagccaagauggguggauugcucgaacccuggaguuggagaccugccuaggcaacauggcaaaacucuaucucuacaaaaaauacauaaaaauuagcugggcggguggcacacaccuguggucccagcuacucagaaggcugagaugggaggaucaccugagcccagcgaggucaaggcugcagugagcugugauugcaccacugcauuccagucuagacuacagaauaagaccucaucucaaaaaaaaaaaaaauuuuuuuuaaugaguucauugauggcaagcgccaggccaacaguaagugcucaauaaaucugaguuacuauugucucccacuguuaacgaccugcauucguugagugcugugugaccaagcaccaucucccuacacacaguccuagagaggggcuguacugccuauacucacuuuacagaugggaaaaccaagguuuggaaaagucaccugaccaaggucccaaagcuaguaggugagaaauucagccucaaaggugggcuccccuggcuuugaagccccuccagugauccaaugcccugaaugcucccaaugucuccguggcuuuuuuuuuuuuuuuuuuuuuugagacagagucucacucugucgcccaggcuggagugcaguggggcaaucucggcucacugcaaccuccgccucccgaguucaagcaauuccccugccucagccucccaaguagcucggauuacaggcgcaugccaccacgcccagcuaauuuuuuuguauuuuuaguagagaugggguuucaccauguuggcuagacuggucucaaacuccugaccucaggcaauucgcccgccuuggccucccaaagugcuaggauuacaggugugagccaccccgccuggccucuguaguucuuucuaugggcacaaguuaagguuauaguacuugcuguuaagaaaauaaaggagguuagcuagacccaagaaucucuggcuccuuggggagacugugggauuaugaguagguuguuucuugucuccacuuuuuagagggcuggccccaccagacaugcauagcucccugaaaauaccaugcccaaggaagguguucaguaauguguguuccuuucugacucuaaaugucagguccuuucuaaguaaauuuugugauuuaaaaaaggugaagucaguacaggaugaaaugugcuuugagagugucaggaugaaauuguuuccaugaggaagagggacaaguguaccccaugguaagugggccuagaucaagacuuggccuccaauagucaguaacuacaaacuggacaaauaauauuuugagggcacuaaggcaauaugauguuaugccaaaaaaaaaaaaaaaaaaggcacggcuaaaagccagaaguugagaccccaccucugccacagaucagcugugugacccaggugcaaaucucgucacucccugucugguucuguuucugcugauguagaauggagcaaucaaugacaaaaaaaaaaaaucaucaucaucugugguucacuauauuucuacuggagagagcuguucuagaaucacuggucaaacuuuuuuuuuuguuuuuuuuucuugagauggagucucgcucugucgcccaagcuggagugcaguggcacgaucuuggcucacugcaagcuccgccuccgggguucacaccauucuccugccucagccuccugaguagcugggauuacaggugcacaccagcacgcccagcuaauuuuuuguauuuuuaguagagaugggguaucacccuguuagccaggauggucucgaucuccuaaccucgugaucugccugccucggccucccaaagugcugggauuacaggcgugagccacugcgcccggccuggucaaacuucuugaagccacuaacuucagaauaugcaagaagucauaacauuuuaaaauaagauauaaggguuuuuuuuguuuuuuuuuuuuuaagacagagucuggcucugucgcccaggcuggagugcaauggcacgaucucagcucacugcaaccucugccucccagguucaagcgauucuccugccucagccucucaaguagcugggaauauaggcgcccaccaccacgcccagcuaauuuuguauuuuuaguagaggcagcguuucaccauguuggccaggcuagucucgaaccccugacaucaggugauccacccaccucggccucccaaagugccaaaaggcaugagccaccaugccuagccaaguggauucuuuuagaaaaacuucaucuaggccagacauggugguucaugcccauaaucccagcauuuuggaaagccaaggugggaagaucguucaagcccaggaguuugagaccagacugaacaacauggugaaacccuaaucucuccaaaaauuuuuaaaaauuagccaagagccagguaugguggcucacgccuguaaucccagcacuuugggaggcugagguggguggaucaccugaggucaggaguuugagaccagccuggccaacauggugaaaccccgucucuacuaaacaauaaaaaaacaauuagcugggcaugguggcaugcgccuauagucccagcugcuggggaggcugaggcaggagaaucgcuagaacccggaaggcagagguugcagugagcugagacggcgccauugcacuccagccugggcaacagagugagacuccgucucaaaaaaaaaaaugaaaaacaaaaauuagccaggguugguggcaugcuccugugguccagcuacucaggacgcugaggugggaggacugcuugagccugggaggucaaggcugcacugagccaugaucacacuccuacacgccagccuaggcaaaagagcaagacccccgucuuuaaaaaaaaaaaagaaagaaagaaaaacugcacaugaugaauugccccuguuauggugcugaauacgcuuuccuucuaaaaaccauacgaggagacagccuuuauccuuguaagauuucacaaauucauuugacaaugaagggggcccauggauuuuacuaaauccuccucaucuuugccacugacuaugccuuugcccaauucaacuaccaguuguuuuuaaaucacaugaauguaucccaggaaaaaaauggaggcuugaaaagagugcaaguagaagauaaagaaaaggcuuuuuagaacucuacuggaauuagccaguagaugccuuugauuuaaucagggaaguauaacuuaccugcuuccuacaaaaugaagccaauaaacugcugguucuuguaagucacaaaaaugaaccaucaauauucugcucaaaaaaagaaugcauacauucugauccuuucuucucagaaguucucauacacauccccuccucucuacuaccucuggucuuacacacucauugccucauaccuuacacaucacaauggucucucagcugauuuaacucuaguuucuccauccugcugccaggcaaucccccuaaaauacaauuguauucaaucaaacauuucuauauuugaaccucuacauaguaccugcccuuaaagaauucaccaucugguagggaagacauacgucucaugauucccuuguccaaaauccccaccaauacaaucauucugaagaacaauuuaucaacuucuaguagaguuuaagaugggaugaccgggcgugguggcucaugccuguaaucccagcacuuugggaggccuaggugggcagauugaggucaggaguuugagacuagccugaccaacauggagaaaccccaucucuacuaaaaauacaaaauuagcugggcgugguggugcaugccuguaaucccagcuacuugggaggcugaggcaggagaaucgcuugaacccgggagguggagguugcagugagccgagaucguggcauuauacuccagucuggcaacagagcgagacuccaucucaaaagaaaaaaaaaagaugcgccuacucuuugaccuagggauuccacugcuagcuacccuaucuugguauacucuuaaacacauaaacaaggaaagaaauauguuuauaaaaacauuauuguaacaggaaaaaaaaaagaaauuccaaauaaccuaagugucuauaaacgaaaaaauuaaauuuucauuauacaaauuuucaaauauagaaaauauacaugcauauauauaauauauacuguauauguguguuuguguguuugauuauacacauaccuauauacccaucauugacauucuaaauuaaaagcuggucaucuugcuucauccuauuccuuucuaaaaaaaaaaaaaauuguacuuuacagcuuacacauguuguauuugguuacucuaucucuaaaucaaguuuauucuaggacacuuucccuuucucccaucuaccucucccguuuuucucccucaugacauugauuuguugaaaagaauggucgguucaucuguaccucauacugaguuuuuuuuauugcuuccucaagauagcauguaauuucuugaucuuccauaugucuuacaaacuaagucucugaaguuaauuaaaauucggauuuaauauuuuagacaaaaaaugucaauagcaacaugcuugauauugaagcacaucaggaagcacaucuuuuuuggaucacuuuuaaugauacuaagaauaauagcuagguuagugauagucuaauccuuccaauguaaaguuauauucuuuuagcuugaggccaacuagaaaucuguggcaucauacuuuggcuccaugggaauauccaauucccaaacauuuuugucugacaguuuuagcacccauuaaugauccuggcccaaaucaauuauucauaacagguuguaacaaauugucacuuucaaauucuuuauuuccuucuacauuacuuggcaucccucacuaaauauaaaauggugcccacucaaaaggcaguucaaauauauuaucguuuuucauuaccaauuuucagaguaaagaauaauagccaccuagccaccuccauuuguucuauuuauuguuauauaaucauuuucucaagaaauuauucuccuuauuucuucugauguucaaauugucccaauuuuggccaaggagagccuuuucgauuuggcuuuuccaucuuugaaagcuuucuugguuuuggcacaagaauguuccagguuacgcauguccccugcuccagacccagaaucagucauuucuucaaggaguccuggauucuuucaaguacaaguauuuaaagaccaaaauuaggguuuuagaagagcucacaucuaccaagaugacaaaguguuucuagguccucucaguggacagagcuaaggaacaaauuuauauggauugaauuaagaaauguauauuauaaaugaugaauucauauugacauuuauaauucagguucaaaauuauagguuuugugcuuagcuucuuugauuuuauacuuguaucucuauugauucguaaucauucacauaaagacuuacugccuuuauccuacaauacauaucauauggugucaaaauuaaaauaccaauauuacaacuagcaauaaaaugaauaaagguggggguuuuuuugcaguucuuuuauccuuagcguauaugccauuuaguauuaagcuccaaagucaccugaaauaguuuuucuccauguauuuaaauaacuauuuugauauaaacauggauaccauuguucaaguuugucuucaauuuuaaggauuuaaaaaaauuuacuauaauuuuugaauguguauuuacauaauucaaaagucagagcuaaauaauaaaaagacacacucagaaaucacauuuccaucccuacuucauguauuucccauaccuucuaccauaggguaacaauuuuauuaguuucuaauuugucuuuuaaguguuucucuuugcaacauaaacaaauuugcauauauucauauucuuauucuccacccuuccacucuuacuuuuuuuuuuuuucccugaaggcagggucucauucugucacccaggcuggaaugcaguggcgugaucauggcucacugcagccucgaccucucagauucaggugauccucccaccucagccuccgaaguagcugggacuacaggcacgcaucaccacaccugacuaauucuaauuuuuggagagacgagguuuugacauguugcccaggcuggucucaaacuccggggcucaagcaauccucccaccucagccucccaaagugcagggauuacaggcaugagucaccaugcccagccaccauucccuacuucucacaccaaaggaacauacuaaacacacauuguucuguacuuugcuuuuuuucccauuuaauauauauccuggaaaauacugcauagagauuuuucucauucuguuuuacagcugcauaguacucggcuaugugaaaauaccauuguauacuuuuaauuaaaaaaaaacuaguuaucucuuacucuagcaaucacaagaucucaccuugcaauuugagucccucuaucaacugccucacacauuuacuucauccauuuuucucugaauauagggcccugacagucauccgauuuuaaacaauucuccuuccucaucucauacacacuuaccuuauuccagacccaauucuccuuccucaucccauacacacuuaccuuauuccagacccaaugucuccccucaugcuauuuucccaguuuagaaugguuacauccuuucucuccaaaugcuauacuucaaucaaagcccauuuuuaaaagaucuuuucuccaacaaaacuuucuaagaugagcucuuaaauuuccucagcaauauauagcauaaucucuauguuucucuucauucaacaaacaaauguuuacugaguaaaugaagagcaaagagcuuauguucugggauaagaacuucacaauaaagaaguaaauaaguaguaguaguaguggugguuguggcagugauaaacgguaugaagaaaaaguaaggcagaguaagaaacagaguacuagauuagggauagggaauugccauuuuggagaaagugauuacaaaaggccucucugaggaggugacaacugaguagaaacaggaaugaaagggaaagcaaaccuagggaggauccaaaggaagcaucaugaugcacaagucauucucuugguugcuuagcaucaaaacaccuucuuguccuuggggaauucccuuccauaugcaucuugaaagaaggcagaaaccucugccuacuacugaauauuugcuuuccuugcuucccauaaggcaaggguacagucauaugaccuccacuccacaagagaagcaucugugcuggaccuuaauguagaagauagugcauuuaaaaagccgagaguguguagaacccuuaguggcaaacguggcagcagauuccaauaacaguagugguagcagcuuccuccugugauaaauuccuuuucuguuaaauuaaccagagauuauuugacuacuuagaacuaagaauucuggcugacccuggugauccagggaaauggaacagcauauguuaagcgcccugagcuacagugaagaaguauaacaggaaaugcaaucauagaaauacaaaugggcuggaucacauagaaccuuauaggcacuagaaagagugaauuuuauugagauuacuagcaaguugucagaaaguuuuaaacaggagaguguugugaugugauuuacauuguuaagaggcuacuccuguuaucauuugguuaauacauaguggaaagcaagaacugaaacaagcguacuaguuagaaaauuauuccaggcaagagcugcuggcaccucaggccuggaugauaccugugugguuauuagacaauuuaccuuuaauugcuauauauuuaaguuaaaucuaacaucauauuuuaugcuuuccauuugucccguucaguuuuuuuuuuuguuuuuuguuuuuuguuuuuuuugaaauagagucucgcucugucgcccaggcuggagugcaguugcaugaucucugcucacugcaaccuccaccuccuggguucaagcgauucucccgucucagucucccaaguagcugggauuacaggcaugcaccaucacacucugcugauuuuuguauuuuuaguagagacgggguuucaccauguugaucaugcuggucucgaacuccugaccucaagcaauccaccugccucggccucccaaagugcugagauuauagguaugagccaccgugcccagcccccuguccaguuucuuuucucuccuuuguuguugcugccuucuuuccccucaauucuuuuuagcauucuauuuauuuccucuacugauuuggaaguuauacccucuguuucuguucuuuuguugguuuucuagaaauuauaccaugcaguaaagucuaaucaaaaucuuuauucucucuuuucccaaaaaaucuauagauuuuaaaagacauaagcaacacaucaacaaaaugcaauauguagacccuguuuggauuccaguuugaagaaaccaaauauaauuuuuuaaaucuuuuuuuagauaauugggaaaaugugaauacuaacuacauaaugcuaagaaauuauugauuuuuuucuguauaugauacugguauuauacuuuaagcccauaucuuuuauaagaacaauauauuuauggguuaaauaaugugauuguuaggacuuacuuuaaaauacuugggauauauauaaaaacacuuuagucaugaauucauaacuguugaagguggguaauaaauacauaaggauucauuauacucuucucuuuuacauauuuaaaauuuuccauaagagguuuuuuuuaaauuacuauccuucuagguaagacaaggaccuuaaauccuagacucuaccuauccuacuuguuauacccuuguuuuuaauccauuagacauuuuuacuauguuuaaugcaauccauauucauuuucauucucuaaauauguaucauuuucuuuaccuuuaauuuacucuucauacauuucauuuugugauuugagaucaauuucauccuguccuaaguauauccuuuaaaaacauacuguccaauauggugcauguggauauuuaauaaaaauuaaguuuauuggcuuaauaacuuauuaauaacuuaauaacuuauuaagccaauaaacuuaaaaauucaguuuauugaauuuucaaguacucaauagcccuauguagcuuaugacuacaauauuggacagcacagaaaaagaacauuuccaggccaaacaugguggcucacaccuacaaucccagcagucuguaggacugaggugggagaaucacuugagcacaggaguuugagccugagcaacacagcgagaccucgucucuacaaauaauuuuaaaaauuagacaggucgagguugugugcaucuguggucccagguacucaggaggcugaggugggaggauugccugagugaucacauuaucauuauauuaucacauuacuucauccauaaauauauuauuuuuagcucagugagccaugauugcaccacacuccagccugggugacagagugagaccugucucaagaaaaaaauaaauaacauucccaauuccacagaaacuuccauugaacacugcugcuuuaaaugaucuuucauaggugagauguucgugacaaguuguuuuuaucugaaaauauccuuauuuuaccaucauucuuuaaauauauuuucacugggcauaaaauucuagauugacagguaguuuucauuccauauaguagacauuucacugucugcugauuuccacuguugcugcugaaaagucaucuagccaggcgugguggcucacgccuguaaugccaacacuuugggaggcugaggcauauggaucaccugaggucaggaguucgagaccagccuggccaacauaguaaaaccccaucucuacuaaaaauacaaaaaauuagcugcauuugguggugggcaccuguaaucucagcuauuagggaggcugaggcaggagaauugcuugaacccagaaggcggagguugcagugagcccagauugcaccauugcacuccagccugggcaacaagagugaaacucgaucucaaaaaaaaaaaaaagaaaaagaaaaaaagaaaagaaaagucaucuauuacucuaauucuugcucguuugaugguuuucuuuuucuccagcuacuuuugguuuucugugacuuuauuacaauguguuuagguguggacuuacuauuauccuaauuaggauucauugaaauucuugaauucugguuugguaucuuuccuugguucuggaaaauaucagccaucaucucuucaaaugucccauucucucuuccuuuccuucuggaauuccaauuaagacucucucacucuauccccauaucucuuacacugucuucuauauuucccaacuuuuugccucuagccaucaucuaugcuacauucuggaugguuuuaucugaucuauauuccaguuugauaauuuuucugauguguccaaucugcugcaaauugcaucauuaaguuuuuaauucaguuacuuuaucuuuuucuuuuuuuccuuuuuuuuuuuuuuuuuuuuuugagacagucucauucugucacccaggcugcagcauggugguacaaccuuggcucacuauaacuuugacuuccuggacucaagugauccucccacaucagccuccggaguagcugggacuacaggugcaugccacuacacccagcuaauuuuuuuguauuuucuguacagacaagguuucaccauguugcccaggcuggccucaaacuccugagucaguuuuuauuccaaaaauucgauuugguuuuuucaaaacuauaaugccacuuaaaaacaaucauuuccuguucccuauucucaaauuugucacuuauuucuguaaacacaguaagcuugguuguuuuauuauauaucuuuuaauucuauuauaugauguuuaucuuuuucugcugucuguuguuucuacugguucaugccuaugguuccuugucuccucguacgucuaguuaucuuugacuaugugcugauuacuguccuuaaaaaauuguggggaggccuaagaugaaggagccuuccuuugaagaacauuugcauuugcuucugacaagcaccuggagucaggaaccaaccuaaauuaaguauggcuuacgguucccuuucccaccuaugcuuuguaaagacuuuuguuugcuuguuuccuuucucuuuuuuccuccugcucugcucaguaccaacacaacuugucuugaaauuccuugauauuugauugggagguaggugaugaaaagcgguuaguucugguucauccuuaccucucagcuguagauauauggagcccaagccuaauuaggcaagaauaucucauaagacuuuacauguccacauguugggugggcucugcaucuuaauuucuguccaccucaccccauaagacugaugaacagaaaccuaaauuucuugauauuggcaaacauauugaaagcaaaaguggcuucaguucgccagauagucuguuaacuuccugcuuuaggcuuucuuccagaauuuggcuuaacagauucccuuuucuucccaguucuucaaagcuacuaagguaauguucuauauauuuuauccaacauuuucaauugucuucaaaaagaagacuggucggccgggugcaguggcucacaccuguaaucccagcacuuugggaggccaaggcggguggaucaugaggucaggaguucaagaucagccuggccaacauggugaaaccccaucucuauuaaaaauacaaaauuagccaggcgugguggcaugcgccuguaaucccagcuacucagaaggcugaggcaggagaaucacuugaacccaagaagcagagguugcagugagccgagaucauggugcugcacuccagccugggugagacagcaagacuccgacucaaaaaaaaaaaaaaaaaaaaaagaagacuggucuaaucuaggccacuauuauccagaaacaagauauauuuggaagugaccuuccugauguacagcugacccuuuaacaacccagauuugaauugcacaguccacucacacacuuuuuuuaauauauuagaaaaugauuuugaggcuuggcaugguggcucacgccuguaaucccagcacuuugggaggccaaggcagguggaucaccugaggucaggagcucaagacaagucuggccaauauggcgaaaacccaucucuauuaaaauaacacaaaaauuagccaggcaugggggcaagugccuguaauucuagcuacucgggaggcugaggcagggagaacugcuugaacccaggaggcagagguugcaguaagccaagaucacaccacugcacuccagcgugggcaacagagcgagacucugucccaaaaaaaaaaaaaaaaaaauuauuuugagaucuuugacaauuaaaaaaaaccucacaagccuagguacagugucucacaccuguaaucccagcacuucaggaagccgaggcaggcggauugcuuaagcccaggagcuuaagacuccaucucuacaaaaaaauuuaaaaaaauuuuuuuaauuagccaggcaugguggcacacagcuguggucccagcuacucaggaggcugaagaaggaggaucacuugagcccaggaggucaaaguugcagugagccauguucaugccacugcacuccauccugggcaacagaacaagacacugucucaaaagcaaaacucacaaacugcauauuuaaaaacuuaagaaaaaguuagguaugucaagaaugcauaaaauauauaucgauauuggucuauuuuaugguuuacuaccauuaaauauacacaaaucuauuauaagaaguuaaauguagccaggcauggugguacaugacugagaggaugaggcagggggaucucuuaagcucaggagcuucaggccagccaggcaugguggugugugccuguagucccagcuacucaggaagcugaagugggaggaucacuugagcccaagagguugaggcugcagggggccaugaucgcaccacugcacuccagccuggacaaaagagugagaccuugccucaaaaagaaaaaauuacauguauauguguguguauauauauauauauauauauauauauauauauauauauauauauauauauauaauaugaagaggucagagcccauccaaaacucuagcccagcccaauccagcauuucucaauuuguguuucccaaagcuccagacuucaguagcaagaaggacaguggcuaaagagguaagcacacguuggaggugacagaacagcaaguuucagacccuuuucacucucacauaaacaagaccaccuccaacuguuaugagauucuguaauauuauuuguaauuuuuaaagcauuuuuugaaagacuaagccagcaauaaaagaaucuuaaaaaguaaacuuuuacuaguaaacucucuucucuucagacauaaaugguuaaaaguuuugaaucucaagcaaaaaguacuggcugagugcagugguucacgccuguaguaaucccagcacuuugggaggcugaggcaagcagaucacuugagcucaggaguucaagaccagccuggacaacaugaaggaaccucaucuccaccaaaaaauacaaaaaauuagccaggugugguggugcgaucauguggucccagcuacuugggaggcugaagugagaggaucaccagagcccaagaaguagaggccugcagugagcugagauugccccacugcacuccagccugggugucagagacagaccccgucucaacugaaaaagaaaaaaaaagaauuacuuaguucuuuuucauuacuguuccauacccaaauccuuacuaacuuaaauccagaaaaaaacuacuacauuuauuugcaaguaugugcuuuaucugugcuccucuuuuacuuaauuuuagacucuggccaaauaaaacucagguaaaaguaguauggauaaaugagaaccucaaaaaucagauucugaaauauaauucauucaaaaaaaaauuuaaacucuaaauuauauagcaaaagcuuaguuuuuuugguuuuuguguuuugagacagagucucacucuguggcccaggauguaauguaguggugagaucuuggcucacugcaaccucugccucccagguucaagugauucuccugccucagccucccgaguagcugggauuacaggcacgugccaccacacccagcuaauuuuuguauuuuuaguacagacgggguuucaccauguuggucaggcuggucucgaacuccuaaccucaggcgaucugcccaccucgaccucccaaagugcugggauuacagguaugagccaccacacccggccaagagcuuguuuuaaguagcacccaacauguuaugacuccuugucuccauuagguuaaacuucuuugucuuauauacaguuacucccaaacauacuacauaaaaaaauauuucugugcuguuauaaacuucccuaaacuucaaagagauuuguuuuuguuucagagcucugucucccaggcuggaguguaguggugcaaugucagcucacugcaaccuacaccuccugggcucaagagauccucccaccucagccucccgaguagcuggggcuacaggcaaacaccaccaugcccaacuaauuuuucuauuuuuuguagagacggggcuucaccauguuacacaggcuggucuugaacuccuggacuuaagugauccacccgggccuugaaaagugccaggauuacaggcgugagccaccacacccggccuaaaccuccguuuuaaauauuacaguauaagcuaucuaccacgaucacuuccuuauucaaaucuauuuuuguuucuuugaauuucagacaucaaaagaugucauuaaauuggaaccauaggccaaacacaguggcucaugucucacuuugggaggccaaggcgggcagaucaccugaggucuggaguucaagaccagccuagccaacauagugaaaccccaucucuacuaaaaacacaaaaauuaaccagcagcugguugugguguuucccaccuguaaucccagcacuuugggaggccaagacgggcagaucacucaggugacccugaccucagggucaggaguucgaaaccagucuggucaacauggugaaacccugucuguacuaaaaauacaaaacuagccaggcaugguggugcgugccuguagucccaguuacucaggaggcugaggugggagcacugcuugagccugguaggcagagguugcagugagccaagaucacacugcugcacuccagucugggcaacaaagugagacuccaucucaaaaaacaaaaaaacaaauaaauaaccaguaauuaaccagguaugguggaaggcaccuguaaucccagcuaucugguaggcugaggcgggagaaucacuugaaccugggaagcagagguugcagugagucaagacugugccacugcacuccagccugggcaacagaguaagacuccaccuuggaaaaaaaaaaaaaaacuucuugaaaccauguuaauaaauaaaauucuuacuuuccaccuaagcuauauauuuaucagauauacauucucuauuucucuaucuacauucuaucugugcuuaucagugucccuauuaugacuauaaaauuagucauaauuuucuaaaaauuaacucagaauauaaaugucuacagauaaaaaauauuuauugaugacuacuuaauauucauguuuaagauaagcucgaaaguuccauaucuaaaguacauaaauuauacccauacacacuaaacuaagaaguaguaaggauuugucaguuagcauguccagaacuucccaggcacaugacaaaaccuaaucuuccuucugcauuaccugauaauauuaucacccucuuuacuucccaauuuagaaaucugggaguuaucuuccacucuucccucugccucaucuucuauacacagcuggucucaauguuuguguccccacaaaauuaacauguugaaauccuaaccccaaggugaugguauuaguagauggggacuuugagugaugauuagcucaugagggcaaaccuuaucauuccauucauaauuucauggauggaauuauugccagauaacugcuuugucccuucaccauaugagggcacagcaagguggcuccaucuauaaagcaggaaaugggcccucaccagccauggaaucugccaccaccuugaucuugaacuucccagcguccagaacucugagaaauaaauuucuauuguuuauaagucacuaguuuauauuuuguuauaguaccccaaauggacuaagacaguuggucaaguucuaugaagucuucuucacauauuuuuccuuuuucaauaggcaauacuuucauauagcucaaaagcccaaacacagaaauguauacauugaaaauccucaauggaaguauuuacacugcucacugcuccuccuuggcccacccuggacccacaaccccaacaaguuauuaccuuuacuaguuucaugaguauccuuccaguauuucuauaaucaccaaaaaaaaaaaaaaaaaaaaaaaacauuaccacauaacacugcucuccacuugcuuuucuugcuuaacacaugagaucuuuuccuauuaguucacagaaagaacuuccucauuuuuuuauacagcugcauaguaugcuauuauuguguuuuaauaugcauuucucaaacuccuaaugagaccaugcaucuuuaucaaauguuuguuggccacuauguuuccucuuccgaaacugccuauucauauucuuuaccuauuuuaccauuucauucucuuuguaggagugcaauauguauauuucugguuuauuacauaugguuuauuaccauauguaauauuacauauuacauaugguuuauuaccauauguaauauuacauauuacauaugguuuauuaccauauguaauauuacauauuacauaugguuuauuaccauauguaauauuacauauuacauaugguuuauuacauauuacauaugguuuauuacauacuccucucagucuguuuuaaauuuguauauauuuuuuucuuuaaaauuuguauauuuuaaauguuaauguugucauaaagucuuaaauugugguuuggccaaauuuaucaaaauaucuuuccaaaaugaauauagauauaauuaugcauuccaaucaccuacagaauacaguggcacugaccauauguauauuuaacuugaaaaugauuuaggccaggcacgguggcucacaccuguaaucccagcacuuugggaggccaaagcagguggaucaccugaggucggaguucgagacgagccugaccaacauggagaaaccccgucucuacuaaaaauacaaaauuagccaggcauggcggugcaugccuguaauuccagcuaccccgggaggcugaggcaggagaaucacuugaaccugggaggugaagguugcagugagccgagaucgcgccauugcacuccagccugggcaacaagagugaaaccccaucucaaaaaaaaaaagaaaaugauuuaaacaguuggcuacucaccauucuacuuaauaaacauaagucccagcaugagccugaaauaugaaucuauuuccucaguaggucucaguucucaaaugcaucuuauggaaugaacuucucauugcaauggauaaguuaacguuuuauaagauuuuauuuuguacaacauagcccacaaauguaaaccgucuuccucuagggcacaauugaggaaacagugauauauuucaucacuagaggaaaaacugacuguuuuggaauuauugagagaugguaccuuacuucccaaauggcaacuuccuacaaguuaauucugacuauacaguauuuuccccuaauaugcauaaucauuaaauaagugguaacuccaacgcgucucagaccuuuaaggauaugaccugugccucacugcagccucaucacucaccacuuaccccuuggauuuauauuuuaauacaggguuauuuacaauacccucaugugcuauucugucucaugauucuacuccuuuauauguuauccagccuaagacgucuuccccucccgaacuuaccuaaguaguccuauucucccuccaaacgcaguucagacauuaccuccuccgauaaguuucccuugaccucagcaaaaugaauuaaucacuucuuuauucucucauuguggccuuaacacacuuccauuauuagauagauuccaucacauuacaaaugauuuauuuauaagcuuuccucucccauaagccuuaggaauucagacaaggauugaucucuuuuuuuuuuuuaacccuuauaggaguaaaggcuaaugguuuaucuuauucuuauguguauuuuaguaucuagcagcuucuaauauaccacucaacagauguuugcuaaauuaaacaaguccuuucuauucagcauuauuauaaacacuguaaaccuacacacaaaaauuaaaggcaagaucuuuaaccaaaaauauuucacaaacugaaaaaauuuguagauuauaacaaaaguaguuuguaguucaguguuuuguuuaaguggguauagacaccauagaucagugcucuucaaacuguuggucaugaccuauuaacagacugugaaaucacuuuaguagguuaaagccaauguuuuugaaaauaucagcauauaucaaauguaguuaucacacaugcacauaguaacauauauagauaauuaccauguaagauauauuuuuuauugggagucagaauaaacaaucaucugagagcuacuucuauaguuguuagauagguuucaagguuuauauuaacaaguuguaguagucaaagaaggccucuucaaugaaggacuuaacauuuguuuuuguuuguuuguuuguuuguuuugagauggagucucgcucugucgcccaggcuggagugcaguggcacgaucuuggcucacugcaaguccgccucccggguucacgccauucuccugccucagcgucccgaguagcugggacuacaggcgcccaccaccacacccggcuaauuuuuuguauuuuuaguagagacgggguuucaccauguuagccaggauggucucgaucuccugacuucgugauccacccgccucggccucccaaagugcugggauuacaggcgugagccaccgugccccgcaggacuuaacauuugaagcauaaucugucuccccaucaucucuucucagcucaucuaucaaucuccccaucaucucuucucagcucaucuaucaaucuccccaucaucucuucucagcucaucuaucauucucccccuuagucacugugcucuagccacaaaagucagcaauucuuugaacaaggcaaauguguucgcacuuuagggucuagcacaaguugguucugcugucuagaacucuucacuuagauacuguauggcuugcuccugcacucuaggacacccagggagcagcuuucccagaccaccuaagauagcuaccacaucccaccaaucuauccccucaccucuuuuuuuuuuagauggagucucgcucugucaccaggcuggaggugcaguggugccaucucggcucacugcagccuccaccucccagguucaagcgauucuccugccucagccucccgaguggcugggacuacaggcacacaccaccacgccuagcuaguuuuuguauuuuuaguagagaugagguuucaccaugucggccaggauggucuugaucuccugaccucaugaucugcccgccucggccucccaaagugcugggauuacaggcaugagccaccacaccuggccaaucaaauguaguuaccacacaugcacauaguaacauauauaauuaccauguaagauauauuuuuuauuggaagucagaauaaacaaucaucuuuuauuaccuacuuuuauuccuuuucauuuuacucauuaccaccuaacaucacguauuuguuuacuaugugucccuccccacaaacgucagcuccaagaaaacgggacuuugucuucucuuuuguucauuacuauaacaucagagauuagaacagugccagccgcagggcaaacaucccugaguaggcucugacaggcaaggaaaggaagaaugcauggaguugugcuuaagcaagguauauuacagaguaaacaccagcuugauaauguuaaacaguaaggaauaaggcugaagaagaauauaaaaagguuugaaagucagaaaguagaauuuggacuuuaucuuguaaacaacugggagucauucaaauuuuugagcaaauggugacccuuucaaacauuuauucagcaagguucaauucacuuuguuugacagaauagacagugcaaaggucaauagcacauguucucuccucaggcuuauauguuuagcaauggguucaaaauauuuucaggaaaaucauucuggcagccauaugcaaaaaggaugcaaggaaggaaaaucuaaaguuuaaaggaagcaaauaauaggcaaugcagaauuccaagacaaacugggagccaauaaagaguaaaaaacugugcucacgccuguaacgccugcacuuugggaggccgaggagggcggcaccugagguugggaguuugagaccagccugaccaacauggagaaaucccaucucuacuaaaaauacaaaauuagccaggcaugguggugcacgccugaaaucccagcuacucaggaggcugaggcaggacaaucgcuugaaccuaggaggcagagguugcagugagccaagauugcgccauugcacuccagcuugggcaacaagaaugaaacuccgucucaaaaaaacaaaaaauaauaaauaaauaaagcaaaaguaugcaucgcagacuacuucaaaauuuaaguaugauaaaauuaaaagaaauggugaaagcaggugagaggcugaauaauaauaaaucuaaaagugauggaaauuccuugagcguuccaacagaaauauccaguaaacuacuggagcaucaaacauggaugggacacacauuugggagucaucagcauauaaaacaucuaagaggggaauaaucaaguacugaugagacuaacagugcuaagaggcucaugaaacaacaaagaaaacagaauagucagaagggaaaaccaggauggcaaacuaacacaaacggcaaggagagaacauuaaaaagccucaguggaaauaguaacacauauauacuagcugaaaagagucaggaugaagccaauauuauugacaaaaaagauguccucugaagcgacaaucugaauuaugcuauuccaaaacugcguaaguuaggaaaguaguaguaaaagaacucaggaguugacuagccuggccaacacagugagaccuugucucuaccaggaaaauacaaaaauuagccaggcauggugacacaugcguguagucccagcuacucgggaaacugagguaggaggaucaccugagccuggggaggucaaggcugcagugagcugcaauuguacuccagccugggcaacacagugagacccugucuucgaaaaaaaaguaaaaacucacggcagcaauuguaauucaauucuuaaaauuuuugaaaugaagagaaaugcagcagauagcuagaaagaacaguagcagcaguucaucaaaauugauuuuuuuuccucccaaaguacagaugucuguacauuuuuuuuuguuuuuuuuuuagauggagucucgcucugucgccuagucuggagugcaguggugcgaucucggcucacugcaagcuccgccucccggguacacgccauucuccugccucagccucccgaguagcuggaacuacaggcgcucgccaccacgcccagcuaauuuuuuuuauuuuuaguagagacgggguuucacuguguuagccaggaucgucucgaucuccugaccucgugauccacccgcccuggccucccaaagugcuggguuuacaggcaugagccaccacgcccggugagaagucuguacauauuuuaagguagggaagaaaaaacauugcaaauaacaaucaaagugaccagagagguaaaguuaacuguggcagcaggauucuucuuccguucaauuuacaaaauaagaugaaagaacagugauuugucaugguuacaaugaaaaaaaaaugugcaagcuuguacccuguuuuccuuuuucacuuauauagaaguaaauggcaucuauuaagaguuaaagaggaagaaggaauaugagacaacagaaaaaugcaauuaauaagaugauugccaagaaguaggaggggccuauuuggaauuguucagcguaaauuuauaguggccaagaaaucuucauaauuacucaccuuccuccacaaauaugcugugaccugugagggaaaacagaagaaaucgaugguggaaaaaucugacaacaggaguccaguaaaauauaaaauaagugauugaugucaaagugcagacuguaucuagugcauacaggaguuaagcuaaacgucucagacuguuuggguugcuguaacaaaauaccauaaacuggguagcuuacaaacaacagaaaguuuuuuuuuuuuuuuuuuuguagagaugggagucucacuauggugccaaggcugguagugaaccaccucacccagcccaggaggcugagaaguccaaaauaaggcacuggcagauucaguaucugguaagggccagcuucuagacaucugucuuuuugcuguaaccucauguggaagaaagagcuaacaagcugucuggagucuuuuuuuuuuuuuuugagacagagucucacucugucgcccaggcuggagugcaguggcgccaucucggcucacugcaaccuccgccccccccagguucaagcgauucuccugccuccaccuccugaguagcugggauuacaggcaccugccacugugcccggcuaauuuuuguauuuuuaguagagaugggguuucaccaucuuggccaaacuggucuuguacuccugaccuccugauccacccaccucagccucccaaagugcugggauuacaagcaugacccacugcacccggucuggagucucuuuuuuaagagcacuaaucccacuccugagggcucuacccaccugagcuaaucaccucccaaaggccccaucuccuaaugccaucaucuuggagguuaagauuucaacaugaauuauggggagacacaagcuuuuagaccauagcacuuagggcaagaaacugagggucacuaugaauggaacaaguaaaggaacacaggaagaauaaucacauuggcaaagaucacagaguucacacaagucauuuagggcacaaaggaaauuuuuuagaucauucacuuacacaccauacaaauuuuuuuuauuuuuuauuauuaaaaauaauaauaaauauggaacacaucauaaauuuaugugucauccuugugcagggaccaugaaaaucuucucugcaucguuccaauuuuaguauaugugcugcugaagcaagcacuauacuacuaauuauuuuuuccucuguuuggauacaugggaagugcuguggaaauaaaggauuccaggagucagaaggggcuauacauccaaaaccguuaucauaaugagaagaauugaccuaauuccaaaguucaguacuguaauuuuacaaccaccucagucucuacaugcacagaaugggugcauuaaagacagguaucacagugucaucuacccaccuccuuuaaagaaucacuacuauaggcugggcgcaguggcuuauaccuguaaucucagcacuuugggaggccaaggugggcagaucacuugaagucagaaguuggagaccagccuagccaacauggcuaaaccccgucucuacuaaaaauacaaaaauuagcugggcaugguggcgggcaccuguaacugcagcuacuugggagaaucacuugaacccgggaggcagagguuacagugagccuagaucacaccacugcacuccagccugggugacagagugaaacuccaucuggaaaaaaaaaaaaagaaucacuacuauaguaaaccaccauaguaaaaguaucuuaucccucaaguguaaugagacauaaacaagcuaauuggguuauaggaaugcucaagccucuuucagaaaaagauucuacauuauguaauauaaucacagcauuaguggguuuaagauauucuuuaaaauagaaucacagucaggaccaacaggaguaguuuuuuaaauuuuuuuuggagacagaaucuugcucugucacccaggcugcaguacaguggcacaaucuccgcucacuacaaccuccgccucccagacuaaaggaauacucccaccucggccucccgaguagccgagacacaagcacacaccacgucuggcuaauuuuuguauuuuuaguagggacggcguuucaccauguuggccaggcuggucucgaauucuugaccucaagugauccgcccgccucggccucccaaagugcugggauuacaggcaugagacacugagcccggccauuuuuuuuuuuuuaaacuuugaaacuuuuuggcugggcacaguggcucacaccuguaauugcugcacuuugggaggccgaggcaggcagaucacaaggucaagagaucaagaccauccugaccaacauggugaaaccacguuucuacuaaaaaugcaaaaauuagcugggcgucguggcgcgcaccuguagucccagcuacucgggaggcugaggcagaagaaucgcuugaacccaggaggcgcagauugcacugagcuaagaucgugccacugcauuccagcuuggcgacagagugagacuccaucucaaaaaaaaaauuuuuuuuaaaucauaguaucaguaugcugaguauuuuuuaaaucaaaggagauggagguggacauuuuccauuauuucauuuuaauugacuuuaauuuaccaugcacuauaaaacuauaaaauaccaugaaaagauguuuuaauauuauaaaauaggacucaaaauuaauauuuuauagguuccuuaucuucaauuccaaaaauccaaaaaacuucugaaacccaaaauaacucaucuugugguaaaccuuacccaaacugauaugaagcuauuuacagucuuuauccuauuuagugcgaacauucauacauuuuguugcagaaacaguaacacuuuugaagggggauauugcacuggacucuauuggaaggcuacacauuacuaccuugcccauauaaaaaaaaaauuccuaauuccauaaccuauuagacccuaagaguuugaaugguggacugugauccuauaauugcuaacauuuauugagcuauuaacuguuauguuucagguacuguucuguucacuuuauaugaaauaacauuuaaucuuuccaaucaucaugagcuaaguauuauaauaauccacauuuuacaaagaaggaaacugagccacggagagauuaaguaaacugccuaaaaucacacagcuagaguaugacuaacugggaugacacugggaugaauauuuaaaauauuacacauaagaguaacaacacacaacaaaauaauugauuaugguagggugguaggagugauauguuucucuacucaauugauauuacuucuagaauaaggaaucaaacaaaaaauuacaaaacacuacaugcauuuacaaauucucauguacaauuucuacaaacuugcuuaaaaugcagaguauaaaacccaaauuucucagcuuaugcuaacacauuuaauuuuuuauugaaaaguuacaucuuaauaucuuaauuacaacaugauagauaauuuauauucauuguagaaguuagaaaauuuggauaagcaaaaagaaaacaaucaccuguaaaacuacacucagaaauaaccauuuaacaauuuggcacauauccuuccagacauaauauauuuuuggguuuuuuuaccaaaauggaaucauguuuuuaaauuuauuuuuucucacuuacauauaccaagacauccuuucaugucuuuauauuauucuaucaucauuuucauggcugagaaggcaguaccccacuguagggauggacccuaacaaucacugugaaacauuuagguuguuuacaauuuuaccauauaaugaucaauaguacuggcucuagagucacacugguuggauucaaguccuggcccuaacacuuaacuaacucagguaccuugagcaagcaaccucauuucucuaugccuguuuuuucuucugaaaagcagaaauaguacuacccacuucauaugauuaccguggggcuuaaaggcauuaauacacagcuuuuauaaucaacaauacugcaucuaguaugcucacaauuaaauauucacacacaucuuuacuacaucaaaaaaaaaauucuuuaaagggaauuuccaugucagaagguaugccaauuuuuaaagcugcugaaucuaccaaauuacagugugguuuaaagcccuucauuaaauagccuucucacuuaauacucauuucucuuuauccaggaaggcaaaaacuauuaucaaguuaaccaguuuguuucacucaauuagcuuuuuguucuuccaccuguaaaccucggcauauuuaauaaaaccucaaaguuuauagguaacuugaagacaccuagcucaaauucuccuucaguacgauuccucuacucuagaauccccaauuugucagugaacaggaacagccuaccacccaaaacaacucauucuauuuucacaauuuugaggaaauuuaucuugaaagagaauugaaaucugcuucuuuuaaacuuccacccacugacccuaguuccuucuggucaagucaaaucugauccuucugcaugacagaacuccaaauccuuaaaaguggcuguuacuucuuaaaagaagcuccucuucuuuaggucaaacaucccauuuuuucaacuuuuucucauuuccauuucucucaugaucaagguccucguuuaugcucuacagauaagugauuuugacacuuaggugucuaccaccuuggaaaugagaaaaauuaagguccguuccuacccuacuuaaguuugggccucuguguggcuuuuuauuagcucuccagaugauucugauaaagucugagaaugaauacaaggucucacuuaugauaguaugcuacccaaaaagccaacacaauaccccaaauauaauauaacuaguacacaguaaaguggggcuaacaccuugcucugucaauaagcuguucuaccaacuucagaauuauucacagauggguguguuggcugacgccuauaaucccaacacuugggaggccaaggugggaggaucacuugaguccagaaguuugagaccagccugggcaacacagugagaucucgucucuacaaaaaauuaaaaaauuagccagacauguuggcagguaccuguagucccaacuacucaggaggcugaggcagaggcaggaucgcucgagccugaaagguggagcuugcagugaaguauaaucgcaccacugcacuaagccuggguaacagagaaagcaagacccugucaaagaaagaagaggugcaaaggggaaaacagggagggaaggagagagagggagagggacagagggagaaggagagaggaaagagggagggagggagggagggagggagggagacagaaaggugcacuagcccaccaacugaacugacagcugauugcaccaaagcaucuucuuuguauagagcacugugaugucaacacugagaaaaaacacaggcccuaauacugaucucaucuagugcuagauuuaccuucuagaaagcaugauggaacaaacaucuucagaaaacuauaauacuaauuguagcuaucccaauguaggcacaucagagcuauagaaacauugugauuacuagcuggaaaccauacuaguuguuggggaggagaggggagcagagggaugacacuaaggaaacuaaguugcucucaacuucaagauuuuguguggguuuguuuuucaacguuugcaaagucagaagagauggaggccaucagugaguucaucugaacucaggcuacuugcaaacagagacuggguaacugccucgugcacccucaaaaauaaauucaugaugcaaaacuucauguaauuucugaauuucugaauuccucaugacgugcacuuuaccuguuaccuguuaauauuucugguacugaggggcaaaagaaaaaaguaaaaaaaaauucaugguacaggagaugugguccauuacaaugacacaauguuaugggaaaaaacacacuaaaaccaagcauacuuuuuuuuuuuuuuuugagacagaguuucgcuccuguugcccaagcuggaaugcaauggcgcuaucuuggcuuauugcaaccuuugccucucuggcucaagcgauucuccugccucagccucccgaguagcugggauuacaagcgcgcaccaccacgcccagcuaauuuuuuguauuuuuaguagaaaugggguuucaccgcguuagccaggcuggucucaaacucuugaccucaggugaucggcccgccuccaccuccccaagugcugggacugcaggcgugagccacugugccuggccaaaccaagugaacuuaaccaagauccaaucuauuuucguuugaacagcaaacauuaaaaguacaccugguauuuucuaacaauuacacgaagaaugaccagaugcuuccuguugauggaacaguagagaacuauagacugacagauucagacuacaguucacagaaacaacuggaaacaaacuuagcuuccuuucaaagccauuaaaauacggccuuaaauuuuuaugcauuaaucaauuaaguauaauugucucccaauaaguauaauugucucccaaccuagaaaacccagaaugauucagagagacaaagaacucuaaggauaugucucugcaaacuguucguuucaccaaaggauucacugcagaauuaauuuucuguaaaaucuguaccuccuauaauuuucaacauguucuaucuuuaaagauaacauuuacacaaguguugauagcauauguggaauucacguguuacuuguguaaaucauuauaaauauguaauagaauuaaauguuuuaaucacuuaagaauaucuucgaauguuccugagucuccgagaucauaggcagauuaugcagucuucaucugugauuuuguuuagucaccuaaauuccaacuuuuaaaaaaguuagagcccaguaaaaaaaguaugggaaucaaucuuauucagucuuguuaaaaugugucuugcauaacagcuugauuugacuuguauggugaaagcacgguaagaaugacacauuucuguuuuuugguuuuuuuuuuaaaaaaguaugaguguacaguggaguguuccagagguuacauggugugcuaaccacaacagucugacguagaucugagaaucuucuauuaaaccaggcauuaaaaagauuugcaaaaaugcaagaugucacucuuaucaucuauguuaacauguaauggauuuauuuuuuguuuuuggaaaaaaaaaaccaagagaaaagaaaauaaagucaucuuuaguuuccuuaaauucaaagucugagccugaaaauggaaguaucaaagcugaugguuauacgucagugagaaaaaaauuuaaaccaagcugggugggucuuuacaugagauaaacuaucuacaggaaagaaugaccacuaacuucugcauaauaaaugagaguggaucuuuuaauucugagauggcaauguacuuuacaaggaccauuuacagacuacaucaaaccuuuuucuagauaaaaaacguacuucaguaacuugccugaauugagagagcaaaacaguccggagagaaaacuuaaaauguuuccacauuaucaagcccccuucagaaguacuguggucucggccccuccuuugaacagauguccgcucgccacaguccaaucagguuuaaagcaagaguauuuguacugaaaacaagcuuaaagugggaagacacacacaaagcaggccuguaucauuccuuugguuucaguuuucacgaugcacccuugaggcuaggcacgcugauucaacacacuuggagagcuucaccgaaacacacuaaacacacagugaugaacugugcccuggcagagaugaccuggcaaaauucucaacuucuucccugaggcagugcacccgcaguucucggcggcgaagucuuuggggcagaagucccgagccuucagaacggcaggcuucucccccucaggacuccaguccccgcggccaaggcugucgcugcgggggccccgcgcgggacuggccaggcucuuccauuaacccugucugguccggccgaucccgccgcgacccgagcgccucucggccccgcagcacagggcgcccaggacccgccacccucgccgcccguuccccucuccggagagcccggcggggccgucaggcugccgagacaaaggguaccgcggcgccagaggccgaggcccagccgcgccugccuuccucuuucucccgcccacugccaaccuccagucgcccgcagaaccuccgcugccucggcgcgaccccaucgccaccccggggcugccgcucgggaccggcaagccggguagccgcgaggcggccgcggcaugcuagggccgaggagggggcggcggccgccaccaugucugcccgccccucccagaagcagugugcccagcggacaaagcgcagcggcggcgcgggcgcccaggccgaccccgccgacccccgcggaauaagcggggccaggagccccggaaacccggcgccuuaaugcaauaaacaggaaaucgcggggaugaucuggguuccgggggaaguggaauuauuuuuuaccagcgaagagaucaacuuccacauccggugguaacagggcccuacacagacccgcacugaccuggaaaagcuucgggagcggcgacgggaaggcagcaggagguggugcggggacccgaggcgccucguacccggccgggcugacgcggccccgcuacacacaaagcgcuucagcugcacagggcgcuauuuuccgaaaaugccgcgucuggucggcgcccaaaauccccaccgaaaagucccccgugcugcgcgcggagggacacauggugugcgagugagucaagcucccagcaucccucccggacccggcccucuucagcucaucgcccgaggauuuuccgccucugcccucgucggcagauccugcuccuacccacucccuagcuguguucccgcggggagagaggggaaagagggucugauuuuuuaacgaagggaaagaaaauaugccauuucuagcgcuucagccacacaaagaaagc

SEQ ID NO: 191234 - RNA, 76699 nt, Homo sapiens
aaugcaaaucgggaaaagggggugagcugggcuggcuuccguccugguagccaaggcuaauucucccucgaguucuugggagaugggcauuuggcgagaaggcuggcguuagugaagcgcgcccggcgucacggugagugcgggucuugggcccuagcaccuguucucugggaagucguccgcugugaacgaugaacgccuuuccuuccaccagcugcugguuaccccggagacaagcucuguccgcggagaggagugggacaacuccuaaagguagaaucagcuuguggagaggaaaggcccaaccuugagucuuuuacgccaucuaccuaggauugccaagcgaguuucguguguuuuuuugguuuuaaaagguggcuuugaccaaucuuccguucucuuggacacuuauacccgacuuugaccucuuuccucuugcuuccgguuuuuuuuuuuuucugcaaucugccuacaaucccaggccuuacuguagcuccuaaaacuguuucccaguuucucuucuuccccagucacacuugauuuuagugaaguuugaguuuaaagacccuauaagcuugucagaguuaaaacuaugacuuccucaaauagaagauuuuuuuuuuuuccccuaaaaagugccuuccauccuagaguugugggacaaguuaauuucaccgccacuccaccuuggaaauuaucagaauccuuacuagcagugaugugcauuauaaagcugcagaccacccuccuggguuuauuucuugccuccaguucauucugugaccuugaacaagucacuuaaucacuaacaaaaaauuuaccugacacggagguguugcagagccuaaggaauuuaguauuuguuaagagaccugaggguuucagaugaaagggauuuauaucuaaaggauguuaccuuuucugaaucugcaaagcaucguuaguuuuguaaauaucuugcugcagccauuaaaaaugccaagugguauuuguuaaggaaguauuccuguuuuaggcuugcucugcugcggcuuugcuauguaagcagauuuuugcauuucagccgauucuguuuaagauucguuggugaaugucauucaugauggauuuggguaguuucuccuuacagcauaucccuggacuauuaagcauaucuggaaggugauaucgguuguguuaugucuuuaucauguugauauggcugcuuugaaauauguauuccuuuucuugugacacauuggaugcaucuuuaauauuagugaagacccuguaguaguuuaaaaaaaaaauacaccucucauuaaugaaauuuugcacauagacaucuguuuuuuuaagaaaacaauguauaagaaaaacuaacaaaaauguuuuaaaggugccuuuuuuagcauuucguuuuuuaauauauuuacuuggacuuuaaucuuuaugggcauuuguuuauuaauguggacguggcugggcgcaguggcucacaucuguaauccuagcacuuugggaggcggaggugggcggaucacugaggucaggaguucgagaucagccuggccaacauggcgaaacccggucucuacuaaaaauacaaaauuagcugggcgugguggugcacgccuguagucccagcuacucuggaggcugaggcaggagaaucgcuugaaccuggaaagcgaagguugcagugagccgagauugcgucauugcacuccagccugggugacaagagcaaaacuccgucucaaaaaauaaaaaauaaaaagcguggacauaauggaaaauaaucaaaaugacuuuuggguaagacaguuggaaaauaaagccaguacauuaaauuuuuuucauaagucuagcacuauauuacgaacuuuucuccaugaaaaugcacucauauuuauggaagugaaaggaaaaaaaugucuucagguauguguugcuaauaaaauuagauauaauuaaggaaacauuuaaaaaauaccuuguuguugucccaguuaccuauugcugcauaacaaaucacuccaaaacauagugacuuaaaacuguaauuuaguaucucuccuguuucucuggccugccuggacuuagcuaagugguuuucaccuagaguuuaaugcguuuguauucagauaagcagcugaguuuggagucaaccgagagcucagcuggucuggacauccaaaauggcuaauucacgugaaggcguuugauguuggcuaggaguucagcuggaaaugucaacuggaaugcccacacauagccucuucacgugacuugaacaguauggcggcuagguuccgagaauacauguuugaggagucaggaaguagaagcugccagucucccaaaaagccugagcccagaaauucgcacaacauuacuuccaacauacucuguugguuagagcaaagaccagcguacaacccucaccuuugaaaggaaaaaugucaaagaauuuguggccgugcuuugccuacuauaauuuugaugacaaaguuguauuggacucuuguuugcauuuauauagcagaugaagaaucagguacacuuccaauuuccaguuucuuucuuucuucuucuucuuuuuuuuuuuuugagauggagucuugcucuguugucagccuggagugcaguguacgaucucagcucacugcaaccucugccuccuggguucacgccauucuccugccucagccucccgaguagcaugucaccaagcccagcuaauuuuuguauuuuuaguagagaugggguuucaccauguuggccaggaugaucuugaucucuugaccugugauccaccugccucaaccuccgaaagugcuggaauuacaggcgugagccaccgcgccugacccauuuccaauuucuuuaaccguaauacuuuauguuguaauggcauauuacaguuuucaaagcauguuuuuguauauuuuuucacuugauaccuauggucacccuauagaagcagacaaauaguuccuauuucauuuugcagaugaaaguaaacugaagagugguggugguauugggagugauuuacggaauuuguucaaagucauaugauuaauaaauggaaaguaaggccugcaacaguuccauaauauuaaauuuauuaguacugaaugaugaaauauuauauuaaacuuauuuggaauucuacauuuauagccguacuaauuuuuuuuuuuuuuuuuuuuuugagacggagucuugcucugucuucuaggcuggagugcaguggugaguucucggcucacugaaauguccgccuccuggguuuaagcaauucugcuucagccucccgaguagcugggacuauaggcaccugccaccaugcccggcuaauuuuuguauuuuaguagagaugggguuuugccauguuggccaggcuggucuugaacuccugaccucaggugaucugcccgccucagccucccaaagugcugggauuauagccgugagccaccauaccuggcccuuuuuuuuuuuaaacugagacaaggucuugcucugucacccaggcuggagugcaguggcaugaccuuggcucacuguaaccucugcuuccugggcucaagugauccuccugccucagccucccaaguagcuaggacugcaggcacacgccagcacaccugacuaauaccauacuaauucaaguaaaacaguucucauguauagugaauaaggguuaacuaagccuugucucuuuugacuaacacauuacaauuuaguuuuuuguuuguuuguuuuugagagggagucuugcucugucaccuaggcuggaugcaguggcaugaucucggcucacugcacccuccgucugauggguucaagcaauucuccugccucagccucccaaguagcugggaucacaggcauaugccgccacgcccagcuaauuuuuuguguuuuaguagagaugggguuucacuguguugcccaggcuggucacgaacuccugagcucaggcaauccaccugccucggccucccaaagugcugggauuacaggcguuagcuaccacgccgggccuacaauuuaguuuuuaauaaugcagcagucuuccucuuaucugcaggggauauguuucaagaccuccaaugaaugccugaaaccacagauaguacugaacccuauauauacuauguuuucccuauauauacauuuuuaugauaaaguuuaacuuauaaauuaguaacaagagauuaacaacaauaacuaauaauaaaauagaauaauuacaacaauauaguguaauaaaaguuaugcccuguggccauaacuugugcaacuugaggugugacagcaaaacuagcacaaauuucuuuuuccuucauaauuuugcagauaaaagaucuuaccauagaucuuagcaaccucagcaugagguuuuugguuuuuuuucuuauuagguugagaacuuucaccuuuuugcuuaaaggaagcaguuuacaacuucuuuuugacauacgugaaucucugcuuuuacacuuugaagccaugauuaaguaaaaugaggguuacuugaacacaagcacuguaauacugcuauagucagucugguaacugagacggccacuuagugauuaacaggcagguagcaucuacaguguggauacacuggacaaagggaugauucaugucacagacugggcgaagugagguggugcacaauuuaaaacuuaugaauuguuuauuucuggaauuuuuuauuuaauauucuuggacugugguugacugcaaguagcugaaaccauggaaagcgaaaccauggauaaggggggacuacuacacuaaauucugaaacauaccaauaaugguguaaacccacaugucuuuuuaauagaguaaaaugaaauaauuacacauuauaauaccaauuucagaacaagaguuaugggcauaagcauccuggagguguuuuuuuuuuuuuuuuuggagguguuauuuuaauuucucaauuacagaguuuuaaaaaugaaaaugauuuuuuaaaauuuugguagguugaaugauuuaagaugcugauuucagcuggaaacaaauuguugccuucauauuauuuuguugcuccuagcagcauguuuauauucauucuuauauugaugguucccagucuugacugguguuagaauucauuugggaagcuuuuuaaaaauaccuaugugggcaaggcgagguuggcucaugccuguaaucccagcacuuugggagaccuaggcaggaggaucacuugagcccaagaguuugagacuauccuggacaacauagugagacucuguauuuuuuuaaauauauaaauaagaaaauaaauaccuguguguaugucucauccauagagauucugauuuaauuguuuaggagugggaucugagcaucaauauuuuuuuaaaguucucuagguaacugauucuaacauacagcugggauugagaacuauguuuuuggugcauguuaaguacgaucuggcucccuacuuaaugauuuugcaucuguuaaaaaauuaaugagguagaagacaaaagaaauggauuaaaguuauaaauguagauagacaucuauucuggaaaacaguuacccuuuuguuaguuucugggaaugguccuuaauaaaacaaacagacauuggccugguuugcuaagugccuauaucacagcauuaagccacacuuuacuuuguuaccguuauguacuuaacuuucauuuuaagaggcagaaacuuuauuaagaguuguauuuuuuuaguauccccuguaucacaacacugcaccuuguguauaguagguaucuauuguuuaccuaauugaagccaguuuagacagucacucuuuagaacuagggcuaguucagcuccuugggaggcugaggcaagagaaucgcuugaaccggggagguggagguuuuggugagccgagauugcgccacugcucuccagccuggacagcagagugagacgucaucucaaaaaaauaaagaacuagggcuaguuuauucuuuucuuuucuuuuuuucucauggcauucuaagacucccccaauuagacagggucucccucuauugcucaggcuggagugcaaugguguaaucaugguucauugcaagcucaaccucccaggcucaaggaaggccucagccuuccgagaagcugggaccacaggcgcaugccaccaugcccugcuaauuuuuuauuuuuuuauuuuuuuuuuguagugauaaggucucacuguguugcccagcaguucaccaaauccuagauaacauaauuuuggugucaauacuuaauuaucuuccaaaacaauagggauuaucaaagucaacauugaugccuuauuaguugauaaacagauuuaauaucugucugcucucacauauaacugauuucuaguuaauauuuacaucuuaagauguuccuuuggcauacacucaacauuuuccacaucgaauuaccuacuuugcuguaaaccagugguucuuguuggggguaauuuugccuuccaggacacauucggcaaugacuguagacaguuuugguuguuacaacuggaagggaaggaugauaguaaacuggcgucuaguagagguuagggaugcugcuaaacauccugcagugcacauugcacagagcagccucucacaacaaauguuuaucugguccaaaaugugagugauggcaagguugagaaacgcugcuguaaacugaucaguuuuaaacugcaguauuacuuuuuuuguuaauagcacuacugcucuucauauuuugcaggguacagugugugugccucuguguguguguguguguguguguguaagcaagagaaaauacuguuucgaucaaccaguuaccaaagcauguuucuaccauuuuguguucuuuucugcagugaccuuguaguuacucuuuuccauaguaucauucccuuguucucaucuccuuucaaucuuacuuacauaucccuaauuugaccaucuugagauaauauuuuucccaucaggaacuggcuuuuauugccugcugaaucaaauauaaagaauucuggauggcuuccaaagucuuccauaaugugacuccaucuccuacauaauauaauuuaguuauucuuguuagucaacauuuuuuuuuccuuuuaguuaaauucagcugacagggagaaacauuuauuaaaguggugacuaugugaggacuauugagauaggugccagggauccaaagacaugucaacauuuucccucuauccgauugauuauuucccaauaacuucuguaauauuccuuauuauuacuauuuuuuccgagauggaguuucacucuuguugcccaggcuggagugcaguggugcgaucuuggcucacugcaaccucugcccccuggguucaagagauucuccugccucagccuccugaguagguggaauuacaggcguccaccaccaugcccagcuaauuugguauuuuuaguagagacgggguuucuccauauuggucaggcuggucuugaacuucugaccucaggugaucugccugccucagccucccaaagugcugggauuacaggugucagccaccaugcccagccagauguccuccuuucuuacccuguucuuagcuaaauucuguccucaaggccagguucucucucucaucacaucaucaugagcacugcguguguaugaggauuuuaaagccuuauaguaauugucuguugaucccauuacuguauuuaaggaaugauauagaucacaagcauuguaggauucacaugaagaaacaaauuccaagaacugggaccauaaaggauggaagagauggaacuuaaguuuguuucuucuuguagcugagaccucagaugugcaccacuacgcccagcuaauuuuuaaauuuuuuguaaaauuuuuugucuuuacuuuguugcccacuuuguuggcuaccuaccauuucucccuaucucugcccuuuaggcaacaacaauacucaacauaaauaucuguucuugaacuccugggcucaagcaguccucccaccucagucucccagaguguugggauuacagcugugaggcaccacgcccagucagugcacugcuuuuugcauggagaaagucuugcugcuacuuuaaaaaggucagugugcuuaauugaucuacauucugucacaaacuucuuauuuuaucacaaacugauaacaaacaguuccccaaucagcacuggucauuggaccauacuuggaguuacauugcuguagugugagacuuucauacuuuuuuuaaaauugucaccuguauuaagaaauacauuuuacauuuucauccaguguuauaucauauacacauguacauaacugaaacaauuuuacgaagcaguaccuaaccuuacuaugugugacauagucugauguuugcuauuuuuuuaaugcugaucaugaccuucuaauggauuuuaaaaacacugcccucaagcauuuagcacagugcuagagacauaguaguugcucagaaaauaccauacauuuuagcagugauuaaaucuugagaggguugagccuucuuaauacuugaggauuacuuuaaaauguuauuucauuggccgggcacgauggcucacgccuguaaucccaccacuuugggaggccgaggcgggcggaucaccugaggucaggaguucgagaccagccuggccaacauggagaaacccugucucuacuaaaauacaaaaauuaguggggcaugguggcggggcgccuguaaucucaguuacuugggaggcugaggcugcuugaaucugggaaguggagguugcagugagccaaguucaugccacugcacuccagcuugggcgacagagugagacuccgucuccaaaaaaaaaaaaaguuauuuaaucaauacuuaguuguuuguggcaccuuauacagaacgaguguagaguggauuaugagauuuaagacagcgagaagauacuuauguugaguauuguugcugccuaagggcagaaauagagagagauggugggugaccaacaaagacaacuuuugcuuuccuuucaauauugccaaagaccuuaggaguggcuggugugaaucccugcuuaaaaucaggaccaguuugaaugacugcaaaccucauuuuucacuuuuuaccuuuuagucuucacuuugugguuccagucaucaaaucccuacucuuugucuuagaaaggagcagaaggaugucagagaaagaacauuuucucuuuauuuauuuauuuuuuuuugagauggagucucuguugcccaggcugcagugcaguggcgcgaucucagcucacugcaagcuccaccucccagguucgugccauucuccugccucagccuccugaguagcugggacuacaggugcccgccaccgugcccggcuaauuuuuugucuuuuuaguagagacgggguuucaccguguuagccaggauggucuugaucuccugaccucgugauccgcccgccuuggccucccaaaguguugggauuacaggcgugagccacugugcacggcugcauuuucucuuuguuaacucauuuucaacacuuuuggguuucacuuuuggagcacugcuguuugacuaaggcugaaguucuuugucagguuuacacaucuuaagaauuuuuauuuuuuguuguuagaagcauguuaauuuuucuugcauauacuuaguuauuuuuuuuucacuugcaauccuucuugaagcauaagguuuuuuguuuuguuuuguuuuguuuuguuuuguuuuaaaagacagagucuugcucugucgcccagacuccgcucacugcaaucuucaccuccuggguucaagcgauuuuucugccucagccuccugaauagcugggauuacaggugugcgccaccacguccggcuaauuuuuguauuuuuaguagagaugagguuucaccauguuggccaggcuggucucaaacucccgaccucaagcaguccaccugccucagccucccgaagugcuaggauuacaggccugagccaccacgcccggcugcauuuucucuuuguuaacucauuuucaacacuuuuggauuucacuuuuggagcacugcuguuugacuaaggcugaaguucuuuaucuuugucagguuuacacgucuuaagaauuuuuauuuuuuguuguuagaagcacguuaauuuuucuuacauauacuuaguuauuuuuuuuuuccacuugcaauccuuuuugaagcauaaguuuugcuuuguuuuguuuuguuuuaaaagacagggucuugcugugucgcccagguugaaguuguagugcugcaaucuccacucacugcaaccuccaccuccuggguucaagugauuuuucugccucagccuccugaauagcuggaauuacaggcaugugccaccaccacgccuggcuaauuuuuguauuuuuaauagagaugagguuucaccauguuggccaggcuggucucaaacucccaaccucaaggaauccaccugccucggccucccaaagugcuaggauuacaggugugagccacugcacccggccacauaagauaauuucaauguguuguaucuuaugguuuguccuagaucuaaacaaauaaauucugcaaauuauuugacuucuguaguuaaugaacacuucuguauaaguaucaauggguuuguuguugcugcugcuguuuuauuuuuuuuaaacgauuguagccaaaauaaggcaauugaguucauucagucauucuagucaauauauuuuaugucagucuauuuucagauuucuuuaauggcaaaaugcagcagaaugacuuaucaaaaauguaacauguuaaauucacauagauugagguuggauacacagucagccuucuguaucugugaauucaaccaauggccgauugggaauauuuuaaaaaaauaauuggaucuguacugaaccauguacagaguuuuuucuugucuuuauucccuaaccaauacaauguaacaacuguuuauauaacauuuacauuguauuagguauuauaaguaaucuugagaugauuuaaaguaagguuauaugcaaaucuuacaccauuuuauaucagggauuugaacaucugcagauuuuugguacuugugggaaaaguccuggaaccacucuccuacagauacugaggaauuacuauauauguuuugcuuucucacuugaugagcggaaaauacccuuuaccuucuguuugacuucugcagaaacgugugugauuguagaggcucaaauagcaauuaaaacaauacugaaaguauuuuuaacacuaggcauccuuaagugacgguauaacuuacaugauuuuguuaauaaaaauagaaacaacuaugguuuuuaauggacuuuagacauuaucagagaagauuguuacuuauuugaacuguuuccaaaaaucaaauggggacagaaaaggaagcuuuuaaaaaguacagucuuucuccuagaaacccuuccuaaaaucuuuggugacaucguaaucuuaucccuguacuuucccuccuugugucuaaucauuugccaaguccugucauucuaccuuugcagcaucucuuauuauaucugcuuccucuauuccaucucuacugcccuaguucugaccuuugucaucuuucccuaggaucauuauaauagauaacuaguguuuucccuaucuaguuugucacuuaccgccuaacuuuauacucuucuuaguuuuaaucacuuaccucccuacuucagaacccugcuaccuuuagaaaacaaaguaaaugcuuuaguaacauucaaggccuuccccguucccuguuccaagucuguuuuuuuuuccacugccauguagaucuuuguucauucuauguaguggcuaauuccuaaagauguucuuuacuuucuuuucuucauccugcuuuucaucucuuugaaaaaccuucccccaccaagacucaaaucaaauguugucucuuugaugaugacuuccaagauccuucuagucauacuuaaucuucucucuuaauuuuucuuauacuguaauauuuguaacucuauaguuugauaucauacuaugcuguauuacuacugcuuaaaacuuucucuuccacauuaguuuuuuaaacuuuguugguuuuuuuguuuuguuuuugagacggaaucucacuuuguugcccaggcuggagugcaguggugcgaucucggcucacugcaaccucaccucccggguucaagugagucuccuacuucagccuccugaguagcugggauuacaggugccugacaucaugcccagcuaauuuuuuuuguuuguuuuuuguuuuuugagacagucuuguucugucacccaggcuggagugcagggugugaucucagcucacugcaaccuccacccucuggguucaagcaauucuccugccuuagccucccaaguagcugggauuauaggcaugcacuaccaugccuggcuaauuuuuguauuuuuaguagagauaggguuucaccauguugaccaggcuggacuugaacucaugaccucaagugaucuguccacuuuggccucccaaagugcugggauuacaggugugagccaccaugcccagccccaauguuccaagucuuuuuuuuuuaaaucaauauguuuuuuuaaauguguauuuuuuguuacuugcuuguuuaacccauaacuuccuaacuuuuacaucucucuggauacucucuucauauuuauguauguugcauugcuuuacucacguuugcguuguuaugcucauauuauuucuuuccuuccuuaaaacuuuaaguacauuucauauauucuuuuauauguuauaaagcaugauacuaaaaugaucaccugugcacauacuacccaauuugagaacuagaaccuugcuguaccccugaagcuccuuauauguaucucccugauuacaacucucccucucccaagaaauauaauguugcguuuaacauuuucugcuuucuuuauaguuuuaccucauuuauaucuuuaagcaauauauuguucaauucaauuugauuuuuaaacuuuauauagaguaucguauuacacauauucuugguuuuucauucaacauugcgggggaugggcagaagaugaugaggugagaaggcgggcaggguauguuuucugguuaaacuauuuauucuuggagaaucagagaccauaucuuauauaccccuuuaauaaccucuguuuaacacgaggccuacuguugcaagcuaagucuccugaugauuugcacugacauugaaacauugcuguugucucuauaaguaugaggaaacccaggggaacccugucauacucuuuccucaauggaugcuuuuagcaaguuugaugaauuguugaugaauuagauaccucgcuagaaggacauauuugauaucaguugauccauuugggagugauaguguggucuagagaccuuuucuccccuaucacuacagcuuuagacacaggacccaggguggaugguaaaguguagaaaauguuuguauauuagaucguuguuucuaaaugcauagaucugaaaguacaaauuaaaguguuugguucaacauguguuuauagauaccuggagcaaguauagauagaaaaaaagugaaaaugauaaaaaugaaauacucagaacaaaaugguuuggugacuaagacaguggacuaaugugcacaggguuagaagggaugaguaccaauaaaucacaaaguauuaauauuuaauauaaaauguuacuagaauuaaagcaaauuggggugcuuuuggaauuuucauaggugagcagcagccuucccauccccugcuccaaguuguacuuuacuuagcuuuuuaggauuagauguucauugauguccauuuguuuaaugauagugaacugguagaaugaagauuauuaagagauuggaaagaaguagccagacgugguggcuuacgccuguaaucccagcacuuugggaggccaaggcagguggaucacuuaaggccaggaguuugagaccagccuggccaauaugacgaaaccccguaucuacugaaaacacaaaaacuagcugggggcaugguggcgaacgccuggaauuccagcuacuuggaggcuuagguaggaggauugcuugagcucgggaggugaagguuacaguaagccgagauugugccauugcacuacagccagggugacagggugagacccuaucucaaauaaauaaauaaauaagaggaagaagucacuuaaaaaauaaauggauaucaaugagaaaagagaaauauuucuagauaaaaauuccaucuacuuaugaucuaaacauuaaugcuauuuuaacaaaagaaacauguaaacgcuuugauuauucuuacugcuaguuccuuugacagguaagauucccaacucuuaaggcaaaaugauacaaaaaguaauucauuugguuaaugaaaauuugaaaaaaauuauuacauucuucacucauauucugcauaucuuaaacuccugaaauagauauucuaaacaauuuaaaauuaacccuguuagcaaaggauaugguuuaggaauuuuuuuuuuuaaacugcucacuuguuuuauugugaaugaggaaaauuaguauaauuauuuguauuuguuucaggaaagaagcacuuguaaggaaauauagcauccauugugaaaguggaaaaguaaagauaauucaucaugccugcuguggcuucaguuccuaaagaacucuaccucaguucuucacuaaaagaccuuaauaagaagacagaaguuaaaccagagaaaauaagcacuaagagguaugauguauccuucgcuaguuugauugaaucaaauauuaauuuuuaguucguuuccauauuaaaguuagaugaauguuaaaguuuauuugaaaaauaacaccaucacacgaauaaaguaggaccuccuuagagaaaguuguaauguaaucguagcacaauacauauauauucugcucauaugcauauuaucuacucuccagacagaucauacagauaugaucucuaggucauaaaguuuaagaggcaaagauuaugaggcuucuaaaaaaaaauucagccagaagucauugucuuuucauaaaacgauacaaaaauaauuccuuuuuggccgggugcgguggcucacgcuuguaaucccagcacuuugggaggccaaggugggcggaucaccuaaggucaggaguuugagacaagccuggcuaacauggugaaaccccauuucuacuaaaaauacaaaaaauuagccgggcgugguggcgcacaucuguaaucccagcuacucgggaggcugaggcaagagaauugcuugaacccgggaggcggagguuucggugagccgagauugugcgauugcacugcagcuugggcaauaagagcgaaacucugucucaauaauaauaauaauaauaauaauaauaauaauaauaauuuuuuuuuuccacuuugggaggccaaggugggcggaucaccugaggucaggaguucgauaccagccucggcaacauggugaaaccccgucucuacuaaaaauacaaaaauuaacuuggcaugguggcauaggccuauaaucccagcuaguggggggcugagggaucccugaguccaggaaguggagguugcagugagucaagauugcaccguugcacuccagccugggugacagagugagacucugccucaaaauaaaauuaaaaagaucuuuugaagggcagaaaguaagagagggauugggcuauuuaucuugcgaaguugggaaguugaugaggugacagaaaacaacucuaacuccuguugaaugauuuucagaugggaaacaaugggaaagauaaagccaccuuuagauaagacaaggucaggccuaagaccguuuauuccuuucuaguaaugucugguuuaccucuagcacuacccuuaucccagaggaagugguauauguaaguugguuguauccaaacuugcaucuaacuuuguaucaguucugaaguaguggaaccuaaauaaugaaauuugcuuuaucaagaucagugguccccagccuuuuuggcaccagggacugguuuuguggaagacaguuuuucaauggaccaggguuagggaggauaguuuugggaugagucaagugcacuacauuuauugugcacuuuauuucuauuauuauuacucuguaauguauaaugaaauuauuauauaacucaccauaauguagaaccagugguaucccugagcuuguuuuccugcaacuggaccaucacaucugggggugauggucgacagugacagaucaucaggccuuagauucucauaaagaaugcgcaaccuuggcuaggcgcgguggcucaugccuguaauccgagcacuuugggaggcugagaugggaggaucacuugaggucaggaguucaagaccagccugacuaacauggugaaaccucgucucuacuaaaacuaaaaaauuagccaggcauggugguacacuccuguaaucccagcuacuugggaggcugaggcaggagaaucacuugaauccgggaggcagagguugcagugagccaagauagcccauugcacuccagccugggcaagaagagcuagaccccaucucaaaaaaaaaaaaaaggagugcacaaccuagaucccucacaugugcaguucacaauaggguucgugcuccuaugggaaucuaaugccaccaugaucugacaggagguggagcucaggugguaaugcgagcaauggggagugacuguaaauacagaugacacuuugcuggcuaacccaccacucaucgucugcugugcguccugguucauaacaggccgugaaccaguaccaaucuguggcccugggguuggggaucccugauaaagauuaucuguggacuuuguauaugaccuguauuuuuucccagaugucaauugcuuuaauuauuauuuuuucucuaauuuuaaguuaugugcacagugcccugaagaucuuuaagacagcagaagaaugcagauuagaucgugaugaggaaagggccuauguacuauauaugaaauacgugacuguuuauaaucuuaucaaaaaaagaccugauuucaagcaacagcagguaccuuuuauuuuugcauuguuauuuccuaaguuauuuugcauaauggagcuauugauuuuuuucuaaaaauuuuaaguaauaaugaaauguagcucaaauuauaugcagcaugaucucauguagauagaaaaagggaacuaaagauacaguguuauuauuuacaaauguguauaaugugugaacucguacacauucuuggauuugccauggauuaguacaaguuuauagcaacauacagauucauaauuuuuuucugagguaauuaauaauugccaggucaaguagaaggauugaguuugcucauuaaguaagaaaacaugacuguguuuuuuuuuauaguacuuuuauugcgcuuucuuaagagucaagguuuagucucuuguuuuuaugugacagcuuuuuauauaugacugacauuguacccauauuacaaaugucaguuugcaaaauugauacugaucacucccuaaaucuuuuuuuuuuuuuuuuuuuuuuuugagacggaguuucacucuuguuguccaggcuggagugcaguggcgugauaucggcucacugcaaccugucuccuggguucaagcaauucuccugccucagccucccgaguaacugggauuacaggcaugugccaccaagccuggcuaauuuuguauuuuugguagagaugggguuucuccauguuggucaggcuggucucaaacucccagccucaguugaucugccugccucggccucccaaagugcugggauuagaggcauaagccucugcauccagcccacucaccaaaucuuuaaacuucuuuuugcuuuuaauccuuugaacaggugcuugucuuccauuugauugaagccauggauagggagggcaggggcaauauaaaugaauagaaaaaauugaugacuaggauaaguguugauagagaaaauagauguauuucaauuguauuagaaacuagcaaaagaaugcugggcacggugguucacaccuguaaucccagcacuuuuaggaggccaagguggguggaucaccugaggucaggaguucgagaccagccuggccaacauggugaaaccccaucuguacuaaaaguaaaaaaaacuagcugggcguaguggcgggcgccuguaauccaagcugcuugggaggcugagacaggagaaccacuugaaucugggaggcagagguugcagugagccgagauugcaccacugcacuccagcuccagcccaggugggcgauagacuccaucucaaaaaacaaacaaaaacaaacuagcaaaaaaagaauaugaagaauguagagguucauuaaacaaaagugaagaauguuguguugcuggguuuaccuuuacuuagaaacaaucuuauuaccugucaguaguaacaaaauacugccuauagaauuuucaccugguagagaagccacccucaauuaauaaugagauuuuauuuuguucucuggugguagaauuggcuucuauuguuuaaauugacuuacugaaauaacaaaauuucguuuguucuuugaugaucuuuuuaaauuuuuuuaauuuauuuacuuugagagagucucgcccugucacccaggcuggagugcgguggcacauucucagcucacugcaaccuccaccuuucggguucaagcgauucuccugccucagccuccugaguaggugggauuacaggcucuugccaccaugccuagcuaauuuuuuuguaucuuuaguagagacggaguuucaccauguuggcccagcugguaucgaacuccugaccuugugauccgccccucucguucucccaaagugcugggauuacaggcgugauccugugagccacugugccuggccacuuauuuuuauuuuuagaggagugugacuuuugguuguuaaggaaugacuuuaauauuuuacuuaauggugauaaaucauugcugguauuucuucucauuagcaaaguuauucuaauaauaguuacuagguuuuuuuuguuuuuuguuuuuuuaaagacggagucucacucugucgcccagacuggagugcgguagcucaaucucggcucacugcaaccucugccucccagguucaagcgguucuccugccucagccucccgaguagcugggacuacaggugugcaccaccacguccagcuaauuuuuguguuuuuaguagagaugggcuuucaccauauuggccaggcuggucuugaacuccugaccucaugauccgccugccucugccuuccaaagugcugggauuccaggcuugagccaucaugccuggccaauuacuagguuuuaaaucugucuuugaagagggggccccuugcauuuggagguucauucaucuguccacaauggaugaauuaguccugcccugggaaaaauacuguuuaauauuuuuggccauacuuaucugcagguaagagacagaggccuuccuaaauucaaacaaguuuuugcacgcucugugaaauauguuaaaguggaauugcuuaaaacgcaguguaaguggugcucacuaaaguaaauauuuuugaaagucuuaaaauuuggauaacuuugguaguuuuguuguuugcuguuuuguuugugugguagguuuuuuuuuuuuuuuuuuuuuuuaaggugacagucuuguucugucacccaggcuggagcgcgauggcaugauuuuggcucacugcaaccuccaccucccaaguucaagugauucuccugcuucagccucccgaguagcugggauuacaggcacccgccaccacgccuggccuaauuuuuguauuuuuaguagagacaggguuucaccguguuggucaggcugaucucgaacuccugacccucggugauccaccuaccuuggccucccaaagugcugggauuacaggcaugagccaccaugcccaaccaguuuuuuuuuuuuaauggucuuguuuacuuuuugcuuuauuuuggaaguuaauaguuauuuuuuuucuaugacaaaauugggaauauuuuuguagccgccuuuuuuuuucucuucuugagaagguagugaguacauuuaaacagaugagauuuuuccauuuccagagucucuauugcauuuccaaagggaguauguaggcagagaaguccaggcugagacgcucccugcaaaggcucagguaacuuaggccauuauuucauaugauucaguaguucauuuccuguuuuucaguaaaaggaucauuuucauuugcucuguccagaggaucucaucugcuucugucuuagaacuguuuuuuguuuguucugagacagaaucucacuuccgucacccagguuggagugcggugggcacagucaugguucacugcagccucgacuuccugggcucagcugauucucucaccucagccuccagaguagcugggaguacagacacgcaccaccacaccuggcuaauuuuuuaauuuuuaguggaaacgaggucuuacccuguugcccagguuagucuugaacuccugggcucagguggucugccugccucggccucccaaagugcugggauuacaggugugagccaccuugcccaguugcagaacuguuuucuguuuuuuguuauauuuuucuguagcccagccucucuaguguacuucagcuaugugaggugcuaaauuuacuaacaagauauuuucuauuuuuuacccuuuagaugagguagggacugaauguaugucauugaacuuccuuagaaacuuguauuuucacucuuauuuuauacuagaaaauguuagagauuuaggcugggcgcaauggcucaccccuguaaucccagcacuuugggaggcugaggcagguggaucacuugcggucaggaguuugagaccagccuggccaacauggugaaaccccaucucuacuaaaaauacaaaaauuagcaggguguggugguaugcaucuguaguuccagcuacucgggaggcugaggcaggggaaucgcuugaaccugggaggcggagguugcagugagccgagaucgcaccacugcacuccagccugggcgacagagcaagagucugucucaaaaaaaaaaaaaaaaaaaaaaaagccugggcacaguggcucacgccuguagucccagcacuuugggaggcagaggcagguggaucacaaggucaggaguucaagaccagccuggccaacauggugaaaccccaucucuacuaaaaauacguaaaaaaaaaauuagcuaggugugguggcaggcgccuguaaucccagcuacuuggaaggccgaggcaggcgaauugcuugaaccugagagguggagguugcagugagcugagauugcaccacugcacuccagccugggcaacagagcaagacuccgucucaaaaaaaaaaaaaaaaauugagauuuagauaaaacauuaauuuagcaagcucucucaauaguagagaaggacacuacauuuuauuacuuaucaaaaagucaucuuaugaauaauucuuucaggguuaucugaaaaaguggggaaagaaaauguauugaaaauauuaguguagcgaauucuagauaaaauuagaauuguauuuuaaaauuuuuaugguauucuugauaauucuucauugguaaaccuauuuuuguuuaggaaaucaugaaaguuguuugaauucauauauucaggaaucaggaaaguucugguaaaccucagaagcaaacauuuuuaguuauguaauaauuggauguuaucuuuuucuucugucaauuaucauacuauugaaauuuuggaaguauuuauauuuacuuuaacugugcuccuuuaagagcacagagauaaauaauugacaggaaaucucacuaauauuaggggaaugucugauaguguguaacagacaugcccaaccauaaacaauuuuuuguguuuaaauaguuuaagcugggcuuacaggcuggcuuuuuggugaguucauguguaaaaaugaauaaaacaaguuauagcauuuuugguuuuacuuuguauuuuguauuuauucagaaugauuacauuaugauuucuguuaaaugguucuguuaauguaaugauuacauuguauuuucuguugagagaauugcaucaguagucaggacauggugugcuaacugaaauuauuguaauguucaauugauacgauauugaacaaacuguacacuuuuauuggaauuacauagugaaggguccuucuaguauauuuaggcuuuagaagaaucagccaaacaaagcaugaucuacuuuuaggcuagauagacauaugauaacucuuaucaacagacuuuuuuugagacagggucucacucuguugcucaggcugaaguacaguggcacuaucauggcucccuaaagccuugaccuccuggguacaagcuauccaccugcuuuggccucccaaagugcugggauuacaagcgugagccaccuggccuggccaucaacagauuuuucuucuuaaaaauaagucuuauguuaacugggacacaaaaauuaaaucuuuugcuauaucacucauauucuguucuuguguuaccacauacuuuuuugaaauuaaaaaguguuuagaaugauagauuauugagcacugguauauugaauuagagcucagguccaguuuuucuaaguuauuuauaauaauauuuguaaaugucuggcaguuuucuuuagaaaaauuuaauucuucauaugcuccagguuguauugugcuacuggacgcuggucuuaugggaaugaauuauuuacuguuaguuuuuguuguuguuuucaaacggagucuugcucuguugcccagacuggaguucaguggcacugucucugcucacugcaaccuccacuucuuggguucaagcaauucucuugccucagccuuccaaguugcugggacuacaggcacgugccuccacgccuggcuaauuuucauauuuuuaguagaaacggggguuugccauguuggccaggcuggucuugaacuccugaccucaggugauccacccaccucagccucccaaugugcugggauuacaugugugagccccugcacccagccuacuguuaguuuuuuuuuucuuuucuuuuuuuccccuccgagacagaguuugacucuuguugcccgggguagaguacaauggcgugaucucagcucacugcaaccucugccucccggguucaggugauucuccugccucagccucccgaguagcugggauuacaggcgcacgccaccaugccuggcuaauuuuugcauuuuuacgcuuauuuuuuuuuuugucuuuuuuuuuucuuccuuuuuguggggaacggggucucacuauaugcccaggcaggucucaaacuccugggcucaagcuauccuccugccucugccucccugagagcugggauuacaggcgugagcuaccgugcccagccuaauuuuugcauuuuuaguggagacaggguuucaccauguugcucaggcuggugucaaacuccugacaucagauagaugauccacccaccccagccucccaaagugcugggauuacagaugugagccaccgcacauggccuacuguuaguuuugaucugccuaguuacagaaguuauguuuguuuauuuguaucaucaguaaucuagaaguuauauauauuuauaugggcuguuagauauguuuauauggcuccaccauugcagcucuucaugacugagagccaaagauagguacuucugaccuacaacccuucuuuuuacaaauuaugauuauuauaauuuguaaugaacugugcuaguaggcucuauuugcaaagucauauugacauguuguggcaaauuggauccaguaaucauuuaacugacuuaacuaacuacugcaaugucauaccaaccuugauuugaaaauaucugauuguaguaucuaaugauugaccucuuguaucuaaugauugaccucuuggaguagugauuuaaaaaacaacaacaacaacuucauuguacuuguuaguaaauuauaugccaaaucuuuuaccuuuugcauuuuuuaaagguggaauuuuuuuuuuuuuuuuaagacagaguuucguucugucgcccaggcuggagugcaguggcgcaaucucggcucacugcaaccuccgccuccuggguucaagugauucuccugcgucagcuuccugaguagcugggauuacaggcacauaccaccacacccagcugguuuuucuauuuuuaguagacaugggguuucaccauguuggccgggcuggucuugaccuccuguccucaagugaugugcccgccucggccucccaaaguucugggauuacagguuugagccacugcacccggccuagauuauacuauuaauuauuuauuuucuaucauuugguuuuuaguugcuuagaguuuccuaauguguaaaacuuguuuuauguaucaaaaguguuuugacuccaguugggaugugaguagcuauucuaaaguacagguggaagcaaaaauaucuguuuagaacaaguaaacaaaacacauuccauguugugucuguacacaauuugcuuuauugugagacuggagaaaaaacuagguacauauuuuuaauaagaaaauauacuuuauucuugaaagcuuugcucuuuggcgcuuacucaaaaauaacaauguuauuuauacuuuuuaacagagacuuacaaauaagucaaauuuaugaacuaguggaucuuuuuaacuuacuaaugguaugaagacauacuuuugagacauuuggagaauaaauuauacauuuacauagguuaaaaguuuuuaaaaaucuuccauuguaauaaaacaaacuucccuuuauauaagcaccaugauuuuaaugauuuuaacacuagugucacaugcaaugccgagaacuaacaauaugggaugguuuuccuauaauuuuaggauuauuuccauucaauacuuggaccuggaaacaucaaaaaagcugucgaagaagcugaaagacucucugaaagccuuaaauuaagguacagauauuaugaaauauuuaaaauaauguaaauuuagaagauaaaaauaauauuuaagauuuaccgauuuauaucugacgauucauauaauauuccaauuuuuuuuugagacagagucucgcgcugucugucgcccaugcuggagugcaguggcgcgaucucggcucccugcaagcuccacuuccuggguucacgccauucuccugccucaaccucccaaguagcugggacuauaggcacccaccaccacgcccggcuaauuuuuuguauuuuuaguagagacaggguuucaccauguuagccaggauggucucgaucuccugaccuucugauccuccugccucggccucccaaagugcugggauuacaggugugggccaccaugccuggccccaauauuucuuuuuuuuuuuuuuuuuuuuucugagacggagucucacuguugcccaggcuggagugcaguggcgcgaucucagcucacugcagacuccgccccugggguucacgccauucuccugccucagccucccgaguagcugggacuacaggcgcccgccaccucacccggcuaauuuuuuguauuuuuaguagagacgggguuucacuguguuagccaggauggucucgagcuccugaccucaagugauccgcccgccucagccucccaaagugcugagauuacaggcgugagccacccggccccaauauuucuaauuuauaauauuuguaaguuucuggcauuauucuuuagaaaaauucaauucuucauauguucuuugguggauucugcuccuggauacugugcguauaggaaugaaguauuuacuguuacuuuugaucugcuuaguuacagaaguuauuuaaauuuggaaaaaaaaacugauucugguauuugccaugacuugcuuaccagguuuacaaaaauaauuacaaaacaaaaacaguauguuucaguuuuuagucguuagucauucuuuuuuuuuuuuuuuuuuuuuuuuggagacggaguuuugccucuuguuucccaggcuggaguacaauggccugaucucagcucacugcaacauuugccucucagguucaagucauucuccugccucagccuccugaguagcugguauuacaggcaugugccaccaugccuggcuaauuuuguauuuuuagucgagacgggguuucuccauguuggucaggcuggucuugaacuccugaccuccgaugaucugccugccucggccucccaaagugcugggauuauagccaugagccacuguacccggccauuagucaugcuuuaaaauuuaaauuguuucccuuaucaacaacauaaugcuguuauguagauccuaguagauaaauuucugccuguaucuguagcauaaaaaauguuaauagauaaaaccaaaagcauucucagcaauaugauacagaaggagagaacaauggaacugguuuuaagugauacaaggugccaaagccugguuagugaaaaacagcaaacugagagcuguuugaugcaaauaauaaauagaaggaggaaacugaaagauuuaaccagggugacauauuucuuuacuggcuugaauuuuuuuuuuucacuaagaauguaucauguuacuuguauuuaaaaauauucugaccaggagcaauggcucaguccuguaaugccugcacuuugguaggcccaggcgggcggauuacuugaggccaggaguuugugaccagccuggccaacaugguaaagccccgucucuacugaaaaugcaaaaaaaguuagccgggugggguggcaggcagcuguagucccagcuacucaggaggcugaggcaggagaaucgcuucagccugggaggcagagguugcagugaacugagaucuugccacugcacucuagccugggcgacagagugagacucugucucaaaaaaagaaaauaacucucaacuuauaaaggaagucauuaagaaaaugauucauuauuuagauauuuacuucuuauggccugauagaauggcccaucuuucaguguaauaaagucccuguugcuaaauaaccucuggguccuuuccaauucuaaggcuuuuuaaauguacuuugaauuuuccucuguauagguuauuuugcagcuagauguggagaaccuuuucacuguuuuucucccugucuguccucucccagccuccugccccauguuggugucuuucauggacauuuagagcaacccugugugaacauaucuucauaucuguccuguccuaauucuguaauaagucaaccacaaagcucuuuuccuccuuuaagucucugaaaucugcaugacuagaauuucucuugucaggccggcagucugagaaugggcaugagggaggguauaugcucucuagguuuggagaauagauuauaacuuuaaagugaaagcccuuaacaucuugggguagauuuucugcuaaauucugccuaaucaucugaugucauggucuaugaccacggaggcgugugugccgagugggguccguggccugcuggccccuguccuagggguggccgcauggucccaggugcggccgcuauagacauagccccagauucugaaaaaaaugcuuuagcaaaaagaccuagugaguggcuagaaaauagauuucaguaucaccugccauuaaggaauacuuguuaagcauuuauuugccugucccguuucuuauuauuaucuuuuuucauggacaccucucauaacauagacuuaauccauuucuguuacauucauguuaggggaggucuuagagguaauuuugaccaaaucuggaaguaucagaauccuaguaaaagggauuaaguggguaaaaggaucagaaguuaguuucagagagcaugccucgcucucacuucagcuuaccaacugaaauuggaaaguaggagagacaucagcucuauuuaauuagauuuauggagacuguagaacaaauccaagguaggggguaagguguggauaagagaagaaaauaggaaaaaagagaaucuuaaaguuuuuucauuucugcccucaaauuggauuuaggcugacugugcuuacuucuuagggcagacaguucacauacuguuccagcauagagcacuacuagagaagaaauauagagcaguagguaaguguacggagccagacucccuggguauggaucccaguuuuuuucuuauuaauugugugagcuugggcaaauuacuuagccucccucugccucaguuuccucaucuguaacuaggauaaucauaaaaccuaccucauagugcauuaagaaaauuaacauuuacaaacacuuagauggugucuggcacauaccaaauaauaaguuuuugugcuauuauuuucguuguuauuaacaguggaagcauucuuguucuguaacaccuuucguccuggcacucuagugauuugcauugaggaggcaagguaaaacaguugcauaauuuugcucuuguuccaaaucuuucacuucuguuucuaacagugaaaugaugcuagcauaugagauaggcaggaaagugguguugauauuuccauagagauaauaggaauacaugcuugcuauucugugaccaaguucuuaacacagugcaguagagaagugggggaagugagcauaccaguaagcaagguccugcuggagauuugagaauccauuaucccugguuauugccuaagcagauggaauaugaugaaacaucuguuuuuguaaaauucuaucugaaguuacucuguuuuucuuuucuccucucacaucuauugauggguucaucauucacuuuuguuccauuuauuuuauuuuaacacacugauuuucauaaaucuauuguuuucccaguagaacuuuauaauuuauuuugaaauauuuucuaauuucccuuucuuccuugacccaugggucauuuagaaauguguuguuuaauuuccacauaugugggauucuucuuauaucuuauugauuucuaauuuaauuucauuguggcuaaagauguugcguccuuuuaaauguauucuuguuuuauggcucagcauauggucucuuggugaacguaccaugugcacuugcaaagaaaaugugguuguugaauauacuguucucuauaugucauuuaggucagaauggcugauaauguucagaucuucuuuaucuuuacugacugugggauggggguucaaguuguaacaauuacugagagagucauguuaaaauauuuaacuguaucuauuuaugccuuuaguucucucagcuuuuguuucauguauuuugaaauucuauuuuuaggcacauaguuacaguuucuugaugaauugaccuuuuuaucauuaugucccucuuuaccucugggaauauucuuuuuuuuuuuuuuuuuuuuuugagacagggucucacuguccugaaggcuggagugcaguggcaugaucuuggcucacugcaacucccgcccccagguucaagcgauccucccaccucagccuccccaaguagcugggacuacaggcgcacaccaccaugccuggcuaauuuuuguauuuuuugguagagaugggguuuuaccauguuggccaggcuggucuugaauuccugacuucaggugauccgccugccuuggccucccaaagugcugcgaucacaggcgugagcuaccacaccccgcccucaucuucauucuuaagggauuuuaacuagauacaggauucuagguuggcagguuuuaauuuucccuuuugucacuucagagcugcuauuccacugucuucuggccuccauuguuucugauauuaagcauuuuucugccucauuuuuauuuucuugcuggaacuccagcucuacauacgauagacuuuuugauuuuguccaaugaaucccuaaggauuuguucuuuuuauuuuguuuuguuuuguuuuaaucauuuucucuuuguuuuucagauuggauaauuuucuuuucuuuuuuuuuuuuuucagauggagucucacucugucucacccaggcuggagugcaguggcacacgaucuuggcuugcugcagccuccaccuccuggguucaagcaauucuccuaucuuagccucccaaguagcugguacuacaggugugugccaccacaccuggcuaauuuuguauuuuuacuagagauagggguuuaccauguuggccaggcuggucucaaacuccugaccucaggugauccacccaccucggccucccagagugcugggauuacagaugugagccaccacgcccagccuggauugaauaauauuuaucacucuuucauccuuuuuuucuuuugagacaaugucucacucuguugcccaggccgaagugcaguggcaugaucccagcucacugcauccucaaacuccugggcucaagcaaucccaccucagccuccugaguaggugggacuaaaggcacacaccucugcuccuggcuaauuuuauuuuuuauagagauggggucuuucuguguugcccaggaugguucucccuucaaauacugacucuuuacuuugucaucuccaauuuuguguugagugaauuuuuuucaguuauauguuucaauucuagaauuucuuccuuuuuuugagacagagucucacucuguugucgagguuggaguacaguggcgugaucacaucucacugcaaccucagccuccuggccucaagugauucucccgccuucaccuccugaacaacuggaacuacagaugcacaccaccaggcccaguuaguuuuuuuguguuuuuuuguagagacaggguuucaccauguugcccaaacuggucucaagcucugggcucaagcaguccuccuaccagggccucccaaagaguuaggauuauaggcaugagccacugcgcccagcccaauucuagaauuucugugugguucuuuuuuauagcgucuauuauuuuuuuacagagauuuccuauuuguucauuuauuacaagcacauuuucauuuacgcccuugagcauaguuauaacagcugcucuaaaaucuuuguaugcuaaaugcaucaucuuagagucagugugcagcaccuuuucucuuuuauuguuguccuauuuuucuuuuuuugguacuaguaacuuuggacauugugaacaauaaaauuauaggcucugcauucuucuuuaguccucugaauaguuuuguuguuguuguuguuguuguuuugucccacuaggcaguuaacuuggcuauacucaaacguuaaguuuucugucuugccuaugguagguggcaacugacauucuuuucaauucuucuaaacuuagcugggcuccuuaguaucugcugcaggugugcuuaauucaggugucagguggcaauuugggcaagucuauacaaagaauuuggaacucugguucucugagauuggggucuuuauuggaauuuuagcuguuuucagcaguaaggccugccuuaggugugaaaccauaaaaaaugggaaucuuacuaaugcccuuccuuucuuucaagugucaacccccaucuacuuucuuccugauuauggcaguuuuccaaugccuucagguaguuauagguuacccagaguuuauaguugucugugagagguucagaacaauggaaacuacuaagucauuaccagaauuagaauucucuuuccuaccuuuauuuuuuaaggcgaaaggauagcauuuuuaaaguagagugucgugaucaccauguuccugucaauauuagugaucauuucugucaauggaauacauaauucagaaggaauugcuaagcguaaagauagaaacugcuuaggccaggcgggguggcucaugccuguaaucccagcacuuugggaggccgaggcagguggaucacaaggucaggaguucaagaccggccuagccaacauagugaaaccccaucucuacuaaaaauacaaaaauaaguagcuggccgugguggugggagcuugucaucccagccacucgagaggcggaggcaaggagaaacgcuugaaccugagaugcagagguuucagugagccgagaucccaccacugcucuccagcccaggugacagugugagacuccgucucaaaaaaaaaaaaaaaaauuaacugcuuaauggccgggugugguggcucgccccuguaaucccagcacuuugggaggccgacgaggguggaucacuuuagaccaggaguucgagaccagccuggccaacauggugagaccccuuuucuacuaaaaaugcaaaaauuagcugggcacaauggcaugcgccuguaaucccagcuacucgggaggcugaggcaggagaauugcuugaaccuggaagguggagguugcagugagcugagaucaugccucugcacuccugccugggcagcagagcgagacucugugaaaaaaagaaaaagaaaaaaaagaaaagaaauuaacugcuuaaauauuuagaggagaagcacuguuuuccuuauauuucuuccacuugaggaauagcacagcuuugugugacaugcuaauuucuucuccaagagcuaaagauguaauucuugcuaagugcaugaaugaucuuauugauagauggcacguuuuuggucacuauuaacaugauguugaaaaugugugguacaaaauaauuuugaguucagaagucauuuuuaaaguaaacuuaaaauuuuaaauaugugaagcuggcacaguuauuugaauagucaccauuucuauuguauaguuuuaucuguuuauuuagaaauuuuucauuuuggaauauucacucaaaagagcauauaagaccaggugcgguggcucacacaccuguaaucucagccuuuugggaggccgaggcagguggaucaccugaggucaggaguucgagaccagccuggccaacauagugaaaccccaccucuacuaaaaauacaaaaauuagguggguaugguggcacacaccgguagucccagcuacuugggagguugaggcaggagaaucgcuugaacccaggaggcagagguugcagugagcugagaucaugggacuguaccccagccugggugacagagugagacucugucucaaaaaagaaaaaaaaaaaaaaacagccagccacgguggcucacaccuauaaucccagcacuuuggaaggcugaggcaggugggucaccugagguuaggaguuugagacaagccuggccacauggugaacccugucucuacuaaaaauacacaaauuagccaggcaugguggugugugccucuagucccagcuacucaggaggcugagucaggagaauuacuugaaccugggagauggagguugcagugaaccgagaucaugccagugcacuccagccugggugacagagcaagacucugucucaaaaaaaaaaagaaaagaaaagaaaaaaaaaagaaaaaaagagcauauaaaauguaaagauacaauaaagagaauaauaaaauggaaacuauugauucgucuuuuacuaauuauugacccuagucaauuauuuauuuuuuuccuuuacaucuguuuuaucuucucucucucugucuuuaaauuugaagcucacagacauugccaagcauugauaauuagggcaaacaagauugcaggucuaugauaacguacagucuguccuggcaauaauagcaaacauugccauucguucauuuauuuauuuauuuagagauggagucucacucuguuaccuaggcuggagugcagucacgugaucucggcucacugcauccuccgccuucccaguucaagugauucuccugccucagcuucccaaguagcugggauuacagacaugcaccaccacgcccagcuaauuuuguauauuuaguagagaugggauuucaccauguuggucaggcuggucucgaacuccugaccucacaugauccgccugccuuggccucccaaaguccuggauuacagaugugagccaccgcacccagccaccuauaauuuaguagggaauaguucuaaauuccucagauaucugcuaacuguaguucagauagcuguuuaacugccaacaaguuggaaauuucagugaagucauccuuuaaaaaaauguaacuugggaccuugguaagacuuuccacagcuuuuugaauguuuguuuucacauuuuuauucuaaauuaucaacauaagugugauauuugggcuguuucuuuugcagaaaaaauuaggauuuuuccuuugaaaagcaaauugcagcagauuugaaucaauauaaaagguugaaauuaguaggagagaaagagcaaaaagcacuaaauaauuucaacuugagaacauacaguuucuuuuuaauaguucugggcaauuugaaguaaaucuacagauggccucagguggcagaugugugaauugugguggagggagaaagcauauagccaugaaauaccucaaggcaggauacuaauuuuacagaacugaaacuccuuuaauuuccacgauuaacgccaauaaaagacaaucuugacuuauuuuuucaacuagauaugaagaagcugaaguccggaaaaaacuugaggaaaaagacaggcaggaggaagcacagcggcuacaacaaaaaaggcaggaaacaggaagagaggaugguggcacauuggcuaaaggcucuuuggagaauguuuuggauuccaaagacaaaacccaaaagguauuucaaauuuaaugugugaguuaaaagacuguuucugcuuguuagaugauuugcuuaaaaagaguugagauaccacuauaaaguucuuuuaggcaacaaggaugaaauuuaauguuuuaauuagaaauuuauuuaaggcugggcacgguggcucacgccuguaaucccagcacuuugggaggccgaggcgggcagaucacuugaggccaggagcucaaaaccagcccggccaacauagcgaaaccccgacucuacuaaaaauacaaaaguuagcuggaugugguggugcaugccuguagucccagcuacucgagaggcuaaaguaggagaauugcuugaacccaggaggcagaggcugcagugagcugagaucguaccacuccacuccagccugggcaacagagcaacacucuugucucaaaaaaaaagaaaagaauuugaauuaaauauucuagccucaguugacuucagauuuuucugugaauuucuauggcaauauuuucucugcauuaauucguuuuuuagcagacauuauaaacuuaauuagagcaauagaaaaaucauuugagcugagcugugauuuauuauaucugcauucugguccuaugucaaaacuuuuuuaaccacucugggacucaguuuucuuguuucccaaauuauagucuugaaauagacaauuuuuaaguuucuucuuucuaaucauguaauuuacauuaaaagauuuaguauacuacuuuguuugguaccaagccuuuuaucuguuucugaggucucauucuuuuuccuuugcuuucuccuucuuuuucucccccaguucccccacccccccccuuuuuuuuuuuuuuuuuugagacagagucucauucuugucgcccaggcuggaaugcaauggcgugaucucggcucacugcaaccucugccucccagguucaagcgauucuccugccucagcuucccaaguagcugggauuacaggcgcccgccaccacacccggcuaauuuuuguauuuuuaguagagaugggguuucaccauguuggccaggcuggucucgaacuccugaccuccagugaucugccugccucagccuuccaaagugcugggauuacaggcaugagccaccacaccuggcucuucuuuuuuuuuuuuuuuuuuuuuuugagacagaguuuuacucugucgcucaggcuggagugcaguggugcgauuucagcucgcugcaaccucugcuucccggguucaacuaauucuccuaggcuucagccuuuugaguagcugggauuacaggcacccaccaccaugcccagcuaauuuucguauuuuuaguagagaugggguuucaccauauuggccaggcuguucuugaacuccugaccucaagcgaucuacccaccuuggccucccaaaguguugggauuauaggagugagccaccacuccuggcuucucccauuuuuucacaucuauuuagugacuacuuguggucuuuucagcuacaucaucucuuugcuaaaagccaucagugacuuagucuguagcugccagcuaucaccguaccucccuuccuuuaccuccucagaaacuacucuuccuaaaauauaaguugaaauccaugggaaaauuucugcuuugauuuuuuucuuagacauuuuguagcuuucaguuaucauucuguguggaucaucauuccuuucauuaaaaagucguuguuggcugggugugguggcucacaccuguaaucccagcucuuugggaggccaaggugggcaggucauuugaguccaggaauuugagaccagccugggcaacauggaaaaacccugucucuacaaacuuuuuuuuuuuugagaugcaguuucgcuuuuguugcccaggcuggagugcaguggcgcgaucucagcucacugcaaccuccaccucccagguugaagcaauucuccucccucagccuuccaaguaacuggaauuauaggaaugcaccaccacgcccggcuaauuuuauauuuuuaguagagacaagguuucuccauguuggucaggcuggucuugaacucccaaccucaggugacccgcccacuuuggccucccacagugcugggauuacaggcgucagccaccgugccuggccucuacaaacauuuuuuaaaaaauuagccagucaugauagugcacaccuguagucccagcuacucaggaggccaaggugggaggaucacuugagcccaggagguccaggcugcagugaucaugcaacugcacuccagcuugagcauuagagugagacccuaucuccaaaaaaaaaaaaaaaaaaaaggucuaaguggguccuuuguuuccccauggauaaaaugaguuaguaccauacaggauuaucccauguugucuugguuaaaaaauguaaacuacauaggccgggcacagcggcucaugccuauaaucccagcacuuugggaggcugaggcaggcauaucacaaggucaagagaucaagaccagccuggccaacauagcaaaaccccaucucuacuaaaaauacaaaaauuagcugggcgugguagcacacgccuguaaucccagcuacucaggaggcugaggcaggagaauugcuugaaccugagaggcagagguugcagugugccaagauggcaccauugcaauccagccuggccacggagcaagacuccgucucaaaaaaaaaaaaaaaauguaaacuacauaagcaauacuuuguauuaguucauuuugcuuuaauuaugugguggaggacacugaaugggauagccagaauuuuuguuugauuguaagaaguacuuucuaaucaaauuaaauauuaaauuucuguagcaguuugugcuguuaaauuauauuuggucuuuaauugaaguaaauuuugaggaaauguucuaugauucugaaagauugcuaguuauuuuagcuguugucuacugccaaagaaaccuuuuaauaucauuauuauucgucugcguuuuuauaaaaggccaguacucugcacaguucguuucuuagaguuuccauuuaagagaaguaaaugaaguauuaaaguugaauuuuuugugucuaugaaaguugaaacuuuuuuuuuuuccuaugcaauagagcaauggugaaaagaaugaaaaaugugagaccaaagagaaagguaaguguguacagaaggaggaaguuguuuuagguucugacugagaucuuuuaaucagaauaagcaucagguuuuauacaaugagauucuuagcauuguugucuaaucucuauguaagcuuuaucauuuuuccuagucuguacaauuauauugaaaaugucugagguuauuuuuauguauuuaucauggggggauauuuuaugaauaauuuuaaccuuacauguuaaacuggucauaugcaguugaaaaaugucaaaaccaaagcuuguacuuguuuucuuuucaacaugcaguuuagcaauaaugguuaagagcauggacucucagaagucaaacugccggaguuugaauacugguuccuccucucccuuuccgccugguuuucagaauguugcuuaaacauucuaccuuuguuuccuugucuguaaaguggagauaauaauaguacuuauuucauaggguuguugucaggguugaaugagcuaauauauguaaauucuuagaauacaugguaaacuuuaaguaggacuuauuaucauuuaugacuagguuguagauuuaauuuuuucuccccccauccauccuguggucaaagacuaaauuauuuaacagucauuuacaucccccauaaaaaaaaaaucgaggccaggcgcaguggcucauuccuguaaucccagcacuuugggaggcucaggaaggaggauugcuugagcccaggaguucaagaccagccuagguaacauggugaaaccccugucucuacaaaaaauacaaaaauuagcuggguguggugguggaugcccuuagucccaucugcucaggagguugaggugggagaauuguucgagcccgggagguugaggcugcagugagccacgaucacaccacuguacugcagccuaugacagugagacccugucucaaauccaaaccaguaauauggaaauuauccauagguggcguugaugcucuagugacaaauaugugaccuaaacaagacuuuggaauuccucuucaucugcuagagacguuuuccucucucagaaaagguuuaccuugucuacagccauaccaccuaacgcgcccgaucucgggagcgaagcagggucaggccugguuaguacuuggaucagagaaaagguugaacuuaaacauaauuauagguaacaguaaaauaaauucucuacuuaaaauauugccauacaacaauuacaaaaguaaacugagugugcuauaagguacuucccuaaaagcuguuacugauucauuccaagauuaguuuuuaugcauuuguuccuuuguaugucauccugcuuaaauguuguccuucucagugguuuguuaacaacuuuuuuagucuguuuuguuagcauacacuugauggcuagagauggaaggaggacgauuguuagcagcuauaggucuuuuagcauaggagcuacugagacuacuuuucuucucacagcucacugcugaaacagcuuauuauauaaucucaacucucuuguagugccuuuuaaucuuucacuucaguagagcuaaggaaaaauaguaacauagggaauauuuauuuugacagauugcugcccucccccaaaaguaaauaaauuaaauauugcauuagcuuuacuuaguuuccuuuuuguuagccuucuuagaaaacaaaauaaucuuuuuuccuucuggcugggagcuaacaaaugaacaucaaguagaaugacaauuggcaaauuuuucuuaaagggauagaugguaaacauuuuaggcuuggggaaccuuaugggcuuggagaguccuguggucucugacacaacuauugaucucugcuguugcaguaugaaaaaauguguaaacaaacuaguguggcagugauccaguaaaaacagauggccauaguuuuucaaccucugauguagaauagcaagcuuuugacuuguuauucuaagaauacuuggauaucuaaguuuuucaaaaagcuaccguaagacugccaucagagaccuuuugaauuuagaacuuuuccagaauuuuagaaccauagauauuucuuucuuccaguuagcauuuuucuaaugucuuaauuuuugaaaacauacuauuuuccugagacacauauauuaauguucuuuauuuuauguugguaacagagucaauaccagguguagcuguaaacucaacagaaaguuuugauuuuuaagucuuuguaaacagagcaucgaacugguuucuugauaaauguuaaaaacacaaggucagguaugugguggcucacgccuguaaucccaacacuuugggacgccaaggugggcagaucgcuugaggucaggaguuccagaccagccuagucaacauggugaaaccccaucucuacuaaaaauacaaaaauuagccaggcgugguaacagccuguguucccagcuacucaggaggcugaggcaggagaaucacuugaaccugggagguggagguugcagugagcugagaucaugccacugcacuccagccuggguuacagaacgagacccugucucaagaaaaaaaacaaguuguauuuaauguuaguuuacaagauaauaaaugguaugauggaguaguaaauauguggcauccauauauauucaguauacuuugcucuucuagaaaaagcgguuuguccuguguuuugugaugucagcacaucuugugcuguuucuugucacuuacacugucucucucaauuccaaggagcaaucacagcaaaggaacuauacacaaugaugacggauaaaaacaucagcuugauuauaauggaugcucgaagaaugcaggauuaucaggauuccuguauuuuacauucucucaguguuccugaagaagccaucaguccaggguggguuauuguguaguaaaguaguaaacuguguaguaaguaguaaacuguggaccuuaguaaauguuacuacuuagcauccaagcuaaaugugauaaaguagucuuuuccugguaacuuuuuaaaucuuugccucuuuuuauguguguggguggugggggaggggagggggagguacauuuuaggagcagagguuuaauaggcaaaagaaagagaaagaagaacugcucucucacuuuugagagugaggggugcccaagugggauuucccuaaaucuuugcuucuuaaagacacacuccacccuuuuugaagguugaaguuacggauuugccaacuuuugauuuggcuguuuucuccuauuggugguauuuagaaucuuaucaaaagagaaaugaaguugccuuuucccucucuccccagauguuuguuaacugauuuuuccuauuauuuucuguuuauaagcaugugaaucguauguaccaaauugauuaaaauaaugaacuaauugaauuguuuuacauacugaaauucccuauauuuacugugauacacgcuacacaaauacuuugugugugcuuaaguuaaaagaguauagucucugaugccagacucuauucaaauaacugucacuuacuaguugcauuauuacuagguagugaccuaacauuucuaagcucagguuuccaucuguaaaauggggauaauaguagaacauaucuuacagagguuucaggagauuuaaaugagaaacauuauauacacauacacacuuuagcacagguccuggcacgaguaaggacuuaauuuaaauuuuuuucuuucuuuuuugguaagaaggccuuuaaccuaugaaauaauuuaaagugacuugcauggguauauuguauauuggaaaucauggcauaguggcagagcuaaaccuccagauaaagggcuauuuucacuauuucgagcauucuuaugcagauccuauuaccucucuuggucuugguuuaaaauuauauauuuuuaaaauuagguaauaaaaucuguauaguucuuggcauauugcagaugcuugauaaauguuugaccugaagcguagagugcuuuguaaauaagcuauuuaaaaauuagagcucuuaggccgggcacacuggcucacaccuguaaucccagcacuuggggaagccaaggcaggcggaucacuugaggucaggaguuccagaccagccuggccaacauggugaaaccccaucuuuacuaaaaauacuucagccaggugagguggcguaugccuauaaucccagcuacucgggaggcugaggcaggagaguggcaugaacccgggaggcggagguugcagugagccgagaucacggcacugcacuccagccugggcuacagagggagacucugucucaaaaaaaaaaaaaaaaaaauuagagcucuuugaggaagacgcuguugaagguagugcugagcuguggucagcccgcuccugcuccugcuguacugcuguugcucucgcagaggaaccggucggucaggaagccgcacagcagccguggcuuuuaaagaugcuggaaaaacacccauggagccggagauagcaauucacugaauucgaaucacucucuaugagccacagcauaaaaucccuggagaaggugugugcugacuugaucagaggagcaaagaaaaagaaucucaaagugaaaggaccaguucaaaugccuacuaagacuuugagaaucgcuacaagaaaaacuccuuuuggugacgguucuaagacaugggaucauuuccauaugagaauccacaaacaacucauugacuugcacauccuuucugagauuguuaagcagauuacuuccaucaguacugagccaggaguugagguggaagucaccauuggagaugcuuaagucaacuauuuuaauaaauugauuacugguuguuaaaaauauauauauuagaguacucagucuaauuaaacaugugaauauauucccaggauuugaacagacgaaguuauaauuagucuuuggguagucuagucuguauuaauagagagcugguggucguuauuacugaguuuacauggaaguuucccaaaaugugagauuuggacuacuaugaaacucaagaugauuuuagguugaagauuaaagaacaaugaaaugcauacugagaaaauuauucucuuuuaauuuauguuacaguccuuuugaguuaguuuaaaggaguuucaguuuggugcuaguauaucuuuuaaauacuugcuuaucucucuuaacugaagggaacaggucucagagcuuucuguagguuacaguaccuacaacuagcugauagugauuacuguauuuuuucauuaucuauuuuuauuuauuuauuuuugagacagggucucacucugugccuggguuggagugcaguggcaugauuacagcucaccgcagccuugaccuccuggguuuagaugauccucucaccucagccuccuggguagcugggaauacaggcacaugccaccaugcccagcugauuuuuguauuuuuuuguagagacgggguuuugccacauugcccagacagcucucaaacuccugggcucaaacaguccucccaccguagccucccagagugcugggauuauagaugugagccauugcacccggccuaucuguucuuaaaauuuuaagcuuuuuauuuuauuguauuuauuuuaauuuuuuaaauuuuaauuuaauuuauuuauuuuuauuuauuuauuuuugagacagagucuugcucugucgcccaggcuggagugcaauggugugaucucggccaacugcagccuccaccucccggguucaagagauuucuucugccucagcccccugaguagcugggauuacaggcacgugucaccuugcccagcuaauuuuuuaauuuuuacuagacacuggguuucaccauguuggccaggcuggucucgaacuccugaccucaaaugauccaccugccuuggccucccaaagugcugggauuacaggugugagccacuguaccuggccuuuuuuuuuuuuuuuuuugagacagggucuugcuguguugcucaggcuggagugcaguuguacaaucuuggcucacugcaaccucugccuucuggguucaauugauccucaugucucaugucucagccucccaaguggcugggauuauaggugugcgccaccacacccggcuaauuuuuguauuuuuaguagacacaggguuucacuauguuggccaggcuggucuugaacuccuggccucaagugauccaccggcaucggcuucccaaagugcugggauuacaggugugagccacggugcccagccuauuucuuuuuuaaacuuuuauuuuagguuuggugguacaugugaagguuuguuacauagguaaacguuuucacggggguuuguuguacauacauauuuuaucaccgagguauuaagcucaguacccaauaguuaucuuuucugcuccucucccuccucuuacacuccccccucaaguagaccccagugucuguuguuuccuucuuuguguucauaaguucuuaccguuuagcucccauauucuuaacuuuuaauacauuauaguauauauaccgaaguacuccugucuuaagugucuagcccaaugaauuuucauuaacugaaugcacccacuuaauuggcauccagaccaagaaacaauguuaucauccccccugaacccgauauacccccuguaaguuacuacccguaucccacugcccaaggaaaccaccaguuucugacagaauauauucuuuuugucugcuuuuguacuuuauauaaauggaauuuauaauauguagucuuuuauaucugucuucuauacccaaccuguguuugugacagucaucuuuguuauuguguguaguuguaguuuguucauucucauugccauaugauguucuguugugugaauauagcgcaauuuacuuaaauauuuuauuuaucuucagacauaccuuuuacuuacuggauaugauuucguuuuuucauguauuuagggcuauacaauuuccuauuaaauuuauuuaaguaaaaaauuauuuuuaauuaaauuaauuaaauuuaauaaaagacaaguagagcagaguuggagcagauugugaagaugguacauaaaagacagaaguuugagaaauguuggcugauacuguuguuucccaaaguguuuucuguagaauacuaauccugaaaacaguauuuagguaaauauaccccuaggguuggaaauagucuuuaagaauaucacauuuuauuuuuuuuccuucuuuguugaccaagcauccuucugaucuguguacaucaggagaggauauuaguagacaauauuuuauauuucuucuacuucuuuacuuccuggaagauacaguaaccaacauuauuauauaggaacuggauuucaaaauuaaaaugaucuuauuugguuuuacuuguggauaaaaguuguaccaguccggcccagcuugccaguaucaucaguuaaauauugaaaugccacgauauacuaagugcuuugcuaagaauaauauggagcuccuuacccagagguguaaaucuguauuauucacucauucaauuauuaaauccaauuuuuuuuuuuuuuuuuuugagacagagucucgcucuucacccaggcuggagugcaguggcgugaucucggcucacugcaacccccaccucccagguucaagcuauucuccugccucagccuccugaguagcugagacuccagucaugcaccaccacuuccagcuaauuuuuguauuuuuaauuagagacaggguuucgccauguuggccaggcuggucucgaacuccugaccucaagggaucagccagccuuggccucccaaagggcugggauuacaggugugagccaccgcguccagcugauuaaaccaauauucacugaacacuuucugugggcuggguuacuguguucuaagugcugggcuaagccauugaacaaacaaaaaauugucuuuggagcuuuuaacagagaggugagauagguaagacguacaauaaaagcuugaaauguuuaguuugucuuauguugagugccuuggaaaugggaauaucaugugugcgugugcauguguguguguuuagaaaggccucacagagaaguuauuagcaaaucuugaagaaauaagggaaaugagugaugcagcuaucugagggaagcagauuccagacagggaaaaagccagagcagaggcccuuagggaagagcaugccuggaugaaccaggaauaacaagccaguggcuggagcgagugaagggggccaguaguuagagaugaggacauugaggcuugaggguguaugucuguggcaggccauugugaggacuuuagcuuuuuuuuuuuuuuuuuugagacagagucuugcuuugucgcccaggcuggagugcaguggcaugaucuuggcucacugcagccuccgccucccagguucaagcaauucugccucagccuccucaguagcugggauuacaggcgccugccaccaugcccggcuaauuuuuguauuuaguagagaugggguuuuaccauguuggccaggcuggucuugaacuccugaccucaggugauccacccgccucagccucccaaagugcugggauuacaggcaugagccaccaugcccagccggacuuuaguuuuuaugugagcaaacgaugaugugaacauugugcuuuaauggagaguugguguuauucacaguugacgguuuuaagaggcagcauagcaaagaacauguacaugagccagauugccugaauuuuaauucuggcuccacuuaccuugagcgagucacuuaaucuguucgugccucaguuuccccaaaauagaaauaauaauguucgucuuacaggauuguugugaagacucaaugaguucaaugagaauaaagcauuuagaacaguaucuggcacaugguaaaugcuauauguguuuguugaauaaacauccugguauaugguggacuauuaauuauauagguauaagagaacugaaauaugaauaauacuacccaggugauuccccaguuuauauuuggcugaaagaggagcucagauaauuuucucuguuuucaguuuugcuccccccuugacuuuuuuuaaaaggucagaaugaaaagaauucagucuucuuuuauagucucuaauaacuacuaaaacuauguuccaauauuauacaguagugaagggguuaaacauguuaggcuguuuaauaucuuaauauauaaccucaccuuagaaaggaaucuacuuaaaauuugcuauggugugguaaagacuguggaacaaaacugagugucuucuguuaguauauuaggaccucuuguugacuuuugccccaauuuaaauauuaauacauuucagagucacugcuaguuggauugaagcacaccugccagaugauucuaaagacacauggaagaagagggggaauguggaguaugugguacuucuugacugguuuaguucugccaaagauuuacagauuggaacaacucuccggagucugaaagaugcacuuuucaagguuugcaaguuucauuguuaguuuauuguaauugcagggcaucucugguuguuagaaaggcauguuaacuaguuguuuaucuuaaauacuaaaagauucaucaugccuuuuuuuuuuuuuuuugagacugagucucacucuguugcccaagcuagaguacaguggcgugaucucagcucacugcaaccuccgcgucccagguucaagcgauucuccugccucagccuccugaguagcugggacugcaggcgugagccaccacaccaggcuaauuuuuguauuuuuagaagagaggggguuucaccauguuggccaggcuggucucgaacuccugaccucaguugauccaccugccuuggcaucccaaagugcugggauuacaggcuugagcagcugcgcccagcccaucaugcuuugauuguagaauuuuuuauaaauucagguuuaaaagauuuguuuuggcugggugugguaaaauuaaaacuuagguggaaaaagaucuuauaagauuacaagauggccaggcgcgguggcucaagccuguaaccccagcacuuugggaggcugagguggguggaucacgaggucaggagaucgagaccauccuggcuaacacagugaaaccccaucucuacuaaaaauuacaaaaaaauuagccgggcgcaguggcgggggccuguagucccagcuacucgggaggcugaggcaggagaauggcaggaacccgggaggcagaguuugcagugagcagagaucgcaccacugcacuccagccugggagacagagcgagacucugucuggaaaaaaaaaaaaaaaaaauauugcaaggcagggccaggcgugguggcccaugccuguaaucccaacacuuugggaagcugaggcgggcagaucaccugaggucaggaguucaagaccagcuugaccaacaugcagaaaccucgucucugcuaaaaacaaaaaauuagucgggcaugguggugugcaccuguaaucccagcuacucagaaggcugagguaggagaaucgauugaacccgggagguggagguugcggucagccaagaucacaccauugcacuccagccugggcagcaagagcagaacugugucuuacacacacacaaaaaaagauuacaaggcagaagacaggcagaaauauuuacaacacauauggcagugguuuaaaauaccuaaaauccaaagagcuucuacaaauaagaaaaauacuuaagauaaaauaguaaaauaagucgugggcacagauagccaugaacagaaagugaaaugcaaguggacguaaccauaaaaauggcaacuuuacuaguaucagauaaaugcauauuaaaacgagugccauuuucacugaucaaguuaacaaagguuuaaaaaauaauacgguuguccucaguauuugugggggauugaugcuaggaccccccacaaauaacaaaauccauggauauucaaguuucuuacauaaaaugguauaguauuugcauauaaacuacacauauucucucauguaauuuaaaucuucuguagauuccuuauaauaacuaauaaaaaguaagugcuuuguaaauaguuguuauaccauauuguuuggagaauagugacaagaaaaaagucuguacaugcucaguacagacauaaccaucauaggccuaacuauauauuuuuuaaauuuauuuguuuuaauuuuaauuuuuauuuuuuuaagagacaagguuuuucucagucaccuagacuugagugcaguggcacaaucauagcucacugcagccuugaacuccuggcucaagugauccuacugccucagccuccugaguagcugggacuacagguacgcaccaugccuggcuaauuuuuuaaaauuuucuaguagagacaagguauugcuauguugcccaggcuagucucaaacuccuggccucaagcauuccucccaccuuggccacccaaaguguugggauuacaggcgugcaccacuguguugggcaucuaaguauauauauauauauauuuuuuuaauuuaauuuaauuuuauuuauuucgagauggagucucacucugucacccaggcuggagugcaguggugcaaucuuggcccacugcaaccucugccucccagguucaagcaauucuccugccucguccuuuccaaguagcugggauuacaggcgcccaccaucaugcacagcuaauuuuuuacuuacuguuuuuugaagacauaucuuacucuguugcccaggccaaagugcaguggugccuucucagcucacugcagccuugacauccugugcucagguaguccucccaacucagccuccugaguagcugaggcgugcgucaccauccuagcuaauuuuauuuuauuuuauuuuuguagagaugagauuucacuauguugcccaggcuggucucaaaacuccugggcucaaacaaacuccugccucagccucccacagugcugguauuacaggugugagccaccacacccagucaauuuguuaaauuauuaacaaugauagcacugaaugcuggugagcauguggugagaagaaaacucauucugcugguaggagggucagcugauugccguugagaaagucggucuuaaaagccuuagaacaauucaugcuaugacauagggaacccagaaauauaccuaaguaugggacaauuauaugaaacugccaguauucaacuggcauugaccuacaaauggcaguuuggcaguuucauaaaguucaaacuaagauaugugaaugauuaguguaugauaaaggugacauaaaucaaugaagaaaagauggauugaaaugaaugguuuggggacaacugcccagccaguaaauaaaagagaauggaucccuaccuuauuucuuagaccaagcuacaucucaaaugaauagacgauauaaauguauagauugaaacagcgaacuauuaggagaaagcauugguauuuuuuaguaccuugaugucaaaucaagaugucauaaaggaaaaugaagacuguguuuauggcuggccgcgguggcucacaccugugaucccagcacuuugggaggcugaggcagguggaucacuugaggucagaaguuggagaccagccuggccaacauggcgaaaccccaucucuacuaaaauuacaaaaauuugccgggcaugauggcgggcgccugugaucccagguacugaggaggcugaggcaggagaauugcuggaacccagugggcagagguugcaaugagccgagaucgcaccacuucacuccagccugggcaaaagaacaaaaguccaucucaaaaagaaaagacauuuaacuauguuuaaaaaacaaaaacauaaaguaaaaaucaggaaaaauguuugcaauauauaugacaaagaccuguuuucccuaauauucagaguacauucacuguuuacuaaaaaaauugcaaauaacuauagaaaaaggggcaaaggauacaauuauuaaauaguuaagucauagaacaauauaaauccauaguaaauaaaugaaaaaauguccaacuucaccaauaaagaaaugcuuauuaaaacaagauaccauuuuauguucaucaguuuuguaaaaauuauaaagauguauaaugggcauucucauauccuguugguuaaguguauaaauugguauagccuuucugaagggcaacugggcaucauauuaaaccagcaauucuacuccuagguaauuauccuaaagaaauacauauauauacauguauauauacacacacauauauguacacacacacauauauauauauuuauuuacuuauuuauuuuucgagaugaagucucacucuuaucccccaggcuggagugcaguggcgcuaucuuggcucacugcaaccuccgccucucggguucaagcgauucucuugccucagccucccaaguagcugggauuauaggcgccugccaccacgccuggcuaauuuuuguauguuuaguagagacgggguuucaccauguuggucaggcuggucucgaacuccugaccucaggugauccucccgccucggccuuccaaagugcugggauuacaggcaugagccaccgugcccgaccaauauauuuauauauauuuuuaagugaucauuucuaagauuagcaauauauugaaaaccuuaaaauguucguguaccuuagcuuaagcaacucccuuucugggaguuuuccuuaaggaggugacuagguaugugcauguauaaggaucuuuuguguuuauuucagcauugcuuauaauuaaauggggaaaaaacccaaauguucaaacgauugacucaguuuuggggucuguguauaaaguagaauaggccaugugcagcggcucacgccuauaaaucccagcacuuugggcugagccaggucgaucacuuaagcccaggaguucgagaccagccugggcaacauggcgaaaccccagcucacgaaaaguacaaaaauuagcuggccguguuggcgcgugcuuguaagucccagcuacugggaaggcugaggugggaggaucaauagagcccaagaggucaaggcugcagugagucgugauuaugccguugcauuccaacuugggugauagagugagaccuugucaaucagucaaccaguagucgaauauuaccuagcauugcaaaugaugauauagcucuauagugaugaaagauguucauagaaaagcaacaucauaaagguuuuauugaaaacucucuauaagaguaaacuccagaauguaaagugguauugggguggugagguuaugggucauuuuuguuuuauauuuaguaauuuauuuucuaauuuuucuucuaagaucauugauuauuuguaugguuuuuaaaaccucaccuauauaaccauuucauuuaauguugaauuuugaauucaguucucauuuugucauuauuuagaagauaaauuuuguccuuaagggaacaacuuuaaaauuuagauuuguuguguuuuuagcuguugaaagauugcugcccuauuuaaaauaugauuuccuuauuuauagugggaaaguaaaacuguccugcgcaaugagccuuugguuuuagagggaggcuaugaaaacuggcuccuuuguuauccccaguauacaacaaaugcuaaggucacuccacccccacgacgccagaaugaagaggugucuaucucauguauguaugugaaaauuuuuguuuaaaauugcuuugguaaaauaugguuuaaaauuguuuucccgguaacauucuugguuguguguguauuuguccuauuagagagcaguuuguuuucaggcauaaaaauauaagccuggaaguucacauuuucuuuaagacuguuguaauuguuuuuucacuuaguuuacauuuaauuacugcauuaacacgcaugagaaauguaaguacuguguaugggguuugcuauucuaaaaaacauuuuuauuuuuggaauuuuaguggauuuuacuuaucccucauuggaagaaucaauuccuucuaaaccugcugcccagacgccaccugcaucuauagaaguagaugaaaauauagaauugauaaguggucaaaaugagagaaugggaccacugaauauaucaacuccaguugaaccaguugcugcuucuaaaucugauguuucacccauaauucagccagugccuaguauaaagaauguuccacagguauguucuugauuuuaacauuauucucgcuuuuguuuuaauauuaaauauauaguauagcugggcacagugccucacgccuguaaucccagcacuuugggaggcugagaggggcagaucaccugaggucaggaguuugagaccaaccuggccaacauggugaaaccccccucucuacuaauaauacaaaaauuagcugggcaugguggugggugccuauaaauccagcuguuugggaggcugaggcaugagaauugucugaacccaggaagcggagguugcagugagucgagauugcaccacugcaccccagccugggugacagcaagacucugucucaaaaaaaaaaaaaagaauuaaauacauaguauagaaacgaaguuuaauauauaaccuuuaacaucuuagaaaaaaguaucgaugagaacagucuguauguuuugauaaauuuuuuguuuaaaaauuuuucaucauaauucagcauuaccgccacgccuauauuagaguagauaauuaagggguuuccaagccaguuggcgauccauuugcuacaaacaaugccaaugaaagauugcauuaucacagugaauuagaauagcccuuuugggauuuuuuguauuauaauuugacccauauuauuuucauaaauagcuuggcuuacauaugauagguaugugaugucaguauuuugguuuuaaaacagugcuuuaguuucauuuccuuagaauuugacacgcaaauaacaggcauguuuaacaauaaucauguaaaaguuuuuaaauaaccaagacauuacaaauaaaaaaauuuuaguuuuuauauccuucauuuggcuuuauuuaaagaaagguuaacuaauguucccccuccaugcauuucccaauaacauuuuuuagcauucauuuuuaauuuuuuccccagauauauuuaaaacaguauuucacauuuaaaguggaugacguuugauuuguggagcagguauugaauagaaaaucugguaauuuuuuguuauaaacugaagugguucauuucuucauuuuuuuaaggucuuuuaguauugcagaauaaauugcagacuaaauagaugugauuaaacaacuuuucuuaaagggugaauuuaggaaagucuaaaaagagcuucucuauguuauugcauuuccuuucaacuuaaucuauuuaaacgcuaauccuuuugugucccaacauaacuuuaugagauacguacaauuuucagacauauuuugaagaucuucuauauaaaaaacagcaugagggcugggugccauggcucgugccuguaaucccaacacuuuaggaggcggaggcaggugggucaccugaggucaggaguuccagaccagccuggucaacauggugaaaccccaucucuacugaaaauaccaaaauuagccaggcgugguggugcgugccugcagucccagcuacucaggaggcugaggcaggagaaucacaugaacccaggaagcagaguuguagugagccgagaucaggccacugcacuccagccugggugagagugagacucugucucaaaaaaaaauaaaaauaaaaauaagacagcaugaaaguuuguauauacaagagauggguucuucugauguuuggaaggagagaucuguauaaaaucagccacagcauaaggcagaauaucauaauugcucuacaaggcacuggagcacagagcaaggagaauauucuagcugagaagaucaaggacgucuucauggaggagacaguauuuuaucugggcuuuaagaguaggauuggaggauagaagaaacaaguagaaaauucuaugaccaaaggcauagggcaugcucuggggccagugaacaguuuuggcauaugugggcgcuagucucuguuggagagaggaaguuaugauaguagauaagauuagaaggauggacaagagucaucaagagagacuuggaucaaauuugaauuuuguccuguaggcacaaggaaccauuaaagaauuuuaaacuugagaguaacaugaucauaacuauacuuuuaaaauuagggaaaaauagaucaagccaccaaaauguaaauggaaacaacauuuauuuuuguuucuguuccaccucuuauuguuaaccucauccccauagugguucuuccuacuuuauucucaaauacaugcaaaaaaaaagacaaaggauuuuuuuuaagaggcagaaagagaagugaacaggaaaaaaauuauuuuuucuacacuaaccucguuuucuuuuucuuuucuuuuuuuuuugaaaacggucucacucucucacccaggcuggagugcaguggcgugaucacagcucacugcagccucgacuuccuggguucaagcaauccucccaccucagccuccugaguagcugggauuauaggcacaugccaccacgcccagcuaauuuuuguauuuuuuuuguagagaugggguuuugccauguugcccaggcuggucucgaacuccuggccucaagugaucuauccggcucggccucccaaagugcugguauuacaggcgugagucacugcgccuggcaacuucuuuuauuuucuaguagaaaaacauaaauucguuuuguaagaacacuauguagauuguuauuggcacauguucuuauaaguuuuuauuuuucuuucaguacacaguauucucaagaaaugauguuagggucacuucucuaguguuaacaugcuguuaaauugagguaauaaacauuuaacucauuaaaucaggaacuuagguaguuuauuacacaaccugaaggaaacuaguuaguauuuuaccucauguaaaaguuuuuagggaagauugcauuuguucccucaguaacauaguuacuaacugugccaggcacagucuuuauccuuuuagagcuuauauucuaggagggaagaaaaauuuuaaauaaguaauuauaguuauuugaucagaauuccgguagagaagaauaaaguauuauaagagcauguaucaggggacuuggcuaguucuaggaaccagggaagucuuuucagagggagagauguguaagccaagaccuaaugugggcauuaucuagaugaacagcugauagaccuaaguugggaaggagcauggcaucuuggaauaauuuuuuuuuuaaggcaaguauagcugguauacacagccauaugacuggagagguaggcagauguaagaccauacagggcauuacagacuaugguaaagauuuuagguguacugagagcauaguggguagcaaaucaaauuuguuuuaaaaugaguccucuggcuauaauguggagaaacagauuggggggcgggggcaagagaagagaugggcaacuaguugaaagcuaugcuguaguccuggugagagaggagguugacauggucuuagccugugguagaagagauggagggacagauauaggaggaaaauuaacagcgugcagaaggauaugggaagaacauaucaugggacucagguuuuugauuugugcaacuauugggagagugagagugguuacauccaugagauuaggaccauguuugucgggguggggggaaucgugaauccguuuuggcuguaugggguuugagauacauguguugacacucaaauggaaauauuggguaggcauuuggauaccuggaaguggaacuuaagucuaaguaugcccaggucuagguuuuauguuuuagaauaaagacauuuuuaacucuuuuguauacaaaacacucaggaagaauugaaaguguugaaucaagaggauguaaguuccagugauguuugaauaucuaccauucaaguucuguuuuaugagaaaucuugacacugaguaauuaacaaauagaugugcugauagauguugucuccacaaagugacacuucuuuuaucacaacuugaucucaagaacugagguuauuuccugauuuuugacaaaaauguuuugcucugguuuuguugcucuagauugaucguacuaaaaaaccagcagucaaauugccugaagagcauagaauaaaaucugaaaguacaaaccaugagcagcaaucuccucagaguggaaaaguuauuccugaucguuccaccaagccaguaguuuuuucuccaacucucauguuaacagaugaagaaaaggcucguauucaugcagaaacugcucuucuaauggaaaaaaacaaacaagaaaaagaacuucgggaaaggcagcaagaggaacagaaagagaaacugaggaaggaagaacaagaacaaaaagccaaaaagaaacaagaagcugaagaaaaugaaauuacagagaagcaacaaaaagcaaaagaagaaauggagaagaaagaaagugaacaggccaagaaagaagauaaagaaaccucagcaaagaggggcaaagaaauaacaggaguaaaaagacaaaguaaaagugaacaugaaacuucugaugccaagaaaucuguagaagauagggggaaaagguguccaaccccagaaauacagaaaaagucaacaggagaugugccccauacaucugugacaggggauucagguucaggcaagguaagcagaaacaguacaaauugccaacgaagugaaagaaaauguauaugaaaaugugaaaacaccaguggcauuccauaaaagggcaggcauuucaaauagucuuuucaggggugauagaauguacugaucuauccacauuugcucaucuauucuccuuugaggccagugccauacauuuaugaaaugauugguugggaaugaaauugcuuuuuguauauuacaucuauaaaaugcaauauauuucaaauaauugagauaaauagcuacauucuucauuuuuauguuugauguaugaucaugggaagacuagagugaaauauaaucuccuucucaguauggggaaacuagaugcuaauauuuguaugauagaauuuauaucuguuuagaauauauccaaaaucagugacaucuaaauggccuaacauuuaucuuugcauauagugauuuuuuggucagaucggugucauuuuguuucuugcuuuaucuauuuaaauaauauuggcaaauaacccaauuaauuuugcccuuggcuacacacccaaaauugauagccguaauuuuaggggacuuuuuuuguuauucuuuuucaaucucuaauaaugcuaugcuuuucuuuuuuucuucauuaugucauuaacaaugccuuuuccuuuugaacaccaaguauauguuuauaauaccaagaacaguuaugguccuuuuuacauauguauaaauggaaaaaacauuuuuaguaguguggaaaugacuucuaauggaaggcgggauaccaucuuuacagaaugucaauuucuauacuucucaaacacaauucaggcauguuaccaaaauuaauucauagucaagcugcucuuauccagggaacacuuaucugguaaccucugcuauuaaaaaagauagcuuccauccaaaaaccuucuaaacaccccaaauuggggauaugaagcccauguacuaaaacucucuaauuuuauucacaggaggagcaaaacaugugcacuccaagauacaauuuaaguauuauucauugaguagcuacuauaugccaaguauuuucacugcauugucuuauuuaccccuaaugauaaccccauaagguauuuaauuuacaagugaaacugaaguuuagagguuaaguauuugccuaggaucacauagacagugagauuccaaagccacuucuuuuccaucuugcuauacuagaggcaugcagucuuuagaacuuaaaucauucauauuuguggagucauuuaguauauaggugccaaauauuccuacacaucuaagauugcauucuuugugugcuccuuuuaaaaguaggagaaauauguaauuuauucuagaauaaauuuuguuaaaauuaucacuaauuuuaaaaaguuuuuaguagaguuauuuuaaaauaagauauaaaacaaaaaugaguuuuuaaaaagaaucuacgggccgggcgcguuggcccacgccuauaaucccagcacuuugggaggccuagacgagcggaucacuuggucaggagaucaagaugauccuggcuaacacgguaaaacccugucuccacuaaaaauauaaaaaauuagccaggugugguggcgggcgccuguagucccagcugcuugggaggcugaagcaggagaaucacuugaacccaugaggcagagguugcagugagccaagaucgugccacugcacuccagccugggugacagagcgagacucggucuccaaaaaaaaaaaaagaaucugugauguuauaagaagauaugaauauagauuuuugcauuuuuuacuauuggucuguaucuuaauuucuucuuucucuugaauacuucaaauuuuuugaagcacaacuccuuucaagauaaccaaaaucguaauaguauuuaaauaaaagaauaauguucaaauuaggucauggugaauauacauuaaugaucagcauuuuauacuuggccauguagugugaaccagugcuucacaguccacuuugauuuucaucuuuuuuuuuucuucacugauucaucagaguucuuuaguuuuuuaaguauuuugaaugugacaguaaaauauaauaaaauuuucagaggccuuuuuuuucuccuuuuacauuuucauucucauagauucgguuguguuagcuaguagcuuuauguugggaggagaauuaaaguuuucuuucacuucuguaauuuuaauaauuuuacagccauuuaagauuaaaggacaaccagaaaguggaauucuaaggacaggaacuuuuagagaggauacagacgauaccgaaagaaauaaaguaaguaguuuauugcaggaaaaaacuggaaaaaaaagccaaacauggauuauaacuaugugauuaucuuaccacacugcuaucuuuuaucaugagaucuacaguguaaggggaucguugccaucuuugguagcugguguuuugcuuguuuuugcaugaucaauccauuuauaugcuaaaggaaauaguuugucuuccuguuuaaagugugacagcguauucuauuuauuuuaugaaaguaaaaaauguuuaggccuuaccauaugauccagcaauucuacuucaggguauauacccaaaagaauugcaaacaagaaguauuuguacacccauguucuuagaguauuauucauaauagccaaaaaauggaagcaacccaaauguccaucagcaggugaaugcauaaacaaauaugguauguacauguaauggaauauuauucagccuuaaaaaggaaagaaauucugacacguuacaacauggaugaaucuugaggucauuugcuaagugaaauaagccaguuucaggauaaauacugaaugauuccauuucuaugagguuuguaaaguaggcaaauguauagagacagaaaguagaauggugguugucagagcuggagaaaggggaaauggggaguuauuguucaguagguacagaguuucaguuuuacaagaugaaaagaguucuggagauuguuggcacagcaauauacuuaguaucacuaaccagugcaccuaaaaaugguuaagaugguaaauuuuauguuauguguauuucaucacaauuuuuuaaauacauaggcuuuguauaagacaucuuugcugggagcgguggcucacgcuuguaaucccaggcaggcagaucacgaggucaggagaucgagaucauccuggcuaacauggugaaacgccgucucuacuaaaaauacaaaaaaaaaaauuagccgggcgugguggcaggcaccuguaguuccagcuacucgggaggcugaggcaggagaauggcaugaaccagggaggcggagcuugcagugagucgagaucgggccacugcacuccagccugggcaacagagugagacuccauuucaaaaaaaaaaaaaggcuucuuugccuuuguuuuuccuucagagcuugagauacaauuugcauaccauaaaauucacccauuuuuagcaugcaguuuagugauuuuuuuuuuuuuuuuuuuuuuuuuuuuuuuuuaguaauuuaguguugugaaaccauuaauacaauccaauuuuagaacauugccgucacaccaaaaugaccccaugcccaauuuagucuacccuaaagcccaggcaacacugagucuacucugucuccauagaucugccuucucugggauauauauacagucuucccuugguaucuguagaugacugguuccacuaccucccucucauaccaaaaucugaggaugcucaagucccuuauauaaaaugguauaguguuugcauauaaccuauacacauccuccuauauacuuuaaaucaucucuagauuacauaccuaacacaauguaaaugcuaugaaaguagauguuauccuguauuguuuaggggauaauaaaagccugcacauguucaguacacccagaguuauuuuuuucaaguauuuucaaucuguggaugguugaauucacagaugcagaaccgaugaauacagaggacugacuccauauccaaucuaaaucuaugugaauuuaacauguuaaauuuuuguuaggucauucugcuguauuuugccauuaaaaaaaucugagaccagccuuggcaacauagcaagaccccauuucuccacagaaagagggggaaaaaaggguaugguugcuccugccuguaauuccagcacuuugggaggcugaggcagguggaucgcuugagccccaggaguucaagaccagccugggcaacauggcaaaacccugucucuagaaaaaaauauuaaaaaauuagcuggguuugguggcgccugccuguagucccagcuaguugagaggcugaggugggaggaucaccugauccugggaaggucaaggauacagugagccaugaucaugcuacugcauuccagccugggcaacaagggugagacccugucucaaacaaaaggggaaaaaaugacauaaaauauauuaaggcuagaaugacugacugaauucacaguuuucuuauuuuugacugcaacaguuaaagagccacagcaacaacaaacccauugauauuuauacaaaaaaaguucauuaacuacagaagucaaauaauuuauacaauuuauuuguuuagaucuaagauuaacuaaacauaacacauaacccauuaaaaccauguuguguaagaaugauacaauggacuuuggggacuugggggcaagagauaaaagacuacaaauagggugcaguguauacugcucaggugaugggugcacuaaaaucucacaaaucaccacuaaagaacuuacuaauggccgggugcggugguucacaccuguaaucccaacacuuugggaggcugaagugggaggaucauuugaguucaggaguucgagaccagccuggccaacaugaugaaauucugucucaacaaaaaguagccgggugugguggcgugugccuguagucccagcuacuugggaggcugaggcaggagaaccgcuugaacccaggaggcagagguugcagugagccuagaucacgcuacugcacuccagccugggcaacagagcaagacuccaucuggggaaaaaaaaaaaacaacuuauuaauguaaccaaauaucaccuguaccccaauaaccuauggaaaaauaaaaacagaaaaaaacacguuuuauuaaaguucuucuaagaacgaaaaauaaaauuucuuaagauguguaagccuuacaaaaauuaagaacuuaagccuuagucaaacagcagugcuccaaaagugaaacccaaaggagcugaaaaugaguuaacaauaagagaaaaugaagagagagagagagagagagacacacacacaugccuucucuucuucugacauccuucuguuccuuuuaaagagaaagaguagggauuagaugacuggaaccacaaagugaagacuaaaaaauagaaagugaaaauugagguuugcaguuacucccacugguccugacauucuaagcagggcuucacaccagcuacagccaaggucuuuggcaacauugaaaggaaaacuaaagugucuuuguuggccacccaccaucuugccccaucucugcccuucaggaagcaaggguacucaauauaucuucuggcugucuuaaaucucauacuguaugauccacucuacacucauucuguguaaaaugccacagacaacuaaguauugaugaaauagcauuuuaaaguaauucucacgcauuaagaaggcucaauaaaacuuacuguauuugcugagcaacuacuaugucucuagcacugugcuaaaugcuugagggcaguguuuuuaaaaucccuaaggucauaaucaguauaaguauaagccuaggugugguggcacaagccugcagacccagcuacuugugagagugaggcaagagaaucauuugugccaaggguucaagaacagccucggcaauguagugaaaccccaucucuaaacuuuuuuuaaaugacauuugcaaacauuuucucccaauauguggcuuaucuuuucguuuucuugauggaguuucuugaagcacagaaguuuuuguggaaguccauucugucauauuuuucacauguggauugugcuguugguauuguaucuaaggaacauuuuuucugacccaaaguccuaaaguaaugaagauguuuucuucuuaagguuucaguuuuggugcuuagaucuaugauccauuucaaguuaauuuuuauauacagugugguaaggaucuaaauccaucuuuuugcauguggauauuuaguugugccauuugccuucauuuugacagaauuuuuuuccagcacacauauucuauuuauuacauguuuguauucaacagaauuugucaccaggcaggaguacaguggcaugaucauagcucaccugaccaccugggcucaagccuugaccacuugccucaagcgauccucccaccucggcuuccugaguagcuaggaccacaggugcaugccaucacaucaagguuggcuuuuuuuuuuuuuuuuuuuuuuuuuuuuuggagauggagucucgcucugccacccaggcgggagugcagugacacaaacucagcucacugcaaccuccgccucccagguucaagcaauucuccugccacagucucccaaguagcuggaauuauaggugcauaccaccauggcuggcuaauuuuuggauuuuuuuuuuuuuaguagagaugggguuucaccauguugcccaggcuggucucgaacuccugaccucaggugauccaccugccucggccucccaaagcgcugggauuacaggcgugagccacugugcccggccaaaccuggcuaauuuuaaaaauuuuuuuauagagacggggucuguguugcccaggccgaucucaaaacuccugggcucaagagauccuccugucuuggccucgcaaagugcuggauuacaggcaugagccacccugccuggccuagaauguauguaucuuaagacaugaagaauauaaaaauagaaaugggugguucaucaggcguuuuuguuuucuauuaauuuuuuaaaggaaguggaaguaucacauucaauuauauugagguugaugccucaauauauuggcuuguuuuuacuuauauaacauuucaucaguauuuugugggaugaaugaauauagaagaagaaauguuaggagagcaagaugacuuuagguagauuuagaauaagccaagauaaugaaguuuuguagccuuucuugugaauauucauuugcuaggauacuauaacgucuauucucuacuuacaccucuuagcauauagagaaaaggcacacuuaguccuaaagaauacauuagguuuauauuuuacguaaucguuugcuguggaaaacuaaaaaaaaaauuuugacuaaaauaccuugagaugcaaaauuaaaaaaaaaaauguggccuuucuuauuugcuuggauccacugucuuccuccccgugaacuaccacagaaggccaucuaccuccaccuugccaccugcuaucauuacaggcuuagacauacuccucuacaccuugguauaguaauauuuguacuuugagaaaaagauaauuuuuuucaucucugaaucuguuuuuuaaaauaugaagggcagccaaggcaagguuuuuugauucuuugguacaaguagcuuaaguuuuuauaugacaaaauuuaauugaaaaaucagauuuaaaaaaaauuuuuuuuuaauuuuuuuuauuuuauuuuaauuaggcucaacgagaaccuuugacaagagcacgaagugaagaaauggggaggaucguaccaggacugccuucaggcugggccaagguaaaagucagaauuagcaguaaaauagccacuguguuccuaaaaaauguuuuauuuguuuauuuuacaucuucuguaaugcagagucaauuccauuucuccauuauagagaacauagcuuauuccccuaauuauaacagggugagauuucucaauacccaaccugagaugcuggcuacaauauaugagcauucuggcauuuaucauuuagaaauaguguauuacuuuaaaaccuaaauuucuuuugaaguuuaucgccauuuuauucgaauuauuuuaauccaaaaguaaauuuagcagaauacuuuggagugauuucuuuguuuauauaaugcuuauuuuuguuuuuugaccuguuuuuuuuuuucuuuuccaucuaaguuucuugacccaaucacuggaaccuuucguuauuaucauucacccaccaacacuguucauauguacccaccggaaauggcuccuucaucugcaccuccuuccaccccuccaacucauaaagccaagccacagauuccugcugagcgggauagggaaccuuccaaacugaagcgcuccuacuccuccccagauauaacccaggcuauucaagaggaagagaagaggaagccaacaguaacuccaacaguuaaucgggaaaacaaguauguuuaucuuaacuccuagaacuaaaauaaugugcuguauuucaaaguuucuacucugaaucugucaguauguuagugucagggaguuggaaauuucuguggauggcuauaccagccguuauuauuuaccacagagaacaaaacaaaugaauagagaaaauguuguugguuuuucucccaagugcucacuuaauaucauaccagagaggauuauuuuaaguguuaauguagauauaaaaucauuguuauguuuuacaguuucaugccagaguacccucacguuuuucauagaccgccuguggucccggaaucucccuuugaggaccauaauuuucagcaauauugagcuugccuuguugcagcacucaaguuccaaacuuuuuuuccccuuagccaauaauguaagcgaaguuuuccuauaguauuaaaauaacaagcacuuuaguauaucauccucuaauccuuauucuguucccuuuuccuucguuguaguuuugcuauucuguuuacaaauauugaccaauagguuagguuucccaaaauaguuucauuuagcuauacuucuggcuucgucccuuuuggaauccucuuagcuuaugacugauagggcuaugaggagaugauuuaagucuguguaccacuucuaaucuuuacuuacuuuuuugggaggaggggggcaauagguggaaguauaaauaaaugauuuuuuucccauuuauuauacacuuguauuugcuaaggaauuuuaauuaggcucuuuuaagccuaauccuaaguaaguugaacacauccuaagaaaguugaaauuuuuucuuccugagaacuuacccugccaggugcagacuuauucgaaggagcuuuuaaaaauucuauuaaucuuguuauagauuuuagaguucauuauaauaacuagugagauuuaauuucuucuugaaucauucuuaaguguguuaauuugauaauguuuuaaggacuguaugcuguuuguguauuuuuuuauauauugaacagaaaaagcacacgaguacaugcaccugaguacagguaaagaggagcugauugaaauauaguuuaaucuguucucaguauuacuuuuagggguggaagaacguuaaggauuaauuaaaaaagaaaaaagaccuaucaguuaagauuuuccuuaugcuucagcaguucuaguaguuccacauauaaaucaaacacaccauauuacagaagucuagaaggcauucucugccccagcacuguccagcagaucuuuccauggugauagaaauguacuguaucugugcuguccaguaugguuugugucuacuuugaaacgugauuagugcaacuaaggaauuuuuuuuuuuugagacggaaucucacccuguugcccaggcugaagugcaguggcaugaucucaguucacugcaacgucugccuccucaagcgauucuccugccucagccuccugaguagcugggacuauagacguccacuaucaugcccagcuacuuuuuguauuuuuaguagagacgggguuucaccauguuggccaggcuggucucaaacuccugaccucaggugaucugcccaccucggccucccaaaguggugggauuauagacagccauugagcccagcuggaacuguauuuuuuuacugugauuguguauccauccgugaauagucaacacacucuagaauuuaaguaauaguacccaaauaaccucugcuucccuugauaucuacuccacgguaugguuuuuuuuguuuuuguuuuuauuuuuuuauuauuccucauuuggcauucugggugaguucaaacauuugauaaugccaaacuuccagggaucauuuaaaggaguuuaaaagagccuucucuacuagagcuccuaguucaugagaagugagauaaucuaucucaaggugucucuaagaaccaugacccacauuaagagguuaaagguauguguuucaugggaaggucugagaccuuagucguaugacuaauguuaaccuaaauauuaaauguccuggaaggcccagcaucuuaugaguuaacauauuaacuguuuacaagaugccugugguacaggugcuacaguuugcugccauuuauaguauagaaccuuaauuucauaugcucagcauuuuaagacaucuuguauccuuuuucuuccucaggccaacauguuauccuaaagcugagaucucaaggcuuucugcuucucagauucggaaccucaauccuguuuuuggagguucuggaccagcucuuacuggacuucguaacuuaggaaauacuuguuauaugaacucaauauugcagugccuauguaacgcuccacauuuggcugauuauuucaaccgaaacuguuaucaggaugauauuaacagguaaauacaugucauacuuuuugcauuauaaugcuaaaaggaugaucuaaccauauuuacugucuuaguccauuaguuuucugcugcuauaacaaaauaccuaagacuagauaauuuguaaagaacaaaaauuuauuuucucuuaguucuugacugggaaggccaucgucuaggugccggcaucuggugcgcuuuuuugcugcauccucacaggguagaagguggaagcgaaagaggacagacucguccugucgagcccuaaacggcaccuaauccuguucacccgggaggggagcccucauggccuuaucaccucuuuaaaggccccaucucuuaauccugucacauuggcaacaccugaauuuuggaauauuugacgugaaucuggugguaaccuaugaauaaguaagcauuuugguguagggcuacaguaugugaauaauuucauguugacaucaagaacccauuuuaccuuucaaaccauaguacuuaccacucagcuccagaaaagucaaauuaggaaaggggaaaauaucuuuauccuuaggaauaaugaaggcugggcaugguggcucacacugguaauccuagcacuuugggaggcugacgugggcagaucacuuggggcccaggaguuugagaccagucugggcaacaaggcaaaacuccgucucuacaaaaauuagcuagguguggugauacaugccuauagucccugcuacuugggaggcuaaggugggaggaucaccugagcccagaaggucaaggcugcagugagccgugauugugccgcuauacuccaccagccugggugacagaaugagacccuaucucaaaaaagaguaaagccuucucugauuaguaaaggacagacaggaugagagcagugccagaaggcagaaccucgcugucaugaacuggagccuguugaugaugaggagaccaugcagggcuugcagccaaaagaaggaagcugaagggauguaagcaagucagauucagaugagaaucugguggugagccugcaaauaaauaaguaguuuaauguagugcuacaguaugugaauaauuucauguugacaucaagaaucuacuguaccuugcuuaacuuuuaaauuuccuuuauugucuuuuguaacaacuuuuauuugcacaggucaaauuuguuggggcauaaaggugaaguggcagaagaauuugguauaaucaugaaagcccuguggacaggacaguauagauauaucaguccaaaggacuuuaaaaucaccauugggaagaucaaugaccaguuugcaggauacagucagcaagauucacaagaauugcuucuguuccuaauggauggucuccaugaagaucuaaauaaaguaagaaauuugauuuuucuaaguugcagagacucuuuaggguugcucaguagcacuguauuuuuauagcaguuuaaaauucuaguuggugauaguucagugcuuguuuauucaaauagugacuguauaagagaauuauaaaacaucagguaaguguaauauuugaagcauauacaguugguauuuacuaauuaacaagcaguauugcugagaaauuugcaaauguuaaaauaguuauuggcguuugugacccacauguaugugaaaguaaaaucauaaacaaaugaucuuauaaaagauuauagacaguuugagcauuuuuauuguauguuauguuuauauaauauguauauguuauuguacauauccuuauucuuuucuuuuucccagucccuugcugaaaguggaacaugccuuuauucuuacacauccuucuaaaauaagaauuacuuggcugggcacaguggcuuaugccuguaaucccaguacuuugggaggccaaggcugguggaucaccugaggucaggaguuugagcccagccuggccaacauggcaaaaccucgucucuacuaaaaauacaaaaauuggcuggguguaguggcaugugccuguaaucccagcuacucagguggcugaagcaggagaaucgcuugaaccugggaggcagaaguugcagugagccgagauugcagugaccacugcacuccagccugggcgacagagugagacucuuucuaaaaaaaaaaaaaaaaaaaauuacuccauguaaccaaaugacucaugugacuaguuauuauaaaggcauguauguauacauaaaugaccacccuccauuuacauacuacaacuucuuuuuagcacuuuuugucucacauauuuuggggucaccauucuuaaccacugaacagauauauauauauauacacacacaccuacacaaaaauauuuguguauauauauauacguguauauauacauacauauauacacauauauauacacauacauauauacauauauacguguauauauacauacauauauacacauauauauacacauacauauauacauauauagagagagagaggcuagggcaacaaaauuauauauguccaguuguagcccuaauucccagcuauaugugggauaucuuuucuaaaaaccaaacuuuuuagcuuuuucuuuuuuuaguagagauuggaggggggggucucacuauguugcacaaguuggucucgaacuccuggccccaagcaguccuccugccuuggcuucccagaaugcugggauuacaagcaugaaccaccacaucuggcccuuuucagcuuuuuaaauaaaaauuugggaaauuucaacaagucacauuccuucaauaaagugagugaguuuuuuuugguauuuuuggcuagaauuauuuuuugccacacucagugagaucagaacuccuuuaugagaacuacagguguuucuaaaucuggcaaguguuuguauucacuuuuauucuuucaauuuaaauguuuucuuugagauauuaauauagagcuuaaaucauuuuauuuccaggcugauaaucggaagagauauaaagaagaaaauaaugaucaucucgaugacuuuaaagcugcagaacaugccuggcagaaacacaagcagcucaaugagucuauuauuguugcacuuuuucagggucaauucaaaucuacaguacagugccucacaugucacaaaaagucuaggacauuugaggccuucauguauuugucucuaccacuagcauccacaaguaaauguacauuacagguaaguuuaagaaguagagagaaaaugauuuauuggauaaaaaugcuguuuuuauggauauagagauguaaauuucuggucuuuacccuuacaaacauuuuaucaguaaaacucggccgggcgcaguggcucauaccuuguacucccagcacuuugggaggccgaggugggcggaucacgaggucaggagaucgagaccauccuggauaacacggugaaaccccaucucuacuaaaaauacaaaaaauuagccgggcgugguggugggcaccuguaguccccgcuacucaggaggcugaggcaggagaauggcgugaacccuggaggcggaguuuacagugagcugagaucucgccacugcacuccagccuaggggacagaacaagacuccgucuuaaaaaaaaaaaaaaaaaaaaccuuuuaucaguaaaacucaauauaaauucuguuuuauaauuaggccuauguagauuagaaagaauuagaaauuucuuuuuuaaagauaccuuuauuaaauauucuuucaggauuucaggauuguuaguauguuuuuaaaaaguuuuauaaguuaauuuggaaaguugucuguugacuaacuuaggccuacuuuucauaagcauuugcuuuacauggggauaucaaauaaauauccuguuuuccauguaucaacaauguuucuuauauaaaagcuuguugauaccuuuagucuuaaaguaccuccagaaugucauuuccuccaacaggguuucucugauugaccagguuaggggcuuuccuguguccugucacaacacacuguagguagcacucaccacacucugugcugucauuguucacuugucuaugcuucucacuagaucacaagcuuugggaaggcaggaacucuuuuguguagauugcuguugaaucacuggugccugcagagugacuaacuaaauaggugcucucugacauuauugaagaaucgaauuaacgaguaucugcuacuuguuuuuuucugccaggauugccuuagauuauuuuccaaagaagaaaaacucacagauaacaacagauuuuacugcagucauugcagagcucgacgggauucucuaaaaaagauagaaaucuggaaguuaccaccugugcuuuuagugcaucugaaacgguaaaggggaaaguuuguccuccuguucagugaaauuaaaugagggaauuuuaaguucuguguaauuuauacuuguuguacugccugccaugggcacauaacaaagggcgauuaucugguuacaguagaucuagggaaauaaagcagaaaugagacuguuaguucaccucaguguuuucaguaccacagcaaaaugacaauaccacuauuucauguaauuccuuauaauuuuaaauaauuacaaagcaucaagugaaaauguauaaaaauauuacaguauaauucaaacaaauuagcacaugaaauguaacauucaaacagcagacuaaagcauaacagacuuaguuauguguuaaauaaaauuuauaauuuuuaaaguauuuuaaugauaaaauauguuaacgauaccauuaagugcagaaauaauuucauccagauuuuuccaauugauggaaaagaucuaguccuauaauagaaggaauaaugacaagaguuauaaaacacgaaccagaucuuuugcugauucuuuggucuucacauaaucacauaauccauguaacucaagaacuuugaguugauuauuugaaaaacuuuuuaaaggaaguugcacuuuuuuauugagagcuguaauuuuugugucaaaaaagcauuucuguuaaaaauguuuuaucuuguauugagauucuuaguuccauauauuaauuuccaaauuuacauguucagauuucucuuguguaaauuuuucuaacaaaagcuaguuuuuuccauuguccuaguugaggauucuggaaguauaaacauucuauaagugauuacacauuugcuaaaauuuuuaaugcugaauauuuucaaaauuaugaaauaaccauauuacaccaaccaagauaucauuguuuugauguuuaaaggagcagaauaugccagaauaauggaaugaaugacauuauuuuagucaguagucuccuacucucaauuucuggcucuaguuuucucugaaguacaagcuugacucgagagcagcugucauucuuucuuuugugguggucagcauuauaaacaugugggucuuaccuuccuagaagacucauguagcaguuguagcuggaccagaguauaguccuaccucuaccauucuggcuguuugaccuuaggcacaucauuaaauauccauaugccucaguuuucuuguuuguaaaauggaaaugaagccaaaugucuuuaacagguuccucuacuacuaaaauuccaagucuuuguauuugaaauggauuuuacaguccuggcuaaaaaucuagauguuaaugaaugaggauucauccugguaucuuccucugucaguguaauuguaauguuuuguucugcaguuuuuccuacgauggcagguggaaacaaaaauuacagacaucuguggacuucccguuagaaaaucuugacuugucacaguauguuauugguccaaagaacaauuugaagaaauauaauuuguuuucuguuucaguaaguaucucuuugaacugaagacuuuuuguuucaaagcaaguuuaaaaaaaguuuuaagugguuuccuaccucauggaagaguaagaacaacauaaagcuuugaaacuauuggcguauuuuaaauaacaauuuuaacugaauugauuuuuuuuucuaucuuguuuggcacagaaucacuacggugggcuggauggaggccacuacacagccuauuguaaaaaugcagcaagacaacggugguuuaaguuugaugaucaugaaguuucugauaucuccguuucuucugugaaaucuucagcagcuuauauccucuuuuauacuucauugggaccacgaguaacugauguagccacauaaggagacauagguuauaaacuaguuaucuuuuaaaaggcucagcaacacaacucuugaaaugcuuaucaggauaaugguagcuauagcuggccauuuagaggaauucuaggacagugggagcuguguuacuagcacuauauaauuccggucagugcugacaaauaacauuuaacaaguauugcaguaaucaucacuuacagguaccauuuauuucaaaacaacuuuuuuagucugcuccaaaguuaaaauaauuaacuagcuaagcauuauuauucgacuggucuaaaaacuauuguuaucuuuuuuuuuuccuuuucacuguuauggccuuuucacauuucuaaaucccaucuugauauacuaugaauacucuagaaugauguaaagcagauaggaauguauguguacauauuuauugcauacuugcacaucaaaucgauguacauaguuuaacacgugguccuuuugugaaaccuagaacucagaggauugcuuuuuuucuuucagccuauuuugaguuaacuucagugcuuucuuagggaaaugacagggcaaagcaauuuuucuguuggcuuugggcuguauuugugcacuaaaucuuuauucuaaaaaaaaaaauggaaacuuuaauuuuuuuaaaacgagaauuucauuuacagcuacauuaaaaucuuaaugagaaaaauaauuuauaacccuguggguguucugucuuuaauauuguauuaucaaauauaggacaguaaaaccauagauuuuauauacacacgugcuauauaauaacacccagagucauucuuucaagacuaguauucucacauauugagaauauucauucuaaauauuaaaguaaaaaugccgggagucaggcaugauugcaaagugaacugcauuauaaacuacaucuuuacagagugauguauuaagaggguuaaaggagcuuauaauuuauuuaaccgagggacucaguugcuauauauauagucaguaaaacacuccauauaaaaauaagauucuaaaagugcuucagaaagagaccaccauuagcaggcucucagggagaagaugaaaggaugggguucaaauugugaagcugacaacuuuucauguuuuacaauuagucuaagagaccacuucuuggcuaaauuauuauaucaaauauauucaaaucauauucuuaaacucaucgagccauuugaacaaaaauuauuuuuguuuagcuucaugaguaucuuuggaaaauaauuuguugaauauauaugauuaugagauauuuucugauaaacacugaauuuugaaaccugaacucacuauauaauugcaguguuuugaaggccugcauccauuagcauugcauuauauucacacugccuuuuuuagugaaccaagacccaucuucuggacgacagauuuaucuuaagaugaaagguuguauaacaugcccacaaggcauaaaaauguuaaugaugcaaguaaguucuaagaguuuaaugaccaagcaaaacucuaccaccagaugcugacugcuuguuuugcaguguucaggaaacaccauuuuccuggcucuuaacgcuuuuguauugguauggaaaagggcuggcagcuauagaacaggagauccauagcauuuugaacagaaguaucuggaaucucacugacucguguguuaucaaagcuauaucaggccugggugacugaauucuugcagaaagcaguguaguggccaccauccaaaucaccaaaaugguucuaugggagaaaggaaugucaaacuuaguauucacauaugaacacuaacuacuggaacagaaaugauagggccaagagaugcuuuuuaaauugucccuuauucuaaauuaaaaggaagugauaauuuuguuguuaaaucaugcauauagccugacugcuauauugcuucucauuucauuguaacuacuuauauguugugcccauugacuaucaucugugaauaaagaaagacaauauuuagca

SEQ ID NO: 191235 - RNA, 46144 nt, Homo sapiens
uaaguucuaagaguuuaaugaccaagcaaaacucuaccaccagaugcugacugcuuguuuugcaguguucaggaaacaccauuuuccuggcucuuaacgcuuuuguauugguauggaaaagggcuggcagcuauagaacaggagauccauagcauuuugaacagaaguaucuggaaucucacugacucguguguuaucaaagcuauaucaggccugggugacugaauucuugcagaaagcaguguaguggccaccauccaaaucaccaaaaugguucuaugggagaaaggaaugucaaacuuaguauucacauaugaacacuaacuacuggaacagaaaugauagggccaagagaugcuuuuuaaauugucccuuauucuaaauuaaaaggaagugauaauuuuguuguuaaaucaugcauauagccugacugcuauauugcuucucauuucauuguaacuacuuauauguugugcccauugacuaucaucugugaauaaagaaagacaauauuuagcagcaucugauuaauguuuaucagugaacauuuaguuagcacuuaauauacaucaacuauuaagcauuaaaggaaauuuuacaauaagaagauaauucaggccgggcacaguggcucacaccuguaaucccaacacucugggaggcugaggcagguggauugcuugaguccaggaguucaagaccagccugggcaaaauagcgagacuccauaucuuuuaaaggaaaaaaaaaaaaaaaaaaaagaugagcuaggcauaguggugcacaccuguagucccagcuacuugggaaguuggggugggaggaucucucgagccugagaggucgaggcugcaaugagccgugauuguaccacugcacuccagccugggugacagagugagacccugucuuaaaauuguaaguucauuuacguaagauggcuucuuuuuuuuuuuuuuaaaguuaggauaagccacagaagagacauuuaacauuagaauaaggaucuuaacugcauauugcuacagcacaaauugagggggcuauguagcaacaaccccucaaucccccauaggguacaaaaaauaauguaucucauuuuccuuuuuccaugucuuuccuaacccaguauuguuuggaacaaaggcauuagagagguguacuuccaaggagguguuaugguguaugauaagggucagcaaaccacggcccgugggucaacuccaggcuguuuuuguaagacccaugcauuagcaacggguuuuaaauuuuuauaugguuggggaaaagauccaaguaauaauaguauuguuauaugugaaaauuuuaugaaauucaaaugucaauguccuuaaaguuuuaugggaacacagucaugcucauuuguuuacacuuuucaguggcugcuuuaaugauacaacaguaaaacugaauaguugcagccaauaccauauggcuuaugaggccuaaaauauuuacuguuuggccuuuaacagaauaaguuugcugaccucugcuguagaggaagaaaauugauuauuuguuaacuuauuuuuaauuuuuugagauggagucucucucuguugcccaggcuggaaugcaguggcacgaucucggcucacugcaaccuccgccucccagguucaagcaauucuucugccucagccuuccaaguagcugggagacuacaggugccugccaccaugcccagcuaauuuuuuguauuuuuaguagagaugggguuucacuguguuagccaggauggucucgaucucgaccucgggauccucccacuucggccucccaaaguuauuuauuuuuauuugagacagagucuugcucuguugcccaggcuggagugcagugacgugaucucagcucaccacaaccucugcuuccuggguuaaagcucuucuccugccucagccucccaaguaacugggauuacaggcacgcaccaccacacccagcuaauuuuuuguauuuuuaguagagaugggguuucgccguguuggccaggcuggucuugaacuccugaccucaagugauccaccugccuccaccucccaaagugcugggauuacaggcgugagccacugcacccagccuauuuauuuuuagaagcaguuucuugcuauguugcccaggcuguacaugaauuccuaggcacaagcaguccucucacuucaggcccccaaauagcugggacuacaggcauacaccaccauguccagaaugaaaauggaucugacuaguuaauuccaacgugaauucggguguaauaguacauugugaccuuagcgaaauuauuugaccuuucugagcuuuaauuucucaucuauuaacauggcuuguuuuguauagcuguuaucaaauaucucauguauugagggcuaguacacaggaguuauuuauucaauauucccuucaaccuucgucuuccccaccucucuccuuacagguaauagaaauaucugaaauucacauuuaaaagaucaagguuccgccaggccugguggcucacgccuguaaucccagcacuuugggaggcugaggcaggcggaucacuugaggucaggaguuugagacuagccuggccaacauggugaaaauccaucucuucuaaaaauauaaaaauuagcugggcaugguggcgcaugccgguaaucccagcuacuugggaggcugaggcagaaucauuugaaccugggagauggagguugcagugagcugagaucaugccauugcauuccagccugggcggagcccuaaacaggaaauuuaacaacaguauggugugugguuuaugcuuugugacugccugggcguaaagacagucccuaguuucuguaaccaguaugcucggguuuuaaaggucacgcaaggacacucgagguaaagucuuaggccccccuacaaggugagaaguuggauugagauccacauacaaagccaggaccuuuaaagacauucacccucaauggaaggauuaaaaaacaaaauccacccucuagugcuuguguuagcuuggacucaugguacagagaauaaaagucauuccugggaauuugucaccauagaccuaccuuuucaccaguuugggauucaaauuuauacuaccuguguggucugcgaauccugugaacuuaauaugaaaaguauuucuagggcaguugccagaaggaaacagaauuucuagauuguugcauguuaacucagaccuaacaggauauccacauaugaaaccccaaugaaguugagaucacaauucaaaauaauagaacaugcaaggaaacaauuuaucauaagagucagaaggcaauaagauuuaaacccccaaggacuuuagauaauagaauuauuaagcagaggcuacaaauaaaguauauuuaaauauauuuagaagaaggaaacaaacuuuagaaacuaaauagaauuuucagaaaugagaaauacaacauaguuggccguccauauuuacgggcucugcaucuucagaaucaacuaaugugaugggaaagauuugaaaaaauaauacaacaauaaaaauauacauauuuuaaaauacaguguaacaacuauuuacauaguauuuauauuguauuagauauuauaaguaauccagagaugacuuaaaguauaugggaggaugugcauagguuacaugcaaauacuacuccaggccuggcaugguggcucacacguguaaucccaacguuuuugggggauggaggugggcagacugcuugagcccaggaguuguagaccagccugggcaacauggcaaaacccugucuacacaaaauacaaaaauugaccaggcauaguggcacgugccuauagucccagcuacuugguagguugaggugggagaaucaccugagcccaggaggucgaggcuacagugagcugugacugagccacugcucuccagccuggcaacagaaugagaccuugucucaaaaaacaaaaacaaaaaacaccagaaaagacaccauuuuauauagggcccuugagcaucuguggauuuugauagucaaagggauccuggaaccaacucccugcagauacugagguacaacuguacuggaaauuaacuuaaugaagauauuaggacacagaaaaugaauaaaccggacugggcgcgguggcucaugccuguaauccuagcacuuugggaggcugaggcggguggaccaugaggucaggaguucaagaccaaccugguacacauggugaaacccugucucuauuaaaaaaaacaaaaaaaauuagcugggccugguggcgugcaccuguaaucccagcuacuugagaggcugaagcaggagaaucgcuugaacccgggagguggagguugcagugagccaagaucgugccauugcacuccagugugggugacagagugagacuccaucucaaaaaaaaaaaaaaaagaauaaacuauaaaaugaaguuggggaaauuagcaagaauggaguagugauggagaauacguguuaagaggcaugaaaaauugaaugagaauauucagcguauguccuguagaaguucuaggaggagagaaucgaguaggggagcaaggcaauauuaaaagugauaauggcugaaaaugauuaaugagacaugaaucuucacauuuaggaaaugcagcgagccagggauaaauaaaaauaauacugcagaacaacagagacaaagagaaaaagcuuaaaagcaaccagaaagaaaaagagaguuuacccacaagaaucuaaccugcugguagaaguucuccauagcagccauagaaaucagagacaauacaguagcuucaaaauaauagagaaaaauaacugucaaucuggaauuugauuucuaguuaucauccaagaaugaaagugaauuaaagacuucucaaagacugagagacuucaggauaacagacccucacugaaaagccuacugaaauauaugccacaugaauuuuaaaaacucaaugaaggaagaagugauacauaauagacagugauuaacaaaaaagacugaugaagauccgggcaaauauaacccaauaugaacaguagaaaaccaugauaaugucuccuuuggaggcauauuaaaaaauuaaaaaccggcugggcauggugguucacaccuguaaucccagcacuuuggaaggccaaggcaggaggaucguuugagcccaggaguuugagaccagccugggcaacauagugagaccuggucucuaaaaaaaauaaaaaaguuggccaugcacaguagcaugccuguagucccagcuacuuggcaggcagaggcaggaggaucccuuaagcccagaguucaaaacuguagugagcuaugauucauugcacuagugcacuccagucugggcaacagagugagacccugucucaaaaacaaaagaugcugaaaacaguaguucagugaucagaauuacaguguucuaagagcuuuccauuucuuugggagcagaguauaaagaucuugauuaacuuuaggcuuuaaguaugaaagcugucguuuuuuagcauaauuacuaaagaaucaaaauguguaacuuccaaaguuguagagggaaaauaaagaaagcuuuaucaguuuaguagcagcaagaacaacaggggaaaacaacacagcagagguccccaacccccccaggcugccugucccugaccuguucaggaccuggcugcacagcaggaagcgagcggcaaaccuacccugagcaccgccuccugucagaucagcugcugcauuagauucucacagcagcacaaacucuauugugaacugcgcaugugagggaucuagguugcgugcuccuuaugagaaucuacugccugauuuucugagguggaacaguuuaaucccaaaaccaugcccgccccggcccccauccaugggaaaaaaaccgcaucaguggaaaaauugucuuccacaaaaaucagucccuggugccaacaagguuggggacugccgaauuagaaaaauaaggcuaacauaaacacaaaagaagaugacgacaaguaaauccgaauuuauuacuaguugaaauauaugggauguaguaaauuuaccaaauauuuacuggauuuuaaauauccaguucuagccaggcgcgauggcucacgucuauaaucucagcacuuggggaggccgaggggggcggaucacgaggucaggagaucaagacuauccuggccaacacggugaaaccucaucucuacaaaaauacaaaaaauuagccgggcaugguggcaggcgccuauagucccagcuacuccggaggcugaggcaggagaauggcaugaacccaggaggugaagcuugcagugagccgagaucgugccacugcauuccagccugggcgacagagcgagacuucaucucaaaaaaaaaaaaaaaaaaaaaaaaaaaaaaaaauccaguuuuaggccaagugugguggcucaugccuguaaucccaacacuuugggaggccaaggcaggcggaucaccugagaucaggaguuccagaccacccuggccaacauggcaaaacccggucucuacuaaaaauacaaaaauuagcugggucugguggcacaugccaguaaucccaacuacuugggaagcugaggcaggagaguugcuugaaccugggagguggagguugcagugagccaagaucaugccacugcacuccagccuggggcacagagugagacucugucucuaaaacaaaacaacaacaacaacaaauccaguucuaugcacuauauaacauuuagaacucagaaaagguguauuucccuugagcaucauguuggugcuuaaaauguuucagauuuuggagcauuuuggauuuucagauuagggaugcucaacuugucguagguagauaugaccaagagaaagcugaaguagcuauacaucagcuaaaauggucccuaagauagaaugcauuguaaaugagucacuuuauaaugaaaaaagguuuaaaucacccaaauuguauaauuugaaacugcuaccuaccuaacaaaacagacuuguuaaaaacaaaugacagaacuauagggaaguuuugacaagucuaccaucauaauggaagauuucaacuauugaucaagcagacaaaaauauuaguauagauacagcuuuuacaauauauacuuagaugaguaucugacuccugaaauagaagugcacugucucaacaaauguaaaagaguuaguuuaggccaggcacgguggcucaugccuguaaucccagcacuuugggaggccaaggcaggcgaaucacgaggucaggaguucgagaccagccuggccaacauggagaaaccccgucucuacuaaaaauacaaaaaauuagcugggcauggugucggcugccuguaaucccagcuacugaggaggcugaagcaggaaaaucgcuugaaacugggcggcggagguugcagugagccgagauggugccagugcacucuagcccgggcgacagugcaagacucugucucaaaaaaaaaaaaaaaaaaaaaaaaagauuaguuuaauuuagacccuagucuuugaacacaauacaauuagcagucaauacaaaaugauacccccacaaaaaaucaauacuuuuggaaauuaaaaaaacacuucuaaguaacuuuauaaauaaauuauaaaaguaaaacacuuagaaguaaauaguaaugaaaauacuauaucaaaacaugggaugcacugaugucugagaaugucuuaaaaauaauacgaugccaagaagagagugggucaguauuaagaugaauugaucauuuauuuuauauucaaauaucuugcuucagcaagcuaguugauggaugcauggcgguuuguuaugcuguccaauuuuguauauguuugaaauauucuauaauaaaaaaaggcagagaaagugggagauagacauuuguaguuuuaaauacuuauaucuuaaaggauagacugaguguuaauacacuggacacucaguuuaaaacauuaaaacauaacagaauaaacccuaaaagaguagagggaagagauaacacuguaagaggaauaacccauaaagcagaaaacaaagauguaauacagaagauuuaaaaaaagguaaaaguugguguuuuaagacaaaauaauuuggauguuagccugccacagugguucaugccuauaaucccugcacuuugggaggccaaggcagauggaucgccugaguccaggaguuugaaaccagcuugggcaacauggcaaaaccccgucucuauaaaaaaaaaaagaguacaggccaggcgcgguggcucacgccuguaaucccagcacuuugggaggccgaggcgggcggaucacgaggucaggagauugagaccauccuggcuaacacggugaaaccccaucucuauuaaaaauacaaaaaauuaccugggcacgguggcgggcgccuguagucccagcuacuugggaggcugaggcaggagaauggcgugaacccggggucggagcuugcagugagccaagaucgcgccacugugcuccagccugggcgacagagcgagacuccgucacaaaaaaaaaaaaaaaaaaaaaaaaaaaaauuacaaaauuagcuggacaugguguugugccuguaguuccaucuacuugggaggcugaggugggaggauggcucgagccugggaggcagagguugcagugagccaagaucacaccacugcacuccagccugggagacagagugagacccucucucaaaaauaguaacuuggacgucaauaguaagauuuagagaauaagagacaaggcggccgggcgcgguggcucauguaaucccagcacuuuggaaggcugaggcaggcggaucaccaggucaggaaauugagacuauccuggcuaacacggugaaacaccgucucuacuaaaaauacaaaaaauuagccgggcaugguggcgggcgccuguagucccaagcuacucaggaggcugagacaggagaaugacuugaacccgggaggcggagcuugccgugagcugagaucgugccauugcacuccagccugggcgacagagcgagacugcgucucaaaaaauaaaauaaaauaaaauaaaauaaaaaagagacaagucaacgauaaaauuaaaaaugaaaaaacauguaauagcuacagauccugaauaaauuuauuguuaauacccuaaaaacuuuaugccagccaacugagaccuuagaugaaauagacaaauaucuggagaauaaguuaccaaaaugacugaagagaaauacauggcucacaccuauauuuuuuacagaaauugacaagggccaggaauaaucgaaauacuacugaaaaauaagaauaaaguugugaugguaaugacuuagggaauaaugaugguucuugcucugccagauaucaauguuuauuucaaagcuauagcuauaauuaauauucauaagcuaaauuaagaauuaauucaauauuaauuuaauaaauuuaauauuuuauagcuauaauuaauacaguacggaauuagcccaaaugugaacaaauugaccaacagacacacacagcauaggaaaaccagcauuauauguuacugaggaaaagaagaggcugagacauuugguuauucauaugcagaaaaaugaaauugaaucccuaauuuauacuacauuuuugucagaagugcaaaacaauuuaaauguuuggaagauauguagguaaauaucuuuguaauuccaggguuggaaaggauuucuuaaaugagacacagaaaaggacuaacuagaaaagauugauguuccaaccaaauuaaaacuugauugucagcaauuacaauaagauacaacaaccaaaugcaguuugugaauuuuggauggauucuggucuuugaaaaaaaaugcuacuaaaaaaaaaaaccuugugacaauugauauuugaauaugaaucuaugaauaugagugauggaauuuuaaauuuucuuacauauaauucugcuauuguggguauguagaagaaugugguuaagggauuauuuugaucuaugaagugucacgauacaagauuuaaaucagcaaaaaguuagauauacguguguauagaugugcacauauauauguauagagagugaaaguaauaaaaguguauacacugcuaaauguuaauaacugaaucuagcugaaauguacaccaauguacaccaauguuuuguuuuuugguuuuuuuuuuagagauggagucucgcucugucucccaggcuggagugcaguggcgcuaucucggcucacugcaagcuccgccuccuggguucacgccauucuccugccucagccuccugaguagcugggacuacaggcgcccgccaccaugcccggcuaauuuuuuuuguauuuuuaguagagacgggguuucaccguguuagccaggauggucucgaucuccugaccucgugauccgccugccuuggccucccaaagugcugggauuacaggcgucagccaccgugcccggccgauguacaccaauguucucuguacaauucuuucagauuuucugaauguuugcaaaguuuuauuuuaaaaacuggagagagagcacuugaaaagaugcucaacaucauuagucauuaggaaaaugcaacucaaaaccaugacauaccaguucauaccuacuuuguaugggauagaauaaaaaaugagaggcaguaacaaguucgguugaggauguggggaaacuggaaccuuaguuccaguugcuggugggaacguaaaaugcugcugccacuuuggaaaacaauuuggcaguuccucaaaaaauuaaccagaguuaccauaugacccagaaauuucacacuuagguauauacccaacagaaaugaaaacauguuuacagaaaauccuguacauaaauguucauagcagcauuacugaugacagccaaaaguggaaacaagccaaauguccaucacuggauggauuaaggaaaugugguauauccuauacaauggaauauuauuuggcaauaaaaaggaaugaaguacagauacaugcuaugacaugaaugaaacuugaaaacauuaugcugaauaaaagaaaauaaaaacagaaggucauauauucuaugauucuguuuauuaaaauacccagaauaggccaggcacuguggcucacgccuguaaucccagcaccugggggagccgaggcagguggaucacuugacgucuggaguuugagaccagccugggcaauauagcaaaaccccaucucaaccaaaauacacaaaaauuauuggggcaugguggugcacaccuguggucccagcuacucgagggagggaggagggaagaucacuugagccagggagguugaggcugcagugagcugagauugcaccauugcacuccagccugagcaagagugagauauugucucaaaaaauaaaauaaauaaaauuuuaaaaauacgcagaauaggcacaucuauagaaauauauaaaguagaggccaggagaagugguucaugccuguaauccgagcacuuugggaggccaaggugggugcgccacuugaggucaggaguucaagaccagccuggucaacauggugaaaccccaccucuacuaaaaauacaaaaauacaccuguagucccagcuacucgggaggcugaguuacgagaaucccuugaaccugggaggcggaaguugcagugagcugaaaucaugccacugcacuccagccugggcaacagagcaagacucuguuaaaaaaaaaaaaaauagcgagagaucgagagagagugcacgugagaagacuaguaguugcuauggacugggggagaaggaacggguuacaggguuucuuuuggggauaacgaaaauguucuaaaacuggacuguggugauaacugcacaacucugugaauguacuaaaaacuacugaacuggccaggcacaguggcucacaccuguaaucccagcacuuugggaggcccugagaugggcagaucacuugaggucaggaguuccagaccagucuggccaacauggugaaaccacaucucuacuaaaaauauuuuuaaaaauuagccaggcaugguggugcaccuguaaucccagcuacuugggaggcuggggcaugagaaucauuugaaaccaggggguggagguugcagugagccgagaucacaccaccgcacuccagccugggcgacagagccagacucugucucaaaaacaaacaaaacaaaaacaacaaaaaacacaacugaacacauuuaaggugaauucugugguaugugaacuaucucuaagaacuucuuuuuauuuaaguugggaaacaaaaagaucauguacaacaaaccaaaaacaaaaaaguuauuucuaacccauguaacauauaacaaggaucuagaacauguaaaugacucuuuccaaucaauaagaagaaaaauaacccaguuuguaaaaaaugugcaaaagacaaauauuucauacaauaggaaaaacuaaaaugagauaauuuuguauccauuagauggcaaaaauuaagaagucugaugauccugguagggguauguauugguauaaucacuuguagaaaguuaaauaugcacauacuuuaugaucuaagugaccucacuccuaaguauauacaugagagaaacucuuaugcacauauauaugcaggaaugucugcauaauguuguucaugccagcaaaaauuuggaaacaaugaaauaucaauaggaaaauggauaauuuaugauauauucacacaauauacaucauaggcuagugaaauuauaaccacaugcaacaauauggauauaucuuuaaaauauuuaaugaaaaaguaugcuuggcgcgguagcucacaccuguaaucccagcacuuugggaggaugagggagguggaucaccugaggucaugaguucgagacaagagcgaaacugucuaaaaaaaaaaaaaaaaaaaagagugaagaaucaagccacagaagguaauuuaaaaauguacacucaagauuuaaaaagaacuacaauuccauaagaaaaaggcaggccacagaauaggaaaaagaauaaaagacuuguuuaggcauuucacaaaagaaaguauacaaauuuaaguaguuauuuaaaccacaaugccauucuacuauaugggcaaccagaagggccaaaacaaaacgaacaaaagacuaccaaguguuaacaaggauuuaaggcaacugaaacuuccagucauugcugguggggguaugaauugguacagucgcuuuggaaagcuacugagcaguauguacuaaagccagacauaugcguauuucugaaccaggaguuucacuccuagguauguacucaaaagaacuguguacacuauguucaccaaaaaacaagaauguuuauagcaacccucuuugcauuagucaaaagcuaguaauuacccaaaaguuccugaaugguagaaugaauuacuaaauuguaguauuuucauacaauggaauacuauacagcaaugagaaugaauaaauuacaauauaaacaacaauauggaugaacauuacauaauuuugaaugaaaggagccagacacaaaaaaaggauauacuguacaauuccauuuauacgaagcauaaaaucaggcaaaaaucuauaaaucuguccugccagaagucagugguuuuccagacucgaaggcagguacaagcacaguuagggugcugguaacauucuguuuaaacucuguucugcugguuacauggguauguucacuugaaaauccaucaaguuuuauccucaugguuuguguacuuuucuguauauauguuucacuucaauaaaguuuauuuuuggucaagggcagugucucauaccuguauucccagcacuuugagaggccgaggcagcccgacugcuuaagcccaggaguuccacagcagccugaggaacauggagaaacccuucucuacaauuuuuuuucuuuuugagaugggagucucgcugugucaccaggcuggagugcagcggcgcgaucucggcucacugcaaccuccgccuccuggguucaagugauucuuccucagccucccaaguagcugggauuacaggcgcaugccaccacacccagcuaauuuuuuuuauuuuuaguagagaugggguuucaccauguuggccaggauggucuccaucuccugacuucgugaucugcuugccucagccucccaaagugcugggauuacaggcgugagccaccaccccuggccuacaaauuuuuuuaaaaaauuagcugggcaugauggcacuugccugucgucccaaccacucaggaggcugagaugcgagaaucacuugagcucaggugguggagguugcaaugagccgagauugugcaccacuacuucagccugggaaaaagagagagacacagucuaaaaaaaaaaaaaaaaaaaaguauuuuuuaaaaaacaugaagaaauagaaaucuugacuagaccuauaauagcuaaaacagccugagucaguauuuuaaaaucuacccaccaagaaaaacgaaauuccaagaccagaugguuuuccuguucaauucuaccagauuuucaagaaacagauuuuuauuuuauacaaucugugccagagaaaagagugacaaacucacuuuaugaggcuuguguuuuguuguuguuguuguuguuuuugagacggagucuugcucugucgcccaggcuggagugcaguggcgcgaucucggcucacugcaaccucugccucccggguucacgccauucuccugccucagccucccaaguagcugagauuaugggcaugugccaccacgcccggcuaauuuuuguauuuuugguagagacgggguuucacuauguuggccaggcuggucucgaacuccugaucucagaugaucugccugccucagccucccagagugcugggauuacaggugugagccaccacacccagacuaugaggcuuauucuaauaagacugacccccaaaacagaaaaggacaguuuaagaaagaaaauuauagguuacuuucucaauugugauaauagauguaaaauauauauguguauauauauauauauauauauuuaaacacuuuuagcaaaaacaaaauuaaagaauaaaucaguugauguaauuuacugcauuaauagauuaaaggagagauuuaggacuguaguucucuugucugguaaaacauacauaugcauacacauauacaaaaauuucacauguuaagugugugucaaugcauucuacaguacuguuucuaaaagcaaaauauuugauauaaccuaacugcccagcaacaggagaaaugauagauacuuacacaauggauuaauaaaagcaguucaaaugaauguacuaaagcuaacguaucaaucaaauuacaaaaauauguaaauuuugacaucaaaaucauaaaauguugagggggaguaaaaguauaguuuuugauugcuauuaaaauguuaaguuguuaucagcuuaaaauagccuguaguaaguaaaagauguuuuauguuauccccaugguaaccacaaagccaaaaccuaaaaagaaaggauucaaaucauaccaccacagaaaaccaucaaaucacaaaggaagacagcaagagaggaagaaacaaaggcucuacaaaauaaccagaaaacuacaaaauggcaguagcaaauaucaauuauuaccuuaaguguaaauggauaaaacaaacaaacaaacaaacaugccagauguggaggcucacaccuguaaucccagcauuuugggagccgaggcagguggaucacgaggucaggaguucgagaccagacugcccaaagagaccagccuggccaacauggugaaaccccaucuccacuaaaaauacaaaaaguagccgggcgugguggcgggcgccuguaaucccagcuacucagaaggcugaggcaggagaacugcuuaaacccaggaggcggagguugcagugagccaagauuacgccauugcacuccagccugggcgacagagugagacuccaaaucaaaaacaaaugaaaaacagacccaacuauauacuagcuacgagaggcaguagggauacauauagacugaaagugaagaaauggaaagagauauuccagguaaauggacacuaaaagaaagcuagagugguagcuauauauauauauauauauauauacagagugguagacaaaacagacuaagucaaaaacuguaaacugagacaaagaaggucauuauauaaugauaaaauggucaauucaucaaggggauauagcuauuauaaauauauaugcaccuaauguuagagcaccuaaacauauaaagcaauuacuaauuaauaugagaggagagacugaaaugcaguaacaguaggagacuucaauaccccacuugcaacaaugaacacauuauccagacaaaaaauacagaaacauuggacuugaauuauacuuuagaccaaacagaucuggcauauacagaacauuccauccaauagcaacagaauaaacauuauucucaagcacaugcagaauauucuccaggaucauauguuagaggucauacaauaagacuuuaaaaauguaagcggaggccaggugugguggcucaugccuguaaucccagcacuuuaggaggcugaggcagguggaucacuugaggucagaaguucaagaccagccuggccaauguggugaaaccccaucuuuacuaaaaauacaaaaaauuagccagguguguuggugggcgccuguaaucccagcaacuugggaggcugaggcaggagaaucacuugaaccugggaggcagaaguuaugguuagcagagaucacaccauuggacuccagccuaggcaacaagagcaaaacuccaucucaaaaaaaaaaaaauaagaggauugaaaucauauuagguacuuuuccaaucacaauggcauuaaaccagaaauuaauaacaggggaaaucaugggaaauucauaaauauguagaaauuaaacaguaugcuccugaaucaccaauggguccaaaaauaaaucaaaaaggaaaucauaaaauaccuugagacacaugaaaauggagacauaacauacaaaaacucaugauaugcagcaaaagcaguuuuuuuuguuuguuuuuucuuuugagaccuggucucacugucacccaggcuggaguacaguagcaugaucauggcucacugcagccucaaccuccuggguucaaguaauccucccaucucauccucccaaguagcugcaacuacagguaugugccacuaugucuagguaauuuuuucaauuuuuguagagacaggguuucaccauggcuggucucuaacuacugggcucaagccuuggccccucuaagugcugggauuaaugacgugagucaucacacccagccaacaaaagcaguucuaagagggaaauuuauagcaauaaacaccuauaucagaaaagaagaaaggcaucacauuaccugacuuuaaaauauacuauaaaacuauaguaaccaaaacaguaugguacugguauaaaaacagacacauaggccaauggaacagaauagagaacccagaaauaaauacauguauuuacagccaacugauuuuucuuucuuuuucuuuuuuuguuuuuuuuuuugagacagagucucgcuccaucacccaggcuggagugcaguggcgcgaucuuggcucacugcaaguuccgucuccuggguucacaccauucuccugccucagccuccugaguagcuggggcuacaggcacccaccaccacgcccggcuaauuuuuuuuuauauuuuuaguagagacgggguuucaccgcagucucgaucuccugaccucgugauccgcccaccucggccucccaaagugcugggauuacaggcaugagccacugcgcccagcccagccaacugauucuucaaaaggugccaagaacauaccauggggaaaggacaccugcuucaauaaauuguacuggaaaacuggauauccauaugcagaagaauaaaaccagacccccaucucucaccacauuaaaaaaaaaaaucaacucaaacuggauuaaugacuuaaacauaagaccugaaacgauaaaacuacuagaagauaacacaaagaaaaugcuucaggauauuggucuaagcaaagauuuuauggcuaaggccuuaaaagcacaggcaacaaauugaaaaacagacaaaugggacuauguuaaacuaaaaagcuucugcauagcaaagaaagcauucaacagaaugaagagacaaccuguaaaauggggaaaauauacuugcaaacuauucauuugauaagguacuaauauccagaauauacaaggaacucaaacaacucaacaacaacaaaaaaagaaauaaucccauuaaaaagugggcaaagggccaggcgugguggcucacaccuguaaucccagcacuuugggaggcagacgcgggcgaaucacuugaggucagaaguuugagacuagccugagcagcauggugaaaucucaucucugcuaaaaaugcaaaacguagccaagcaugguggcacaccccuguagucccagcuacucgggagguugaggugggagaaucccuugaaccugggaagcagaggcugcagugagcugagaucacaugacugcacuccagccugggcaacagagcgagacucugucucaaaaaaaucaguacaauacaauaaaaaaaaagugugcaaaggacaugaauacacauuucucaaaagaugacaaauagccaacagcuauaugaaaaaauguucaacaucacuaaucaucugacaaaugcaaaucaaagccacccugaggccgggugcgguggcucacgccuguaaucccagcacuuugggaggccgaggcggguggaucacgaggucagcagaucgagaccaucuuggcuaacccggugaaaccccgucucuacuaaaaauacaaaaaaauuaggcgggugcgguggcgggcaccuguaaucccagcuacucaggaggcugaggcaggagaauggcaugaacccgggaggcggagcuugcagugagccgagauagugccacugcaguccagccugggcaaaagagcgagacuccgucucuuaaaaaaaaaaagccacccugaaauaucaucucaccucaguuagaaugcaaaaagaugaaaaauaacaaauacuggcaaggauacagagaaaagggaacucuuauaugcuguuggugggaauguaaauuaguacaaccguuauggaaaaccagcaugcagauuccucagagaacuaaaaauagaacuauuauaugauccagcaauccacuacugggcauuuauccaagggaaagaaaaucauauccaagggauaccugcacccucauguuuauugcagcacuauucacgacauccaagauacgagcuggccauaguagcugcuugugccuguaaucccaacauuuuuggaaggucaagacaaggaggaucacuugaggccaguaauuggagaccagcuagggcaacauagugagauucugucucuacaaaaaagaauuaaaaacucagcugggcaugguggccuaugccuguaguccuagcuacucgggaagcugaggugggaggaucucuuaagcccaggaauuugcgguuguaauggagccaugauuucaccacuugcacucuagccuugggcaacagagagagacccuuuuuuuuuuuuugagauaggguuucccucugucacccagacuggagugcaguggcauggucucggcucacuuuagccucgaccuuucugggcucaagugauccucccaccucagccuccugaguggcugggacuacaggcacaugccacaauacccagcuaauguuuauuuuuuguagagacggggugucacuauguugcucaggcuggucucaaacuccugggcucaagugaucugccugccuuggccucacaaagugcugggauuacaggugugagccacugcaacuggccgacucugucucuuccccgcccccgccaaaaaaaaggaauauucuucauuccuaaaaagaaugaaaucucaucaucugcaguaacauggauggaacugaaggucgucauguuaagugaaauaagccaggcacagaaaaacaaauguugcauguucucacucauaugugaggccuaaaaaaaguucaucucauggagguaaagagauaguuaccagaggcugggaacaacuuggggaggauaaagagagaggcugguuaauagauacaaacguggauagaaggaauaaguucuaguguuugacagcauaauagagucacuauaguugacaauaacugcauauuauuuguauauuucaaaauagcuagaagauuggaaauauuuccaacucaaagaaaugauaaagguuugaggugauggaaaccuuaaauaccccaauuugguucuuuuguuuguuuguuuugagauggagguuugcuccguugcccaggcuggaguacaaaggcgccaucucagcucacugcaaccuccaccucccuggugcaagugauacucgugccucagccucccgaguagcugggauuacaggcgcccgccaccaagcuuggcaaauuuuuguauuuuuaguagagaugggguuucaccacacuggccaggcuagucuugaacuccugaccucaggugauccacuagccuugaccucucaaagugcugagauuacaggugugagccaccaugcccagccaaaauaucccaauuugaucaguacauauuguauacauguaucaaaauaccacauguaccuuguauguacaauuauuauguauuaauuuuaaaaacaauuucagaaaaagaagaucucaacaaucuaacauuacaucccaaggcacuagagaaagaacagacgaagcccaaaauuagcagaaggagggaaauaacaaagaucaaagcagaaauaaacaaggacuagaaaaacaacaacaacaaaaucaaugaaacuaagaguuguuuuuuuaaaagauaaacacaauugacaaacuauuagcuagacuaagaaaaaaagacaacucaaaaucagaaaugaagccgaguacaauggcucaugccuguaaucccagcacuuugggaggccaaggcagguggaucacuugaggucaggaguucaagaccagccuggccaacacagugaaacccccaucucuacuaaaaauaaaaacacuagcugggcauaguggcacacaccuguaguucuagcuaguugggaggcuaaggcaggagaaucacuugaauccaggaggcggagauugcagugagccaagaucguaccacugcacuccagccugggcaauagaacgagacuccaucucaaaaaacagcagaaacaaaagaggacacauuacaauucauaacacaaauauaaaggauccuaagaaacuacuauaaacaauuauacaucaacaaauuggauagucuagaagaaauguauaaacuccuagguacauacaaccuacuaagacugaauuauggagaaauaggaaaucugaaaaggcaaggcaugguggcucaugccuguaaucccaacagucugggaggccaaguggguggcuugauugagcccaggaguuuaagaccagccugggcaauauagugagaccccaucucuacaaaagauacaaaaauuagccaggcaugguggcaugugccuguagucccagcuacuagggaagcugaggugggaggaucaguugagcccaggagaagguugcagaauagaucaauuacaaugaaauugaauuaguaauaaagucucccaucaaagaaaagcucaggaccagacuacuucacagcugaauucuacccaacauuuaaagaagaucuaguaccaauccuucucaaacccuuccaauaaauugaaccagagagaauuuuaugaggccagcaauacccugauacuaaagccagacaaggacaguacaagaaaagaaaauuacaaggcaagagcccugaugaacauagaugcaaaaauccucaacaaaauaguagcaaaucaaguucaacaucauauuuuuuauuuuauuuuuugagauagagucucacucugucacccaggcuggaauacaauggugcagaccuccaccuccuggauucaagugauucuccugccucagccuccugaguagcugggacuacaggugugugccaccacgccaggcuaauuauuuuguauuuuuaguaaagacaaguuuucaccauguuguccaggcuggucucgaacuccuaaccucaagugauccacuugccucggccucccaaagugcugggauuacaggaaugagccaccacauccagccacucaccacuucuuuucagcauaguacuggaauuccuagccagagcaauuaggcaagagaaagaaauaaaaggcacgccaauaggaaaagaaaaagugaaauucucuguuugcugaggacacgaucuuauauagagaaaccccuaaaaacuccaccaaaaaacuguuagaacugaaaugaauuccauaaaguugcaggauacaaaaucaacauauaaaaaucaguagcuuuuuuuuuuuuuuuuuuggugagacagggucuugcucugucacccaggcuggagugcaguggcaaaaucacagcucacugcagccucaaccuccugggcucaagcgauccucccacaucagccucuggaguagcaggugugcaccacuauacuuggcuauuuuuuuuuuaauuuuauguagagacagggucucccuauguuguccgggcuggucuugaacucccggacucaagcaauccucccaccucugccucccaaagcgcugggauuacagguauaagccacugcauccggcuacaguggcauuucuauacauuacugacaaacuauccaaaaaagaaauuaagaaaauaaucccauuugcaauagcaaaaacaacaaaaacuacuuagguguaaauuuaaccaaggaggugaaagauacugaagacuauacguauugaagaaagaaacugaagaaaaugcaaauaaauggaaagauauccuguguucuuggauuugaaaaauuaacauugcuaaaauguccauacuacguaaaacaaucuacagauucaaugcaaucccuaucaaaauuccaaugaaaauuuuacagaaauagaaaaaaauccuuaaauuuauaugcaaugacaaaagaccucaaauugccaaaacaaucaggccaaaagaacaaagcuggaugcaucgcacucccugauuucaaaauauguuauuacauaaagcuauuauaaucaaaacagcauguucuggcauaaaaaccgaacuguagaccaguggaacaggauggaaugcucagaaauaaacccaugcauuuauggucaaaugauuuuccacaaaggugccaagaacauacaauagggcaaggacaguaaauaaauggugucaggaaaacuggauauucacaggcagaagaaugaaaguggauccuuauaucauaaacaaaaaccggcucaaaauggauuaaagacuucaauauaagaccugaaacuauaaaacaacuaaaaguaaacauggagacgcuacacagcguuggccuagacaaugauuauuuuggauguaacccuaaaagcacaggcaauaaaagcaaaaauagacaaagggaauugcaucaaauguaaaagcuucugcacagcaaaggaaacaauuaacaaagggaagagauaacacaaagaauaggugaaaauauuugcaaaccauacaucugauaagcaguuaauaucuaaaauauauaagaaacucaacucauuagcaagaaaacaaauaagcugauuuuaaaaugggcaaagaaccagaacagauauuucucaagacauacaaauguccaguggguucaugacaaaaauguucaacaucauuaagcauuaaggaaauagaaauuaaaaccacaaugagcuaucacuucacaccuguuagaauggcuacuaucaaaaagaugaaaguuaacaaguguuggcaaagauguggacauaaaggaauccuguacuuuguuggugggaauguaaauuaguacugucauuauggaaaaugguauaaagauuuaaacaacuaaaacuaagccaggugugguaacacaugccuguagucucagauacuugggaggcugaagugggaggaacgcuugagccugggaguucaaggcugcagugagcuaugauugugccacuguacuccagccugggugacagagcaaaacccagucuuuaaaaacaauaacaucaacaaaaaaaaaacccuaccaccagcaaucugacuuguggauauacguccaaaggaauggaaaucaauacauugaagggauaucuacaugcccaugcucauugcaguauuguucacaauagucaagauauggaaucaaacuaagugucugucaguggauaaaugaauaaagaaaacaugauauauuuggaauacuauucagccuuuaaaaaggaaauucugccauuugcaacagcauggguggaacuggaggacauuaugcuaagugaaauaagccaggcacagaaagacaaauacugcacgauuucacuuauauguggaaucuauugaacucacugaaguagagaguagaauggugguuaccacaggcuggggaggggagugaggaaucaggaguuuuuggucaaaggguauaaaguuucagugaggaaguuugagaucuauugcguggcagaguggcuaucguaaauaaaagguauuguguauuucaaaauagcugagcaaauuucaaaugccucaccacaaaaaauaagugaggugaggaauauguuagcuugauuuaaucauuccacauuuuguguguguguguguguauauauauguauauauguauguguguguauauauauguauauauguauauguauauguauauauguauauauguguauauauguauauauguauauguauauauguauauguauauauguauauguauauauguauauauguauauguauauauguauauguguauauguauauguauauauguauauguauauauguauauuauauauguauauguauauauauguauauauguauauguauauauguauauguauauaaucucucaaaacaucacauugcaccccauuaauguauaaaauuuugauuuaucaauuaaaaauaauauuaaugaguuuaaaagcuaauguauugauggauuaauaucauuaaagauaacauugaagagaaaaaacagcuauagaagaauaaguucaguaugauacuacauuuagagaacaugcaaaacagaaaaugcaaacauuuguggaaaagaauacaugggaauaauauacaccgaauucggguaaugguuacaucaggaaacggaagggagcgggaucauuaaagacacacagggggcuuuucuuuuauacaguauuauauuauuuuauuuuaggcaggguuucucucuguugcuuaggccggagcgcaguggcacuaucucagcucgcugcagccucaaccucccaggcucaagagauccccccaccucagccccucgaguagcugggaccacagguaugcaccaccaugcucugcuaacuucuguauuuuuuuguagagauggggauucgccauguugcccaggcuggucuccaacucuugagcucaagcaauccuccugucucagccucccaaagugcugggacuacaggcgugagccacugcuccuggccuguauuuuauuucuuuaccuagguggcaaauagcaugaauacuuacuccguucagauuccugugccugaaguauuucauuguuuuaaaaaacacucuuucuagaaaccaaugauuugaggaggguugaaggaguuagauauuguuagcauaugguugccauuuccaaauauuugaaggaacauguauaagaaaaaaagguauucuguuugcuaaugcauauguacaagcauguguuaacuguaagccacauacauauugcuaucacugcuucagaggacagauuuaggacaaaugggaagacacuacaaggaggcagguagauuugggcucaauauagacauguuuaacaaucagaggcagcacaaugucagagacgagagcaagacgguuuggagccagccugccuggguucagaucuuggcucugcucuuuguaggcaguaugauuuggggcaaauuauuuaaccucucugugccuguuuccuauucuguaaaaugggaauaauacagagugccuaccucguaggcuagaauaaggauuaaaugguugauuauuuguaaagugcuuagaacagugccugauacauaauaaacacuauguaaguguucguaaaauaaaucuaacaaagaaucuagcaaaugaagagccugccuuguaaagcaguaaacucuucaagggcucaugcaaaggcuggauaaaucucuuuuaaggauggugcagggauauccuucccuucuagucuacagauguaugcuucuuaaacuucauuaugcacagaaaccacagagggaucauauuaaaaugcagauucuaagccaaugagccugagguggggccugagauucuuuuuuuucuuuuuucugagacggagucucguucugucauccaggcuggagugcaguggcacgaucucagcucacugcaaccuccgccucccagguucaagugauucuccugccucagccuccugaguagcugggacuacaggcacaugccaccacgccuggcuaauuuuuuuuuguauuuuuaguagagaugggguuucaccauguuggucaggauggucucaaucuccugaccucaugaucugcccaccucagccucccaaagugcugggauuacagguguaagccaccaugcccggccugagauucuuuauuucuaacaaguggugccaaugcuacgguucuccugaggaccacaccuuaaguagcaaagcucuagaugguuuuauuccuacugucaugcaucauaauuucaaagaugcuuaguuuuuuauuguuguuuuuuuuuuuuugagaccgagucucacucgcucaggcuagaguacaguggcccaauaucgcucacugcaacuucugccuccuggguucaagcaauucuccugccucagccuccugaguagcugagauuacaggugcaugccaccacacccagcuaauuuuuuuguauuuuuaguagagacgggguuucaccauguuugccaggcuggucucaaacuccugaccucaggugaucugcccgccucggccucccaaugugcugggauuauagaugugagccaccaugcucaaccucacagaugcuuaguucuuaccucugaugaaucuucaauuugcagcaaauucuaaacacaguucucuuucgaaaccaacuuuugaccccuuaauuaaccaauaauaguuugauuacuaaaagaacuaaguuuuuuuuuuuuuuuuuuuuuuagagaugggguuuugccauguugccagggcugcuagcuugaacuccgggacucaagugauccuccuaucucagccucccaaagugcugggauuacaggcgugagccacugcacccagccuaggaguaagaauuuauaggagguuuggggugauguuuuauauaaacauauauuuccauacugcacauaauuacuuuuuuuuuuuuaagagauggagucuugcccugucauccaagcuggagugcagaggagcaaucauagcucacuauagucucuaacuccuggccccaagugauccuuccacgucagccuccacaauugcuggaauuauuaauacaagagggagccacugagcucagcaauaauuauaauuuuuauauucaauucagauuuuugucauuuggauuuucuuaaagcagaaacaucuauaugagaaauaaaaauaguaaaauauaagggaggcaguuccugcacuguucgggaaucuacauuagagucugcauuugauauaauagagaagaggaugccacucuagauucccaagcaaggaagugagagaagaaaaaccauguuugggagcaggauaaauuggaaaggagaauguugagacucgaagugaaaacacaaaauacagaacugauaauuuuguuaaaguguggagguaugguucugagagcugcuaaugaggaagaccagugggauucacaucuuagaauacauuaauucaacaauaagcugaagaggcaaauuagacuucgguggacucuggugaauccuacugggcuccggugggagucucaaccauuugauaugacauaacuggaccuccagguacaauuugaaauaugaguauguucugagacugaucguuaacaccgugauccagaacagaaacccacagaauggcuugcuacuuggggaugguugauaugaguuccggugguuuggucuaaauuauacuccaugcuuucuuuccuucaggaaaucuuuauugaucauagucgacuuagaaccauagggaccccagcguuuuucuaggccuggcugcauacaggaauugaaucuuguggcuaguauguaccuacucuuuuggggcuuggucacaaagugguucacgguuauucaacauaaagcuaucagaggcugggcaugguggcugaugcuuguaaucccagcacuuuaaggggccagggugggagggucccuugagcccaggaguucaagaccagcaugggcagcauagugaaaccucaucucuacuuuaaaaaaaaaaaaaaaaaaauugguggcacaugccuguagucucagcuacuuggggaggaucaguugaguuggaggcugcagcgagcugggauugcaccacugauggcacuccagccugggcaacagagcaaggcccugucucagaaacaauuuuaagcuguuggaaccaacuucugcugcugcugcuucuaggagcacaauuugcaguauccuuagaucuuagaucugaaauagccacugaguggagagaaaauagagaggcagugaacaguauauuuuauuucuuuguuccucuacuugucuaggucaaaguggagaguuuccuggucuauauuuuuuaaaaguagggcauaagccagggagagacaggagaaauagggauucaagcagauaauucuggaguuuucuuuaaaauuggauuacuuuuaacaguuuguuuuuacucaccaccacugcacagagguuguauuuaggauauuuccggaaaauugagcaaauauaaggagugagguccaaguuagugaguggguaaugaauauccguucucagcuuccuuuuuguuguacccugaaugucaaaccugcagguauaauaaaugugugaaauacaaaguaagcuugugaaccacucauuugucuacaugacaaauuccgaguauuuuaaaaguaauuucuugacugggcacaguggcucaugccuguaaucccacaacuuugggaggccaagguggacauaucccuugagccuaggaguuugagaccagccugaguaacauggcaaaaccccgucucuacauaaaauucucaccuguagucccagcuacucaggaggcuaagguaggaggaucaccugagcauagggaggcugaggcugcagugagucgugauugugccacugcacuccagccugggugacagagugagacccugucucuaaaaaaaaggaacuucuggccuggcaagguggcucacgccuguaauccuagcacuuugggaggcugaggcggguggaucacuugaggucaggaguuagaaccagcuuggccaauauggugaaaccucgucucuacuaaaaaugcaaaaaaauuagccgggcaugguaguggaugccuguaaucccagcuacucgggaggcugaggccggagaauugcuugaaccugggaggcgaagguuacagugagcugagaucgcaccacugcacuccagccugggugacagagcgagacuccuuuccaaaaauaaaaaauaaaaaaaaaaaguaauuuccuggaaagauuauuugguacagacuuauaaauuacuuuuuucuuaucuauuuaaauaccgcauccacaagccucaccaaaaugagacuggaauuugaaucaaggagugagauagcaaagauucaagcuaaacugaaucuagcagggcaaaaagaaagggauaaccaaggcucaacauugggggaagcagaaaccccauugauaauuccugaggcuuuugcuccagcugagccuauuuauucuaaccaagcuagcucagcuuuuccuuaucuuguuuucagcacagguagucuuggcaauguccuguuuucaagcucugaguuuuuguuuguuuuuuuuuaauguuuuaauaagaacauuuugugaaaaucuuucacauucuguauuguuacauggauccuaaguuuguaaaucugggcucacaucagaguuacucagaagcuuuuaaaaauauaauuauguucauuuuggaaaaauggcugauggaggucugaggccgggaaauuaccgcgacugagacauucuugugucagaaagcaagauacccuguuuucaaaaaacuaagggaaugccaugugauccagcaauucuguaccuagguaucaucccaagagaaaugaagccuuaggcccacauaacaagcuaucugcuaguauuuguagaaguuguauuccuaacuaugcaaaacuguaaacaacccaaacguccaucaacugguggagacauaagcaacuaugguacacucacaaaaaggaauagcacacagcaauaaaaaaggcacuacuaaugcacgcaacaacacaaaagaaucaugcuaagugaaagaaaaacucugaaagcuacauacaguaugacauagcacguucuggaaaacaaaauuauagggacggaaaucagaucaacaauuucuauaggcuuagggaggagaaugauuagagaggagcaugagauaacuuuuuggggugauggaaaugguuuauauguugguuguaaugguuacaugacugcaugcauuugucagaguucauagaacugugcaccuaaaaaugauacauuuuagguaagcauacccuaauaaacuaauggggccccaggagcugacuugaaggggcucccacuggccaauuuugaacaauuugaacaccaaaagcaaugaugagagacaucuaguuuucaguucaacacguaaggaaacuuugaagucaccauucuguccuaacaaguuaaaagcuaaauaaagcuuuugguuauuuuccuucccucaggaaggaaagaauuaaccgaaaggaaaauaaacagcucuucuuagagcugaaagagcagugaggucacaggacaaaccacugcccccaaaacuggaaaaacagaccagcaaacauagagaaucacagacuuaccagagccaaaacugccgagcagaaaccucugagggaacaggucugcguaggaaaaccugaacuguaauugaugaauugcuagaggcucagugcagagucugagaguuaaaaacuccaaagaauccagucacagggggaccacacuuugugaauuuuccuuccaggagcccaaccacacucgcacgguaaauauuagagacaaaucuccucaugcuucuggcaagaagaagggaaagaaaccauucugaaauaggcuaaagcacccuguucguaaagccugcccacaggagaaacucauuaaccagagccuaaccugcuggggucuuaucagagcuuaacuaaccugggagaaggaaaacacccaacuccagcccacucuagccauccuguuccaccgaagcggguguggagggacugagcagcgcuugugaaguucguagucuggaggcugaaguucauuaaaagaccgagacccacucauaggauuauggaacgcuuccccucccccuccgccuuaccaccccaucauuaaggucuauuuaagucaguuucucuuacccaguucaucauaucuggcuaucaggaaaaaauuacaaggcauacuaaaaggcaaaacacacaguuugaagagacaguaagcaucagaaccagauagcgcaggggugugggaauuuucagacuaagaauuuaaaacugaucaacacacuaaggguucuaacgaauaaaguagacagcaugcaagaacagacggucaauguaagcagagacuuggaaauccuaagaaugaacgaaugaaccaaaagaaaugcuagagguauccuuguuaguacagugguuaguuucuuuucuuuucuuuuaacuacuagaggaaaaaacugcaucuucuaacaugugaagaaugccucugaugggcucauuaguagacuggacacagcugaagaaagaaucucugagcuugaggaaccucaguagaaacuuuuaaaacugaaaagaagaaagaaaaaagacuggccggucaggcgcaguggcucacgccuguaucccagcgcuuugggagaccaaggugggagaaucgcuugagcccaggaguuugagaccagccugggcaacaaaguaaaagccccucccccugcccccaccaugccuccuaaaaaaaaaagaaacaaagaaaauagacuaaaaaaaaaaaaaaagcacaacaauauccagggacugugggacaacuacaaagauguaacaucuguguaauggcaauaccaaaagaaaaagaacagaaaaaauauuugaaacaauaaugacugagaauuuucccaaauuaaugccauacaccaaaccacagauacaggaagcucagagaacaccaagaaagauaaauaccagaaaaaugacaccuaagcauuucauuuucaaacugcagaacaucaaagauaaagaaaaaaauccuaaaagaagccagagugggggggaaaaaaacacaccuauagaggagcaaacauaagaauuacaucuaacuucucagaaaccaugcaaacaagaagaaaguggaaaaaaauauugaaaguguuaaaaggaaaaaaacccaccaaccuagaauucuguaguguaaauuaaccuucaaacgugaagggaaauaaauacuucacuggacaaagaaaaauuaagggaauuuuuugccaguagaccugccuugcaagaauguuaaaagaggucuggcacgguggcucaugccuguaaucccagcuacuuugggaggccaaggcagguggaucacuugaggucaggaguucaaaaccacccuguucaacauggugaaaccccgucucuaccaaaaauacaaaauuagccuggcaugguggugugggccuguagucccagcuacucgggaggcugaggcaggagaaucgcuugaaccugggaggcagagauugcagugagccgagaucaugccacugcccuccaggcugggcaacagagugagacuccaucucaaaaaaaaagaaauguuaaaagaaaucguuuacagagaaggaaaaugauauaggucaaacacuuggaucuacauaaaaagcacugaagaaggaauaagugaagguaaaaugaaaacuuuuauuuuucuuauuauuaauaacaguuuauucaaaacaauaauagggacaauauauucaauuauguaugcuuaugcauauaucauauauauucuuguguaucuuuauauauaagugaaaugaaugacagcagugauacaaggaaagcaguaugguauuauuugaaaguggaccaggauuaguuguaaauguauauugcaaacucuagggcaaccacuaacaaauguuuuaaaaaguauaacugaugugguaauaaaggagagaaaauggagucauauaagaugcucaguaaaaccacaaaaagcaggaaaagagugguagauaaaaacaggaacaccaagaacaagggcaacaaauagcaguaacaaauacaacagauauuuaacccaacggcaucaacaaucacuuugaaugucgauggucuauauacauuaauuaaaacacagauuguuuuaauccgugaaucaaaaacaaaauucaacuguguacuguguacaagaaacauacuugaaauauaaagacacacagagccuaaaaguaaacagaggaaaauauaccauccuaccacuaagaaagugggaguagcuauauuaauuucagacagagcagucuucaaagcaaagugauugaggauaaaaagggccauacauaaugauaaagggaucacuuuuucaagaagacauagaaauuauuaacauauaugcaccuaacaacaaagggucaaaauacaugaggaaaaacuggcuggguaccguggcucaugccuguaaucccagcauuuugggaggccgaggugggcgggccacuugaagucaggaguucaagcccagccuggccaacauggcuaaacccugucucuacuaaaaauacaaaaaccagccaggugugguggcacgcaccuguaaucccagcuacuggaggcugagacacaagaauugcuuaaacccaggaggcagaguuugcagugagccaagacggcaccacugcacuccagccugggcaacagagugaaacucugucacacacacacacacacacacacacacacaaaaauugauagaagugcaaggagaaauagaugaaucacuuuuauaguuggagauaucaacacaccucugucagaaauggacagauccagcaggcaaaaaauuaguaaggacauaguuaaacucaacgacaccaucuguccauagauguaauugacaucuguagacucuuucacccaacaacagcagaauauauauuauucucaagcucacauggaacauucaccaagccucuagcuaggcuaaauaaggguaaguuagaccuucuggccuaaggugugcuuguuaaaacacacuuuaacaaauuuaaaauaauagaaaucauacaaucucugcucucagaccacaauggaauuaaacuagaaauaacagaaagauaauuaggaaauccccaaauacauggagauuaagcaacacacuucuaaauaacacaagucaaagaagauagcuugaaagaaauuucaaaaugggcugggcacaguggcucacgccuguaauuccagcacuuugggaagccaaggugggagaaucucuugagcccaggaguucaagaccagccuaggcaacauagugagacaucaacucuacaaaaaaauuuuaaaaauuagcugggcaugguccuagcuacauaccuuuaucccagguaugcaaagcugguccuacauuggaaaaauuaaugaaaucuaucacauaauuagguuaaaggaaaaaaaaucacacacacaaucaaaucaacagacacagaaaaagugucugacaaaauccaauacccaucaugauaaaaacucucaguaaacuaagaauagaggagaacuucuucaacuuaauaaagaaugucuacaaauaaucuacaguaacaucauacuuaauggugaguaacuagaagcuuucccacuacagucaggagcaaggcaaggauguccccucaccacuacuuuucaacauuguauuagaagaccuagcuaaugcaauaagaaagacaagaaaauaacagguauagagacagggaaguaagaaauaaaaccgucuuugucuacagaugacaugauuguauauguugaaaaucugaaggaaucaacaaaaaaaccucuuggaaauaauaaacaauuauagcaagauuguaggauacaagauucauauacaaaaaguauauuacacaucagcuuugaacaaauggaauucaaaauuaaaaauauggcugggcaugguggcucacaccuguaaucccagcacuuugggaggccaagguggguggaucaccugaggucaggaguucaagaccagccuggccaacaugacgaaacccugucucuacugaaaauacaaaaacuagucggguaugguggugcaugccuauaaucccagcuacucaggaggcugagacuggagaaucacuugaaccugggaggcagagacugcagugagccgagaucgugccacugcauuccagccuggacaacagagcaagacuccaucucaaaaaaauuuuaauuuaauuuaaaaugaauuaaaaaaaaacacaauaccauucacauuagcacccucaaaaaugaaauacuuaguuauaaaauuaacaaaauauguacaagaccuauagaaggaaaacuagaaaauucucaugaaagaaauccaagaggaaccuaaauagagagauauauucuauauucauggauaagaagcuucaauauugucaagaugucaguucuucccaacuugaucuguaaauacaaugcaaucccaaucaaaaucccagcaacuuauuuuguggauauugacaaaaugauucuaaaguuuauggggugagguaaaagauccagaguagccaaaacuauacugaaggaaaacauaauuggacugacauuaccaaacuucaaaacuuauuuuaaaaccagaauaaucaagacaaugugguauuggugaaaaaaauagaaaaauaaugguauagacaagagagcucagaaagggacccacaaagauauaaucaacugaucauugacaaaggaacaaagguaauacaauggagaaaagaugaccuuuuucaacaaauggugcuaggacaacuggauauccacgcgaaaaaaaaaagaagaagaagaagaauccacacacaaaccuuacacccuucacaaaaauuaacucaaaauggaucacagaccaaaauguaaaacagaaaacuacaaaacuccuggaagauaacacuggagaaaaucuagauaaucuuguguuuggcaaugacuuuuuagcuacaacacgaaaggccugcuuuacaaaagaauugauaagcuggacuccauuacagucaaaauuuucugcucuacaaaacacugucaagagaauaaaaaacaagccauggacuaaaaaaaaaaaaagacacaucugguaaagaacugcuauugaaaauauacaagaaacuuggccaggcacaguggcucaugccuauaauccaagcacuuugggagaccgaggugggcagaucgccugagcucaggaguucaagaccagccugggcaacauggugaaaaccugucucuaccaaaaaaaauaagaauuagcugggcgugguggcgggugccuguagucccagcuacucuggaggcugaggcaggagaauggcuugaacuagggaaguggaggcugcaagaaccaagauuucaccacugcacuccagccugggugacaaagcaagagacugaagaaaagaggggaggggagggaggggaggggaggggaggggagggaaggggagggaagggaagggaagggaagggaagggaagggaagggaagggaagggaagggucuuaaaacucagcaauuagaaaaccaacaaccuggccaggcgugggggcucaugccuauaaucccaaaacuuugggagaccgagguggguggaucaugaggucaagagaucagaccaucguggccaacauggugaaaccccauguuuaccaaaaauacaaaaaaaauuagcugggugcgguggcgugcaccuguagucccagcuacuugggaggcugaggcagaagaauugcuugaaccugggagguggagguugcagugagcugagaucacaucacugcacuccagccuggcaacagagugagacugucucaaaaaaaaaaaaaaaaaaaaaaaaaaagacagaaaaagaaaagaaaagaaaaccaacaacccaauuuuuaaaauacgccaaagacuuuaacagaccuucauugaaguaucuuaccagggacuagggggagcaggaauguggaguuacuaaagguuacagaguuucugugugggugaggaagaaguuuuagaaauagugaugacuguugcacaacauugugaauaauuaaugucaaugaauuguaugauuauaauugcuaaaauggcacaguuuuguguuaugcuguauauauuuuaucacaauuuaaaaacaauaauguaauauaccaaauaucauugaauuguauacucuaaaugggugaauuauuggcaugugaauuuuaucucuauaaggcuguucgaaaauaugugcccacaaaaauguaaaaauccauaccuuuuuagguggaaaauaauuauuuuuggugcuuuggaaauacuggcccucacagcaguuucuugcuugguuucacaaaaggagcagugaauuucguuguuccaggucagugcgucuuguugaaaaaaacauuggagacaguccuguuaaggaaaaaaaggauuuggugaccaaauuggaucaacugcaaccugcacucucuguuucuauuggaacuuugcaaaugccguggaaauguaguucucagugcuuuucucaaagucaacaaauccagaagacaacagucucacuagcugcagccagauaccuguaaaauccaccuagaagguguuucuuucuuguuacugagauggauuugagugccuaccucacuuauaaucuagaaaucaguuuuuuuugguuuuguuuuuuuuuuuuuugagauggagucucgcucugucacacaggcuggagugcaguggcaugaucucggcucacugcaaccuccaccucccaguucaagugauucuccugccucagccuccugaggagcugggauuacaagugcgcaccaccaagcccagcuaaucuuuauauuuuuaguagaaauggggugaucugccuaccuuggccucccaaagugcugagauuacagguauuaagccaccacacccagccuauacaucagcauuuuaacuuuucuguuuuuuuuuuucagaauaauacugauuuugcaauuuuuuuuuuuugagacggagucucccucugucgccaggcugagugcaguggcacgaucuuggcucacugcaaccuccaccuccuggguucaagcgauucuccugccucagccuccaaguagccgagacuacaggcgcgugccaccacacccagcuaauuucuguaguuuucauagagaugggguuucaccauguuggccgggauagucucgaucucuugaucucgugauccgcccgccuuggccucccaaagugcugggauuacagccuugagccuccaugcccagcuacuuugcaguuuucagcagugaaaucaggcagcugcuuuaugcuauucaucucauugcuaaaaugauccggugacaaaaaugacucucaggguuuggggguggcccauaauaaagauagcagaacagggauaaauuagaccccauauccauaggagagauccucaguguggccagcuccuugguucugcaaaccauuaacuggaagaagaagaagagcgcagauuuuguuugcagaggagccacuagcaccuuacuuagagugucaggaauuucuuuccaacaaucuuuagcaguuugagcugagaaacaaagcccagugcugaauaaguaauaggauucuauucuccaauucugguagguaaaacuuuuagcaauaaaaugugcuuucguaauuuaggaagaaaaaauguaaauuugcauaauucugcaagaaaacuuauugcuguccgccccuuguuugcuccuuauugcuggcugucuucuacugccacccaccccaugcccacauccccaguuacagauuaacuuuuggcguuguggugaagaaaauuugagagguaaaccaaggcacuagauuccauucucucuuuccaaaacauuucacaacuuuaguccaaaauauaagagcucaagucuaagagucuagaauguuuuauaucuaguucccaaucugggccuuacagaccucugggguaagggagggucauaaacuuuuugcaagaaauuauaaauuucuuuuaugcacaaaucuaccucaauagacucaauaaaccccacuauauuuccaauuuuacagucaggcuauuucguugaguacauuuaaaaauaugauugaauuccuaggaacuuuuggccaguaugucccuauaaaaaaaaauacugucaucauggacuuccucuuucuuuuauuuauuuauuuacuuauuugagacagagacucacucugucacccaggcuggggugcaguagugcgaucuuggcucacaacaaccuccgccucccagguucaagcgauucuuauggcucagucucccaaauagcugggauuacaggugcccgccaccauguccaacuaauuuuuguauuuuuaguagagacaggguuucaccauguuggccaggcuggucuugagcuccugaccucaggugauccgccugccuuggcuuucaaaagugcucggauuacaggcaugagccaccgcacucagucuauuuuuuuuuaaauuaaaguuauaaagccgucucucauacuaaacaaauguaggaaacagccccgagaaaauccggggcugagaguauagcgagacaaaguguccaggaauacugcauuccuacccgaagggagcauucauauuuggauggaauggggagugagaagacagugaagacuucguucuuguaggugcauuucucacacuuuaaacauacgaugcuauaauugagcugcucuucaaacagcugggugaugauggaugucucagugguaauccacuuccugcagcaucucugaguagauccuuucucauaugaucuucuccgggaguagugguacugaaucaaggagcaaauuucacccaaauuaauuauugguuauuuaaaaaagacuguggcaacauggugagaucccaucucuacaaaaaaaacaaaaaauuagcuaggcaugguggcacacaucuguggugccagcuacuugggagguugagguuggaggaucaguugagccuaggaguuugagacugcagugagccguguuagcacuacugcacuccagccugggugacagagugagaccauguuuccaaaaaaaaaggaaaaguuuucaauaaaaugacugauuuuuuuuucuaucagaaugagacauugcuaccagaaaccacuuaguuuuggauucagacaauagaguaagauauccuugaaaguauauauaucaugugugauuucugauaauucagauauuuucccguuagaugaaacagaggaaugaugacagucuaacucugguaaaacauauacccauggccccauaagcuaccagccuugggagcuaguuuuuucuggaaggggguaaguaagcuaaauuagcauuaguucacucaagcagaucuaaagguaaaauauuaagaaauccaaucuuuccugucuccagucccuucagguuacauucugcagccuuuacuccuuuaacuucuagaaaacacuuuuuuaaaagagcaaaucuuggccaggcaugguggcuaacaucuguaaucgucgugcuuugggaggcugaggcgggaggaguuugagaucagauugggaaacauaacaaaauccugucucuacaagguuaauuaaaaaaaaaaaaaaaagauaagagagcaaaucuuaaauuucuaaggcagccugguggaacuagccuuguggccugguuuggauccagcucauacucagcaacagcauuucuggggcacacccugaauuuucagugauuuaagagccucaguggaauauacauuuugaagauguguuagcuccacagcuggcucuaauuuggggcugugcucagcauuccauuuuugcuugcuccuuucaucacacucugcugccaaagucuuccacccugacaguaacuuaauuccccuaauuccuacuuugaucuugggaaacagaaugcuguuuguuucagauuggcuguagaagaggacauaagugauuuuuacugcccacucaccucuuuucuuaaaaaagugcugccaugaauauguuuuuguuuuuuuuuuuccuuuucauuuuuuuuuuuuuuuuuuuuucuuggagacggagucuugcucugucguccaggcuggagugcaguggcaugaucucggcucacugcaaccuccgccuccugaguuuaagcgauucuugugccucagccacccgaguagcugggacugcaggcuccugccaccacgccuggcugauuuuuguauuuuuaguagagacgggguuucaccguguuagccaggauggucuugaacuccugaccucaagugauccacccaccucagccuccuaaagugcuaggauuacagacgcgaaccacagcgccuggccaugaguacuuuuuuauuacucuaaaugaaaaauggaacugagaucugccaaugagaacaauuaauagcuauaguuugcaaccuuuaugcuaaccauucccuggguauuagaggugcagugagguaauguuagcagaaggauguugcauaaagucaaggacacauuuucagagaaugugggucucagaccaaggcuaagggcagugaguuuuguaaauaaaggcaaaaccucuagaguaacugaugauuucauguuuaaugaaauguauguccuaauucggugaugaacucagguuagguauguuugguaugaggaugaaacuuuguagugcguagaucuguugcuuaaucuaauaucaagcuuaauauuuucauggauuuguaggucccaagaaaauuuaagcuauaaaguucuauauguuauuucucaugaggaauauauuuugcacuuuuaaaaacuaguccauucagccucuauuuacaaagaaaaguagauuaguguuuccaaagccuagcugaccacuggaaaugccaaguaagcuuucccaaaagacauucuaauuaauuacccuuggaguauuugccuuaaaaucuguguuguaaaaucuucccagaugauucugaugacaaguaaguuugguaaauacagcuacacauucaaauacuaacuuggauguucuccaugggacaccuagcacagugcuuggcacaaaguagacaauauuaauugaacaaguaaaagaaugaaaaauggaagcugcugauaaagguucaggacuauccuauuucaaggucauuaacucuacuuaccuuuuuuagagcuucaugaaguucauuuaggacacaaaucaagaauuccugagcaucuuguugcaucuuuuucguaaaugcuggguagagguugccaagagcugaccagaauauuucuggugagacacagucugagucucccagccacaugucugucaucagauaggcaaaagcaguggcaacuucacugcaaucgcuuggaagaagaaagggauauguuucuggcugauuuaaugaaaagaaggcaccuaaucacccaagccuaggaaauuagucucaaaauggaagaacguggugucucaugccuguaaccccagcacuuugggaggccaaugcaggaggauagcuugagcccccagaaggucgaggcugcagugagcugugaucauaccacuacuucaccccagcuugggugacagaacaagacugucuaaaagaaaaaaaaggaugccaggcucaguggcucacaccuguaaugccagcacuuuggggggccgaggugguagguugggagggguggaucacuugaggccaggagcucaagaccagccuggccaacauggugaaaccccgucucuacuaaaaauacaaaaaauuacaaaaauacaaaaaaaauuagccaggcaugguggcgcgugccuguaaucccagcuacucaggaggcugaggcaggagggucacuugaacccgaggaacagagguugcagggagccaagaucgcaccacugcacuccagccugggcaacagaacgagacccuggcucaacaacaacaauaaaaaaaaauaaaaaauaaaaaaaaaaggagcugcauucauuucuugguugcccuucccacuuuuacuuacucuagcguguuaucugggaagcuacaaccucuacugacuuguuuguuuaucucuuaauagggauuccagaguuccuucucuaaccucaucuguggggaagugggggugggggcugggcugcagggaaugcaaauggucuuacuuuugcagagcggugauauacuucccggugagaaaguauuccaccagcggcaagaugcugcagagacacugugagauggcauucacgcagcauguguugcccaaguuccacaagccagugacacccugaaaauggggcugguucccaucagccuccuuaacuggaaggguaucauaguaaucugugcacucugcacuguguuggugccacaugggaagaaaggguuuugagagaacaaaauauguacaaaugacaauaagcuucucuuaauauuaugaaauaaagaagaguucuuaauaagacuuccuccaaacacauucccuaccaaggacaggaaguauuggaacuuggagucuaaaauuguauuauggcagagcauaguggcucacaccuguaaucccagcccuuugggaggccgaggugggaggauugcuugaggccaggaguuugagaccagccaggguaacauagugagaucuugucucuauuacauaaauaaauuaaauuaaaaacaaaauuacauaacuuagaccagaacugugaacaaguaccugaagccaaauaagacagauaaaaauuuccuucuaaaacuaaagcaagacaacugacaacuugcugggcaaguaauuaaauuauuauuauuauuauuaauaguuaauaaaacaauagcuaucagguagugagccuggcacuauuuaaguacuuaacaugcauuuucccauuaaaucuuucaacaauuguguaaggcaggaacgauuauuuuuacaucccauuuuacagaugagaugucagguuuaaaugauguagucauuuacucaugggguguguggugguauguaaaaaaaggaauauccaccuaucuguuuaccucccucccucucucccaacauaccuauccauuaagauauuuggauuuacauauauuaagauugucuauauauauuaagauugucucuauauaugugauauauauguauauauuuguauauauauguauguauggcauauauauugaaggcauaauauaugcacauuaagagcaugaauauauauaucuuaagagcacacauauguguauauguguauguauauagcuauauacauauaaacacacacacacacauauacacggagaggagaaagagcacagacuuuguaaaaauauagaucuuaguuuaaaucccaacuaugccguuuauuaauuauaggaucugggauucuauguccguuucucaucuauaaaauaggaauaauaucaucugccugauaggaugguugugaggauuaugcagguaucaugcaagcuacuugacacagguucgucuaaaugacaacugaaaaauuuuuuuaagugauugaucuaggauguccuucccaguaagcuacaggauuagaguguucaugugaauugcccagaccugccugcacagagagaacacugaggguuccaaacgggaccuccucucccugcacagagcuuccucuuacaauuuuuuguauugugccaggcagccugguaucuauguccucucggauuuuucuuuccauauauuguaucuaaaguuggggcuccaugagacagugaccuuaccucauacauacuuuuaaguacaguuaugccaguuugaaaaguguucacuguuauaagcauggucauuuucacuuuuacucacugauaccacaggagguccuagacugucacccuuuaggaaggacauguauuuauugccaagauauuagguacaaucuuccuuccuuuccggggaccuuccaugggucacaccugggagaacccuccugaaugcaguguguguccccugacuccucugagcuugacuuucccaccacugggcuaaucuagaaagcuguaguagaucaaggcucacaggacgugguagauaucgaagucaucugcagggagagacggcugagaagucauuuuaauggaaccacguuggacuuuugcuucuauucaggagcuacaucuauuccuuucaacuucauuucucugagccuguuaacgcuggcuuuuuguuuuaaacaauugauaugcuccucucucuuccaguagcugcgaacugauuuucaccuguaucaggcaccacuccaacuuggauuu

SEQ ID NO: 191236 - RNA, 39791 nt, Homo sapiens
gccggcgacgucacgcggccguuacggcgcucaggcgucucgacgcgcgcgauuuaaaaccagcucaggagacgccaaggaaagaugggaccucccggcccaggugagccgggcggucgggaggcgcggcgggaagggccccuagcgaagcaguacuucgggcgggcagggcuggcgggcuggccugggcggggagagaggauaugcucagcucgggucuuggcccugcggcugacagcagaggccggugcggggggaggggagggccggcgcggggcgggcggaccuugugcgcucagccaaucagaaagcggcuucggccggagucggagagcgcgcgggcccugccucacacuccucaguucccgggcgggcgguggggcggccuccuccuugggcuccuaaagcgugcucggugucucuccauuaaaauggugguuuuccuggaauagacguuauuuucagggcuuuggaagcgaugugguuaccguuguaugcuuagcaugcaugcauuuauuuuugcaucuauucaaaaguacugagcucucccguugggcgaacaaaauugauaauaucucuauacuguuggaguuggggagacagacaguaaacaaaagaaauaauuacacaugaggcugagugcugugauugaguauagcagaguagggguggcuccgccagggguucagggaagaucuuuaggcagauacuagggaacguguuucaggcagaaggagcaaguacaaaaaugaggcagggaagagccuggccuggccuaggaccugaccagaacauugugaccaagcuuagugaggccugacacguaggcagggucuggaggccuuggguaagagauuuggaaauugaguuacauuuuggacaugguaugugugacuuacgggagagacucaggugaagggaucuauaaucacuuaggugagaauuuggcucucaggggaguuauauggaccacucagggaagugacccauggauugagaaauaaauuuggauaccauuaucauauagaccauuagaccauaaaaccaugggaacaggugagaacacuaggaaggcccugcacaucuaggaccaacguuuagaagcuggauagagaaggaugagcuggaaaaacucaaaagacagugguauaggaagaagccaagaguguuucaacaaggaagggacugucagcuguuucaaaugcugcuggauuccaagagaaaggccagaaaaugaccauaggguuuaggcaacauggaaguuauagaugaucacgaaaagauaguucucaugaaguuggaauaggaaccagaccagaguggguugaaaaaugagugggaaaugaggaaguagacauaggaagugucuuugagcucaguaaccaucgguugaaugaauggaugcauaauaucaaaggcaaggagagaaaccacggaaagaagauuuggagaauuaaagcaugccucuaauuccaaguuuaguuucucucuuagacaagguucuccuuaagugcuuccuauuucuguuaagguauccucuccaaagguccagguuccuuccuuagccuguagccuacugugcucacauccaaauacuguccucauaaguccucuugauucaguuucuaaaaaugucucuugccuccucccuuccuauuuuuacuuuguuguuuuuuguuuuuuguuuuuuuugagacggagucucgcucuaucgcccaggcuggagugcaguggugcaaucucggcccacugcaagcuccgccuccuggguucacgcuauucuccugccucagccucccgaguagcugggacuacaggcuccugccaccacgcccagcuaauuuuuuguauuuuaguaggaacgggguuucaccguguuagucaggguggucucgaucuccugaccuugugaucugcccgccucagccucccaaagugcugggauuacaggcaugagccaccgcgcccggccuauuauuuuuuagagacagggucuugcuguguugcccaggcuggagugcguggcuauugacaggugcuguccuagcucacggcagccuugcugagcgcaagcaggcucagcuuccugaguagcuggaaccacagaugccuggcaaaguaccccacuucucaauaccaccuauaucuuucuaauucacucucugguucccugacuccaacaacccuuuuuuuuuuucugagacagagucuugcucugucccccaggcuggagugcaguggcuugaucuuggcucacugcaaccucugccucccaggcucaagcaauucuccugccucagccuaccgaguagcugggauuacagacaugcgccacuacaccuugcuaauuuuuguauuuuuaguagagacgggauuuugccuuguuggccaggcuggucucgaacuccugaccucaagugauccucccaccuuggccuccaaagugcuaggauuacaggcaugagcccagccuuguuuuuacuuccuauuuuauugaaaaaaaaaaaaaaaaaaaaaagcaaacaaaaaggaacauccccaagucugccauugcaccugcucccugccugcaucugugccagugccucugucuuuucuccuguuacugaggaugggcuuucugugcucucuacaaaggcaaccucuuugccugcuugaguacauuguucagcaaauuuuaccuuuuauuuuggauggucacugugauaggcugaauaacacuugcccuaaagguguccagaaccugugaauauguuaucuuacguggugaaagagacuuugcucaugugauuaaguuaaggcuguugagaagacuaucauggaucaucugggugggcccaguuuaaucacagugguccuuguaagaggaaggucgucgggguagagugagagcagaugugaugacagaacaagagguuagagugauggggggacagugagccaaggaauguaggcagcucugaagcugcaaaaggcgaggaacagauccuccucucaaagccuccagaaugaauguaacccuccacagcugcaagagaacacauaaacguguggggguuuuuuuguuuuuguuuuuguuuuuugagacggagucucacuuugucacccaggcuguagugcaguggcgcgaucucgacucacagcaagcuccaccucuuggguucaugccauucuucugucucagccucccaaguagcugggacuacaggcacccgccacugcgcccggcucauuuuuuuguauuuuuaguagaggugggguuucaccguguuggccaggauggucuggaucuccugaccucaugaucugcucgccucggccucccaaagugcugggauuacaggugugaaccaccgcgcccagccacauguguguuuaaaccgcuagguuuguggucauuugugacagcagccauagaaaacuaauacagucucuuugcuucauucuuucuaccaugcugagguuuuuguuuguuuguuuuguuuuuuugucuuaaaaauuccucacuucccuuucaacucucacccucucauuucucuccacccuuuuacaguagaagucuuugggcagggcgugguggcucacgccuguaauuccagcacucugggaauccaagacaggcagaucacgaggucaggaguucgagaccagccuggcuaacacugugaaaccccgucucuacuaaaaauacaaaaaaguagcugggcgugguggcgggcgccuguagucccagcuacucaggaggcugaggcaggagaauugcuugaaccugggaggcggaguugcaaugagcugagaucccgucacugcacuccagccugggggacaaagcaagacucugucucaaaaaaaaaaaaaaaaaaagagaaguccuugaacaccuugucaucguuugcugucuccaguuucucuucucccaucuucacuugaaccacuccaguucagcuuucucccuuacuacucuaggaaaacuguuuuugucaagaucacuaguaacccuagguucuaaauccaaugaucaguucucaguccucaucuacauaguuuaucacauccuccuccccuaaaaauacuuucuucaccuggcuuuuagaaugccacauucuccugauuuucucccaccucacuaguugcacauuucccagcucuuuugcugguuucuccuucuuuauuuuuacuuauuuauuuauuuuuugugacagagucucacucuguugccccggcuagaguguaguggcgccaucucggcucacuacagccuccgucucccggguucaagcgauuuuccugccucagccucccaaguagcugagauuacaggcgcccaccaccacguucagcuaauuuuuguauuuuuaguagagacaggguuucaccauguugaccgggcuggucucgaacuccugaccucaugugaucugccugccucagccucccaaagugcuuuccugcucuuuaaaccuuuaaaguguuccucuacucaguuauuuggugaucucauccaguauuauggcucugaauacccucuacaugcugaugacuucccaguguguguaucucaucuggaacuuucccuaaauucugggauuagauacccaccuaucuaacccaguaggaugacuaauacuaauaagcaucuuuuuuuuuuuuuuuuuuuuuuuugagacggaguuucacucuuguugccuggguuggagugcaauggcacagucuuggcucagugcaaccucugucucccggguucaagcgauuaucuugccucagccuccugaguagcugggauuacaggcgcccgcccccacguccagcuaacuuuuguauuuuuaguggagacgggguuucaccauauuggccagcuggucucuaacuccugaccucaggugauccacccaccucggccucccaaaguguugggauuacaggcaugagccaccgugcccgguagcccaggcuguuucuuaacuccuggccucaagggauccucccaccucagccacccaaaggguaggauuacagggaugagcuaccauguccggccuuuuuuuuuuuuuuuuuugguuguuaucuuuuaaguuaagagacuaagcuaguuuucuugaaaacuguccugcauucuagaguguuuccuugugauaucauuuaacuuguuccuugaccccuuguauuucuuauaaaccagaaguuaaagaucuaaaguucuuugguuaaauuuagguuaaacauguuugguggaaauauuuccugggugaugcuaugaauuucacauugugucacaugaagagaugaguaacuuucagauugauuuuuagugaggcuacauuugacugguuaauguggugacugguagaguuuuuauuguaaaagacauuuuuccuuuuguaguuagcaaauaaucuggaugauucuuuggaacauucuauuuguuuuacauguuuauguuguuuuuccucugucuguuugccaagauauggaggagcuggaauuagagcccagccugucuaacucuauagcccauaccucacccuugucucagcaucugucucuuccuugucuuaccuggcaugauggguuauauaugucuguuguccaguuugugagcuuaucagaggcagcaauauuauaucauccauuuuuauauccaugcaguacuuaaauucacauagcugcagaguggauauuugucccagauuaacaaagaagcaucagaaaccuauggccuccccccugcaccuccaagaaacccaaacucuagagguucuagccauuaaguauuagaguuggagaagaucucaguggacaguguguggugaaccuccaccccugugacaggcucaagacuucuuuggauauaggaaauguucucuugaagguuucuugagcaagaauuuuguuccagcacugccagccacaaugaauaacucuucuucagagacgcgaggacacccccacagugccuccucuccuucagagcguguguucccgaugccccugcccaggaaggcgccucucaauauuccuggcaccccaguccucgaagacuuuccucagaaugacgaugagaaggagcggcugcagcggaggcgcucgagggucuuugaucugcaguucagcacugacucaccucgcuuauuggccucccccuccagcaggugaggugcuccugggcuguuucuccuugaggcagccgccuugauaugggcugcguagguccaggcaucuccacaaaacuucaugggucuagguuuugaaaauuuaaacuaucauggauucuugccagaguuguuuguuuuuguuuuccauuuaggaguauugacauuucagcuacuauccccaaguuuacaaacacgcagauuacggaacauuacuccaccuguaucaaacuguccacugaaaaugugaguauuugcugguuuauuauugaagacguaaucccuugaucacaggggaaauccagcuaucuuguuucuguagauaaugcacaaucaaugaugauaauucucuggugagucaucuuagugcuggugguuuuacuguuuacucuggacccguggugcaccuccugagaggcugccagcuaucugcuguguaucuagaaaggcagcauggcgcaugaguuaauaguagaguucuggagcuagccugaguuggaggcuacaugcuucuaagcugugugugagccacccaaccauuuugcuuccguguccucuggagaauggggguagugccugccucaugaaguuguuuggagggugagucccuuugugugcagugcuuagagcagggccugcacacacugagcauucaggaauuuugugccgucauucccuagccuugaacaugaggacaugccugugaggauuuggcucuugacaaguguuuuugggaagagagaucagugacaauauguggguauuccuauguaaagacuuagcuuccucuguuaaaagcagcauuauuuacaugagccuaggcuauaaauaacaauccuuucugcaauuuucuguuuucagaaaaucacuaccaagaaugcuuuugguuugcacuugauugauuuuaugucagagauucuuaaacagaaagacaccgaaccaaccaacuuuaaaguaagaaggauguccacuuucucuugcaucugaauuaaaugaugaugauuucuacuacuuggcauaacacaguugaaugcugcaaauacaugagagacuucucauuuagauguuauguuaguuaauuuacuuucuuuuccuaaacugaugaaauacagagagaauauauauucuguuuauucccuaucagucauagagggaucuuugucauugcuuccuuggggcaaguaaauauuuugugaagcuugcuguguuuuaccuguucagaaguuguuuuuuguguaucuuugugagugcagcucugauuguuugacuagguggcugcggguacucuggaugccagcaccaagaucuaugcugugcgcguggaugccguccaugccgauguauacagaguccuuggggggcugggcaaagaugcaccgucuuuggaagaaguagaaggccauguugcugguagguggguagggaucuggauuuaaguggcucuuuuuagggcauaccagguaguuacuugaguaauauacuagaagaaggucacaagaaauaagugaucucauuuuauugaagacagggcauuuuuagaaccauauauggucuuacgugagaagauacucaaacacuaaaauuauauuuccuugaaaaagagaagggccuuauaaaagcguuuauauuuuauuuaggccagguuguguaaacaucaccaacuaaggaacuucugaucugggagucuuuggaaauggacuugcgugagaagccaaaucuaauaguuugguuucuccauaaguugcagauuaaauaugccugauguuuugagagaacugcguguuuuuuguuugguugggguuggaguuuuguuuuuuuuuuuuuugaaacgaggcucacuuugucacccaggcugguaugcaguggugugaucugggcucacggcagccucuggcucccaaguucaagugauccuccugccucaccaccccaaguagcugggacuacaggugugcaucuccaugucuggcuaauuuuuguacuguuuuguagagacgggguuuugucauguuggccaggcuggucuugaacuccugagcucaagugauccgucugccucagccucccaaagcgcuaggauuacaggcaugagccaccacaccuggccucacauguuuaaauuacgacagguuuugaagaacuugaguuaguaaguucaucacaugcuucaaagcagcccuugcaguacgcaauuguauuucuccuuuuagauggaagugcuacugaaaugggaacaaccaaaaaggcuguaaagccaaagaagaagcacuuacacagaacuauugagcagaacauaaacaaccucaaugucuccgaagcagaucggaagugugaggugaggaacuguaugcgcagugugguuucugacuaauucagaaccuuaggggcugagacuuggcagggcuaaggcugccuugcugguaugugccuguuuaagccucaagggaguaaaauauucaacugauaucucugcauuaucaucuuuuagcuugacaguaaagacuaaaaguaagucccucaguguuucagaaugauucaaaaggaagagacugcaaauugcugagaaaucuaauugauaaaaaauuaauuuuauuuccuaguaaauguagcagugguuauguuagcuaacauuuaauguacacauagugagcaccaugugcuuccuuaagccuguaaccuguauuaacucauuuaauccucacaacauucuuguaucauuuuaggaagagguaacugaggcacaaugacuugccugaaacgacacaucuaguaagugagcuagaaguugaagcuaaguggucuaacuccagaauccuagcuuuaaaucaucuaucuagcaaauccuaaggaaucggcuuaaacaaaugguacuggaggccucaucuauaauuagcacaguuaauuuaaagcaaacagguguuacuacaauuuuauuuuuuaauucugccauuaaaaacauuguuucagugaacauucuaauacauauuaucuuugcacucguaugggagaauaucuguaagaaaauucugagacauggauuuuaaguugcccucaaaaaaagguacuaauuuacucucccacuagcaguagacuagauuacuuuucucucuuaccuccacaacauucauaaaugguaauuaaggucacaaaacuagaauuggucaccaaggaaaugaauguauaugggaaaaagacugggaguuccuuuuccccaaucuuaggaguucagagagcugaaaaaacauccaguagguaggaggaaaaccagaagagcgugguauccaaaugagaaaauauuucagggaguggggaaugaucaaccaugccaaauguggcaaccugaggccacuaaugagcuuggagugggggccccucugaaacucaagcucagaccuccagggaagggcuuggcuggugcuagugucccugaguuugagggaggggauugugugcccaggacccagacccuggaacgggggcaugcuggcuggugcuggugucucaauaaggcugguucugugagugugaaaaucugccagugggguucagcugcugcuacaggugggcucugcugcagccgggguggaacacugcugggugacgcucuccuaacaugcaaccugcagaaaggagcagugccuucucucccuuggagccuguagucucccucuagugccccuacuugguaaacccuaacagggagcugccggcaaagcugaaugucccagacccugcaucacagccaaggagagaggguaggcuuagagcugagaggcaguagcuuaguaacugggacauggugaagugucaugaggauuacugacaaaagacucugggguggggagagagauauauauagagagaguaaaugaaaacaaauaugcaaaaugcuacccauuggguaaucugaguagaagcuuuacagagauucguauuacuguuucaacauucuuguggaucugaaauuuuuuuuaugauaaaugggaggaaaggacugaaaacacuugaauauagguaguuguuuugaagaguuuugcuauaauuuggagcagaguacugggauagcaaauggagggaaaaguaaggccaagaguuuugauuuuguuuuugaaugggagaaaugacagcauauuuuguugaugacagcagucuaguuuggagaagggauuauugaugaugcagcagaaaggagaauugccaggcugauguccuugcgcaggugagagguagggaauggacagcacagguugggcucggcugacggguguuguuugggugcacucaugggggagccuucuggauacugucuuaaaacaggaagccaggucaucagcuuacagugaggauagggaaggaaggcacugggggcgugaggaggggaaaggguaggaaagaguccucuaggaggugggcgaguacaugaacuagggagauauggugugacuguuagacaacuuagggucuacuugagggugguggcagauggauauaaagugaggucagucagcauuauuuugugucucuguccagccgugaauagcuguguggguacaaucauggaguaggcagaaaguuggguuuaauaugggauccuguugagcugagugaauggacacagcuggaaagggacacuggaggaggugagugcauguguaaaggugugguugcauucacugcuuagggaauuuuaccucggaagacaggggaaugagggcaguggaaaguaauauaaucaguagauuguaggccugguggggucaaagacuucgugguguuggggacaagaaggggugagcuggaaauguaggaggugguugccagagaggggcccuagaauugaggauauagagagguugcagucaugguuaaugagucaacucagagcaggcaagggagcaaauggcggaggcgggguaggggucuuacuaggcugucuuggugucuuacuuggcugucuuggaguccuggguuucuuaggauggagaccauugaaggagaggauaucaaccaagagacaguguacuggauggaucaacauauggauauugaaaucaauaagagcuacaccaggaauaaauuuggagacuaguaaugagccauaaacuaauacuaagaucuucugagaagaaggacagguugugaccuggggauuggaagaugacugcaacacagaugggcagacaguggcaaaagcugauguuguacucagagcuggggcauuagaaauugggaggggggauaguuggaugcugcaaucaccuggcccaccuguaggccacugguuugacggcugugaagagaaagcagccacugcagaggcccgcaggggaagccuauccucaggcuggcaccaugucucaauuggagcagugccccucagccuguuuuuuuuuuuuuuuuaucacuuuugccccuucagacccauuuagacauuuugugccuacuccuuccccuuaaaaugaaauacuaaggaauaagauuuugucagauaggguagagauuuggauaggcaaacauuauuguaauaucuaagauuuuucccaccuagccucuaggaaacaguuuucaccccuugagagugaaaugagaacaccauugagaauacauaaauuagaacaaguagguggagauaauccucaggaacuaagugggcgauagagagaauuuugcugaugacugagucuagagggcccugaggaaauaccaguuuuugaggaggagugggagaugggggcugugguggggugggagguggcaucagaguucuauagaucuuagaguccaagaaauguagaauugugggugucuugggucuuuuuguguaauuaauaaauaagccagauaaagggcaacagugagaugaaugccaguguucuuacagcagaugguagugguaagacugagugugcaaggggcuagggagguggggccuugccaugcccacucugaguggugaggugagcagggcauugcugugcacgggcagggaggggccagaggaaggagagucacugagaaugaggccuaagagggaggggagaggcgagagcagcuggcucuuguggggagagggaguuguauuuuuuccuuaugugugugucagcauuaaccgugggugauguguguagcauaucaccauguuuaaagaccuugacguaggccgggugcggugcuuagcuguugaccugggaagaguugugaaucucacugucauauacuauaaaaaauggggaacgcuggccccaaccacaucucgguuuuauauuagugaauccauuuaugccaaggucucucucuuuuuuuuuuuuuuuuugagauggagucuugcuccgucgcccaggcuggagugcaguggcgcuaucucagcucacugcaagcuccaccucccggguucacgccauucuccugccucagccuccagaguagcugggacuacaggcacccgccaccaugcccggcuaauuuuuuguauuuuuaggagagacgggguuucaccguguuagccaggauggucuugaucuucugaccuugugauccgccgcccgccucggccucccaaagugcugggauuacaggugugagucaccgcaccuggccuaugucaaggucuuuaaacauggugauaugcuacacacaucugaagugguauuauuuauuagucauagggauccagaaagcccuuucuacguucccuucccucccccaauucuccuuguuuuuuccccuucccagauaaucuggaauuuaucuuacugucauuauuauuauuauuuuuuuuugagacagggucucgcucuguggcccaggcuggagugcaguggcacgauguuggcucaccgcaaccucugucuccccgguucaaacgauucucgugccucagccucccauguagcugggacgcaccaccacgcccagcuaaauuuuuuuguauuuuuaguagagaugggguuucaccauggugaccaggcuagucucgaacuccugaucucaagugaucuacccacuggggcucccaaagugcugggauuacagacgcgagccaccgcuccuggcccuuacugucauucuugcuuuugauucuauagugaaauguucaaaucaaucggauuauuaaguacaggauguuuggaaauucuguuuuguagucaucuucuuucuuaccagguaaucucaauucugggagccugaggaaaacggacuauuucccaggccugcauuagcuuuucccaugauuauaaagagaaaaggagagagcagcaaguagggcugauuucgcuaagccugauauugacaggcugugguauguuuaugcuaagugaaaugaauacugucaugaagaaaugccaaauacuccaauccuggaaagcuuuuuuugcucuguaaguugcuguaaacuuguaaucaucaagaguauggaagauaaaaaagagggauggauugucacaaacagaauuuaaagcuucaacuguuuauuaaacucucauuuucuuuucuuuuuuuuuuuuaagauggagucucacucuguugcccaggcuggauugcaaugguucagucuuggcucacugcaaccuccaccuccuggguucaagcaauucuccugcuucagccacccaaguagcugggauuacagacgugcaccaccaugccuggcuaauuuuuuuauuuuuaguagagaugggauuuugccauguuggccaugcuggucucaaacuccugaccucaagugaucugccugccucggccucccaguacacuugggauuacagguguaaacucucauuuucuuggagaucagaaagcaaaugugugggugugucuagaccaguugagagcacuucuuuauauaugagccgaucucuuuuggacacagcucuuugguauuugcagaacauuugcugucauagaggauucaaacaugauuaugcuucaguucuuuauaccaggagaauacagguagaugaaugcaaggaaggucaaggcacaugcuauaggaaaccagaguugguagggcucagaguuuauggaagaagcaagacuugaacugggccaugaaggaaggcuaggugucuugucagguaggcauugccagggaggugauucuaagcagagguguaaaagcaaaagccauagcacaggaagguucugauuaggaagcuggagaguauacgaguuuggcuagcgccaaggauuugcuuuuagaaaucaccuaaagagaucuugaacuuuaucauucagucuauuguaaggccuuuuauugugguccuuccuuacuguggacccuuguuucagaagguuucaucuacucaaacuacacagucagccauaauucauugucccauugaauugcuuggggauauaaaucccucuguugucacacaugauauaauucuagacacaagugaggaacauuaucauagugcuuucagcuuuaaugugggucaguguacaauuuccauguuggcucugaagugcugaguauaguuccguuaacuaccuacacaagacuuuuaggggugcagggcuccaggugggaaaccauuacucuggauagcauuugagaauggaauaggaguaaccuauuuuuagguauuuuuaggauggggaaaaaaaauagguauuuuuaggaugggaauugggagaggccagagauaagggucauauugcuggcucuggggauggaaagaugcacugggaggaaaccgacuuggacguguggcugccugagggcuaaagggaugggagaauguggagaugacgaaugugcugcucugggacaaagaauggugagauggguuuaugguacggcaggagcugaaccucaguucugaugagcuuggacuccgagcuaaggggaccagggaagagccagggaggcacaucuguguuguccuauccaagccccucucucuccauaguagccacguucugaggcaucaggaagaccugugaaccccauacccaaccguaucuccugucucaaggucaccugcagagucccagggggcuucuagccucuugcugcacaugugugugauucacccugucccuguucuuaugcccagugccuguuuuugccuuugggcuuggugucauauggccaugccauuccugcuccugacccagccuuagggaccuucuuaaaaccucucucagguuucacccagccagcuagcccuacugacucuguccuuugccuggauaucuuggguauguucuuccaaacuuuagaagauauuucuguucagaggaacaauagagcccugugacuagcccuaucauacaggcuuuuuaagccaauggcauuuguuagugacuuauagaaggagaccagcagcaaggauacacguccagauguauuauaaaaaagccauuugacacaguguacacuugccaccacauacugucuucuggagcaguauauguuuaucuccugacuauaaccagccuuucuuuugaaccgggauuuuaucugcucaauuagaaagccacuuuuguugggugcggugguucacaacuguagucccaguacuuugggaggccaagguggguggaucacuuaaggucaggaguucaagaccagccuggcuaauaugaugaaaccccgucucuacuaaaaauacaaaaauuagccagauguaguggugcguaccuguagucccacuacucuggaggcugaggcccaagaaucgcuugagccugggaggcagagguugcagugagccaauaucaugccacugcacuccagccugggcggcagagcaagacuccaucucaaaaaaaaaaaaaaaaaacaaaaacaaaccacuuuugaccaugaguggagauauuucaguccaguguauauaccugcuaaugaguggggccaaaugcaugagaauuuaucuuucccuuggcuacaugccguaaaucuucaguuucuucucucucuguguucagauugaucccauguuucagaagacagcagccucauuugaugagugcagcacagcagggguguuucuguccacucuccacugccaggacuacagaagugaacugcuguuucccucugauguccagacucucuccacgggagaaccucucgaguugccagaguuagguuguguagaaaugacagauuuaaaagguaaguacaagugaugccuuucaccagagcauuucagucauuggggaauuuuuuuacauaaccaugggguacaauaagcccaucaugcucuuauguugcuuaaauuacccagaaguuuccucuggaaugccaaauuguguauccuuuugggagugccuugcaacccacuaacuuuugucuucucugcggcguggagucuaaaacgguaaaccaucgccucuuggucuugaugugcccgguaccuuaggugcccacuguuugcagucagcucuccaagucacauuugggagaccuggguuccuccuggagugucaguuuguucuugggaaggggacuuagagagaccuuugccuagccagagaggcuuuguuuuuauuugcuccccauccagggggcccugaggagaagagagcguugugaauuguuuugagacuccucugcagcagucuaagaacugaucucuccuauuaucaguccccuauacuggcuugacagagauuuuagcaucccucccauauacgccuccacgccugaguuggggguucuccuugggauguuguaaugaggugccagcagguagggaggccaggugcgugcagugcaguagcuacacuuggggucccagaagagcugcccccuccugcacauuuccaaugcaguguucguacucucgcugaucuucaucucaagugcggucauuuuuauguguugaaugaaauuaauacuuccccuccaggcugggcaguuguuagcucccauucuugucauuucuauucuugccucaauuuuguuuaguauaguuuuugugcuaacgaucuauuuuccaaguuugugcucucauuuggggcucuaauccccugaaguaagucuucucuaguuugggacuaaaaauaaguuaaaguaccauuacaugauugccuauguacuugguguauuuuuaagacgaagcguuugauuucccagcuauagcauaggucacagaauucauuucagaaucgaaugucugugcuuuagguuucuccucuaguauuuuacuaauuugugcgaugacagugcauagccucacuccagcguggguguggccgacgcaucugcucgcucccagaagaggcagggacacagacuggcagcuagccagccacugaugauacuugagccuuugcuggaggacagugagguaacugugccucucaucucucgucccacucaguaucauucugaagggaguaaggaaugcacuugacccccuucuaaucucucuuugugaucuugcuauccucuccagcgcccuugcagcagugugcagaagaucgccagaucugcccuucccuggccggguuccaguuuacacagugggacagugaaacacauaaugagguguggucaaguuuuaguggcucaugguuucaguuaguuggcucaagagugguccugcccaaugggaaccaaaacuguggcaucaucuuuauuuagccaggaguacagaaaauauuuccuuuggcacuucuguagggacaaaaacccugagggaggaggguaggguugugaaccccagcaggacuauucuagagguaagugaguuccaggaucagcuuuauguccucucuucugcuauccuaggguaaggcggcccuggcauuaaucagugaacauuuauaauuagauuuacucuugaaugugguuaucccaguggccucgaaucucuuaggcugccgucaagcuugaggaauuuccugcucuuugggguugaaucccuuggcacagaguuuccugagaaauugucauguguagagcuuuccucuguguauuuuuagcauggcccccuuuagccuacuuacuacaauuuccaaaauaaaugaucuccauggaaaacuguuuucugcaaacauguaguuaauggguacagaauccuguuucauguuuuacaaaaugugccugacaacaaugcagcuuccuccugugcugcacaauauaaacuucccccucacuguacuaucgugagagucuuggcccaggcaggcaggggaugggaaagggaaggguggcucaggggaaggaggaggcuggaaacugaaauuuaagggugagaaggcugucccuccaguggugauuuggggugguuauaggaaugagaauuacagaacccucuuuugucccuccagucugugucggcccugguagacaaguuuaagaagaaugaccagguauuugacaucaaugcugaaguugacgagagugacuguggagacuuccccgaugggucccugggggaugacuuugaugccaacgaugaaccugaccacaccgcaguuggggaucaugaagaguucaggagcuggaaggagcccugccagguucagagcugccaguaaggcucucagaguccgaaaguguuucuauaggaguuuuccauugguucuuuuuucuuuuucuuuuuuuucuaauuaaaaaauuuuucuuucuuuuuuuuuccccccccaaaaauagagacgggcaucucacugcauugcccaggcuggucuugaacucuuggggcucaagcaauccuccugcuuuggccucccaaggugccaggauuucaggugugagccaccaugccugggcacuaucaguucuuaacagauuuccugcuggggugauugaauuugaugucugauuggcugggcuggugugcugugucauacacaucagcugagcuuuucagcugagccuuucugacucagaggaaucacaccuggcuuugaaugucggcuuagccacuuugguuauaaaacugacauugcaagaguuuguaaggauuagaacaauguaaagcguuuggaacaaagcaccugggaucuaguaauuacgucaauguggcuguuguuaccacgugcauuuugguagcagagagcaugcucccuuuguacacauugcuuauaguguggcuguuggugacucuaagccaccaauuuaccaccugaaagguaagcaaguggggguuaggcaguguuggguuaccagaugggcagacuggggacgagcaaggcagggaaaacaaaaccaaccaauaaauugagaauauuuggaggagaagaagaagaauugguuuaguaauuaaauuuuugauuacccuaguaaacaucauaaaaauaaucagaacuugguuggccuuuauguacuuaauagguuaguauuguuuuaauucuaaauaugauuuggaagcagggucucacaacacuuuaaugucaugguccuguaaaggucuucaaugggccuggggguaggagauuucaugagauuagagugaacagucccucuguuaacuccuaugucuguaacagagcuuugcagaacugggauuggggacagccaagcugguuuugaguaaaaccuuagaaguugcuuaguauaauuucccgcuaugacaaaaaucucuucaagacccugcucggaugucuuuccuaagcucauuuugucugcccuugugggaaacgauuaggcugauaaugucuuuuaaagacauuaucaaggcgccacugcccauccaggcucaguagcacccugcucuccggaauuguacuguucacauggcugcaauuuugccccauucucaucgugucuuuuuuguuuuuauguuuuuuuguuuuuuuuuuuuuugagacagagucucggucugucgcccaggcuggagugcagcagcgcgaucucugcucacugcaagcucugccucccggguucacaccauucuccugccuuagccucccgaguagcugggacuacaggcgcccgccaccaugccugacuaauuuuuuuauuagagacgggguuucaccauguuagccaggauggucucgaucuccugaccucaugauccucccaccucggccucccaaagugcugggauuacaggcgugagccacugcgccuggccauccugucuucuaagaagggagaaaugauagguugaugggaugaacucuuaaaaacaucauuuucaaaugucagagaaaagcuaucacuuuccuuaaacagugaggugacaucugagggacugacaauaacaaagggcuuccaugacuuuuauuugguuucuggaagauguuuucugcugguuauuuugaacaaaugucuccacuucucuccccuauuccaaacagcacaaaaucuuagacucuauccuaccuaguacauuaggcgugggaggcugcaguucuagucucagauuuuacccauccuuaaauccccuccccuugccacaucgcuggccuuuccugggaauucagugaguguuugaucuggaguagaucugaucuugccguuacuagcccugagauguggggcaauguuaucaccuuuugcggucuuuguuuucucauccauaaaaugcaagguugggaccaguugauaauaacaauaucugauauuuauugagcuccuuauucuuugugcaagaugcugcgccaggugccuuauguguguuauuucacauaauuuacauaauaucuaaaauuaauuauuuuauugcagcaacccuauaauuagguccuauuauccucauuuuacagaugaggaaacaggcucagagaguuuaaugggguggagcugguugccacccagcaccuuugaccaguccuggccacauauagugagcuuuggauggcaggcuccaguccacaccaccugagcaucucaguggguagagggggccagacaucacguuaccauccccgggugauuguguucugcacccagggcugaaaaccacuguacucuacugagaggucuucggaggccucuggaugaaggugggguggggcaaugcugagugauaaauaccaguguuguguagaugccucacguuauuggucucugcauggcagcacauugacaacugcaagcguaaaagguggagcucuuugugcacaugcauugguaaggacuggucugcaaaagugcuugaugucuaagagugagcucccucucugugcagcagcaacagcagcccaagaacacuuggagccaaguguucucuggccgacccuucuguaguaccagcaugcuuacauaaggcaguuacugugguuaaugaccuagucggaggucaaagcccagaacacagccuacuucacgcaugcgagaaugaaacauucggcugcaugcugccugaugugcugagccagcugggaggagaccuuaucuugccaguguuaggacaguggauugaaccauggcuaaauugaaggagggacccugugauauuauggggaggggauagaagaaauacagaguuuuccuggagggacuggagauguuugaagugggcagccuugaaaaauggauagacuauuuuggacuauagguggauucauuuaguuguugaguggugaaauugggacugguaggaugccugcgacauagcauuguauguugaaagaauuauugaauuacuacaguucaaaaauccugcagagccucuguccagcuccaucaccagaauugggaaugggagccacucuuccuaauggaagaauauccaucagaauggaguggggaugcuguugaaacuucuuccuucuaccucuggaguucacagcacagugcauuuguuacuuaauaacaugcuagguaucagauucuguuacagcacuaggccauacagacuagaaaugugauuuuuuuauuguguauuuuauuuuuuuaaauuagguuuuaauuacacaauaaaugcacaaauguagucuccuguuuuuguuuuuuaaaauucuguauguaaagacaaaauccccuuuuaaaagccuuuuuagcuuauuccauauggcuuauauaaacgggaacuauauguaggcucaauacaaauacaaggccacucuucugaaacuucuugguuaccuuaccuucagagggcaguacagcagcaccagcguccuuucugacauguuggagcccuuuaggagaaagcuuguaccuuguggaaagagugaaaaauggcugggcacgguauaauccugacacgccuguaauccuagcacuuugggaggcugaggcaggaggauugcuugaggcuaggaguucaagaccaaccugaccaacauagugagaccccaucucuauuuuuuaaaaauguagaaagagugaaaaaccaaacugaaacugccaugcugcacugaccacuuagacacuuuacacacggcaaagaauaaagcuggaugaccuaacagauuauaaggggagcccccaaagcguuagaggaacuaaauaauuagacaaacauguuuuuucacuuuuaguaggaacuauagcgguaucuuuuggagcccucauuuacagaaggauggugacgaaugagggauuugucaucuuguguggcaagaagcauguguguggaaagaccccgaggcugggauuaagggacuuguguccagcucccagcuccggcauuuuacuagcuguagauucuuacccaaaggaauucucuuuuuuuuuugagacggagucucacucugucacccaggcuggagugcaguggcgcgaucucggcucacugcaagcuccaccuccuggguucacgccauucuccugccucagccuccggaguagcugggacuacaggcgcccgccaccacgcccggcuaauuuuuuguauuuuuaguagagacggcguuucacuguguuagccaggguggucucgaucuccugaccuugugauccgcccgccuuggccucccaaagugcugggauuacaagcgugagccaccgcgcccagccaaaagaauucucuuuacuuuugucaucuugucucucaaauuagguagacuagcauuuuauggugcacuuugaaacuuccagaguacuuguauagauaugauuauauuguuauaaaauuaagggaaggaaaaguacuugagaaguaaaaggaauuauuaauaaugaaguuauuuguauuggacucacagaaaugcagcucauuugcggacauaugcuucauauguaaauacagcauuauaauauauguauuguacauguacaaauauguguguuacagggaagaaaugauuucccuuggggauggagacaucaggaccaugugcccccuucugucuaugaaaccuggagaauauucuuauuucaguccucggaccaugucgaugugggcuggcccggaucacuggcgcuuuaggccucgacgcaaacguauguaauucuagguggaauuuuaagaaaagaaguaguguagaugaccagccagucagcaguuagccaaggaaaagaaaugccagucacagcccuguugugucucuuaauaagccgaggaagcauacagaugagccagccuccugguuggucaguuugccuggccugggaugaagggacagugaaaauggaagccucugagugaggagagugaguacuggagucaggagaacuggacucccagccucacacugcucccuaguauccacaugacuucacucaguggucacgggugggcaugacccccgggcacuagagggcacacaggagcuacugcacauguuggcauucuguagaacuccaaagggcugugcugaccuuauguguuuugcauugucucuuugaaagaaagggauaagcaucuguuguuuuauguuuuguuuugcuuuugagacagggucucacacugucacccaggcugaagugcaguggugaaucauggcuuacugcagccuugaccuccugggcuuaagcguccucccaccucagccuucugaauagcugggacugcaagggcaugccagcaugcucaguuaauuuuuaaauuuuccauagugaugggaucccgcuuuguugccuaggcuggucucgacuccuggccucaagugauccuccugccuuagccucccaaaguguugggauuacaggcaugagccacugcaccuggccaagcauauguuucugauguguuuucuuagccaaaacacaaauuauaaguuuaggaugaaaagagggugugugauugagcacuccuacuguugugaugcucagacacaaugcugccuugugguuuugauaagccuugauaaggcugucagcagaucuugugaaaugaguaaauaguuuaggccacagaagugaagugcugacgucuguguucacucugcagaagaugcuccuucccaaucagaaaacaaaaagaagaguacaaaaaaagauuuugaaauugacuuugaagaugauauugacuuugauguauauuuuagaaaaacaaagguuuguacugaauuuauuaggauugugcuuacucguuuuucccuuucagaugugauuuuuuaaaauuccguauaaauuuaacuguuagagcaaacagaugguuucauucuuccuuguuccuuaaacgcacuauuaagaaauaguccuaaacucaguggcagaaagaaucaaauuuagaauaaaaagaauaaugcuagcaaaaucacuuuuuuacauagaacugugagacugaugguagacucaugcugcccaaacccuucccagacugcuuuaaaaaaaguaagauguuuugcccacuguuaaaaugccuaaaacacuuuuuuuaaaaaaauuaauaggcugcuacuauucugaccaaguccacuuuggagaaccagaauuggagagcuaccacccuuccuacagauuucaacuacaauguugacacucugguccagcuucaccucaaaccaggcaccaggguaagccuauuucuugguuccuuuaagcacacaagguaucaaguggcugauaguaugacaguuaggcagugccuuugaggaaaagggagaaugugaggagugguauguguuagccaaagcguguugccaggaaaucaaauagauaaggcaaagaaagcuaaaaggaaaggcuuauaugauggacacacaguaaacacuuggaaauaccuuaccuggcaagaaugcuggauacugaagccuccaugcugaaauucaggggggcagugaguguaguuuuuuggugaaguuucaacaguuuuuaaguuauuucuugauuccuuugcuuucuccuuuuuuuuuuuuuuuuuuuuuuuuuugacagaguuucgcucuuguugcccuaggcuggagugcaauggugcagucuuggcucacugcaaccucucccuccuggguucaagcaauucuccugccucagccucccaaguaacugggauuacaggugccugccaccauacccagugaauuuuuuguaguuuuaacagggacaggguuucacuauguuggccaggcuagucucgaacuccugaccucaggcgauccacccaccucagccucccaaagugccaggauuauaggugugagccacugugcccaccugauuccuuggcuuucucauugaaguuguggauuuacucaccaauugcuuuauacagugagguugccuuacucaugauccaagucgaagcgagcccaaggugacacacgggcucacauccucaggaagucuccuagggcucuacaggcugcuggggcuccuucugagauugucacauggagccuucugaauuaccugguguugcacccugauuacugccuccuucauuugccuggggcucuucucacaugucccugcugacaggguaagcagugguucguguaaaccauuccauucacauccucugcuuacuugcauuacugguucuccuacucucauggaguguauuaagacuuuauacuuuccucuuuauuuugccuguuuuuccacaagauuuuaaugauauauauauauauauauacauauauauauauacacauauauauguauauauauguguauauauauauauauauauauauuuuuuuuuuuuuuucccugaauugacugauauuacacauucuauuuguuuuuuuguauuuuuuuuuagagacagggucuugcucuguugcccaggccauaguccagugguguaauuggagcucauuguaacuuugaacuccuggauucaagcagucauccugccucagccucccaaaguacagggauuacaggcgugagccguuacaccuggccucacauucuguuuuuauaaacuaaccaagauauguuuuucuuucugaucaauauuguuuacuucaauagaaauacucuuuuuuuuucaguccuagcuacuugggggccugaggcuauaguaagcuaugaucaugccagugcacuccagccugggggacaaagugaggccucaucucagaaaagcaaaacaaaaaaaaaauugugauucaugagagggggucaaaauaucaacauuaacaggaguuuggaagaaguugauucugacucuuauggaugauuuugagggguucaagacuucaguggaggccagucacgauggcucacgccuguaauccuagcacuuugggaggccgagguggguggaucgcuugaggcuaggaguuugagaccagccugagcaacauggcgaaaccccgucucuacuaaaaauacaaaaauuagccagacaugguagugcaggccuauaguccuggcuacucaggagggugaggcacgagaaucacuggaacccaagagguggagguugcagugaacugagauuacaguacacugcacuccagccugggugacagagcaagacucugucucaaaaagacuucaguggaggaagucauugcagaugugguaugcagaugugguagaaauagcaagagaaccagaaugagaaauggagccugaugaugugacuacauugguacaauauccugauaaaacuugaauggaugagaaguuguuuccuauggaugagcaaagaacauuuucuugagauggaauuuacuccuggugaagaugcugugaacauuguugaaaugauaaaaaaaaaagauuuagaauguuacauagucuuaguugauauagcaguggcaguguuugaaaagauugacuuugaauuugaaagaagcuccgcuauggauaaaaugcuaucaaacagcauuguaugcuucagagaaaucuuuagugacaggaagaguugauugauguagcaaacuucauuguugucuuauuuuaagaaauugucgcagccaccccauccuucagcaaccaccacccacccugacagucaguagccaucaacauugaggcaagacccuuuaacagcaaaaauauuacaacucacugaaggcugauaugaucauuauaauuuuuuagcaaugaaauauuuuuaauuaagguauguaaauuguuuuuuagacauauacuguugcacacuuaauagacuccagcauaguauaagcauaacuuuuaaauuugugugacuggaagugccuguauuaaacacuggacauuuggcuagggacaccugagagugugcccagaggagaguauucuaaaugaagaugcaguuagaaguugugucauaugaagaacaguggaagaaaauggggcguuucuuaauucaaguauuuauuguuuaguaguaguuuuggauuuguuacaagcacauuguggguuuauuugaguuguuuuugaggcacagaauuauauuaaaauauucagugugcucuuguaaacugugcacaucuccagucacauuucuccuacuucagagauuuauauaucaaguagaaaucacuggucuaaggaaggaccugcaaauauuugaaagacugugauccauaggcacucguaaaagaggagccucauuccacgaggcucuggaauacagaaugaggaugauggauguaauuagagggaagagcuggaugucucuccuuguugccauguagggaacagugguuuccauucaggaaugagacaggcuguuaauuaagguaauggguuuuccuuuuuuuuuuuaaagacagggucucaggcuggagugcagugguaugaguauggcucagugcagccucaaccccugggcucaaaugauccuccugccucagccuccugaguagcugagaccacaggcacacagcaccaugccaucuuuuuuuguagagauggggucucacuguguugcccaacgcuagucucaaaauuccuaggcucaagcaguucucccaccucagccucucaaaaugcugggauuacaggugugagucaccgugccuggcugguaauggguuuucugucaaaauuguucaagugcaacaaggugacuuucagaaagcuggaggguagauuuuccaacuuuuguuuuuagugaaggaacccuuuuucagguaaaacugugcagaaggccuaauugccagucacacagaaauagagcugcucugguuuauuugggauugguagagaugcugagcccugcuacuccagguuugcacuguauaguggaaaagucuguuagacuuagaugacuugugagggcccuucugacucuaaaauuguauaauucuaggaggagauugggcauaggaauuaagauuuacuucucuaaccuaguucaguagcuuuuaacaaaauagcuuucugcauuuauucuuuccuuuaguuacuuaagauggcccagggccauaggguagagacugagcauuaugaagaaauugaagacuaugauuacaacaacccuaacgacaccuccaacuuuugcccuggauuacagguaaaggggggaaaggggcucuguccucucuucuaagccagggagucguuuuucucugcuucucauguccccauuuuauauggugggagacuguuggcaauuuugaauccaguggagguuuucuggguaaagggucugccuuccacccagugcagggagcugagcagagucaaggaaacagccucaccuuggccugccuuaccucacauccuacaugcaggaagcaaauggccacacucaagugaaugcgucgacauguggauggguguuuagccucugcuacaaaguacuaaucuuggcuguugugggauuucaaaggaauauaaacacuuuguccucuuaugagcuaauauuuuggccagguagacaaccagaucacaccauaugugaucugguguggcaaaaaauaagucuucgggguguaucucagaugaccagauuucuagcugugaaugcaguucucauauugcaagcuugcugugaacuuguacaagccaccccccaucuuuagaucacgguuuagacuaaauaauuuccauaucccuucucugagucuacugaugagauggcuaauacagguaacagaaacuggaaaaauaggcuucaucugugucccuguauguggaaaggggggaacgaacuggaaaaaaauguauucaccuuauuuucuuacuuaggaagagaguuaggcuguuauauuuuagugaaaauccagacugaccucuugacuagugcuucucaaacuuuaacuuacauacaaaucacccagggagccuauuuaaggacugauuccugaccuguguccccccaccccacccccugcccgaagauacugauacauucacucuggaugugaucgcaaaaaugacuuucucaccugcuucugggugguaugccugcuacugaccagauggccccaggaaucuccugugcuuuccuugggugauauguucaggucauaucuccgguauuugaggaauguuucuguaaaaugaaauccuaaauuuguuagaagcugaaggggggacauaguggcaauuaugguuaucgaauuccuuuuaacucccgcucaaaaggucuuagguugauaacagacaccucucuaauaggguuuacgugaaacaggaugauaacuagaggcaccuagaaguucaucguaguguaacucacugagugaaccaucagauggucucuucuugcuuuguaaacauggagucuauuucaaggguguuucugagcuccucugcagcguccaccaaacucgaagagcuguuucuugcccaggcugcugacagugaugaugaagauuuggaugacuuauuugugggaccuguugggaacucugaccucucaccuuauccuugccauccaccuaagacagcacaacagaauggugacacuccagaagcccaaggauuagacaucacaacauauggggagucaaacuugguagcugagccucagaagguacggaugaaacagcugagaauuacauuguuugccugaaaucuauuuaauugucucuuauaugagagucacgcaaucugagcuugauuucuuuucuucucaguuuuaaccuguugcucuccaaguuuuaaauaggguugugggagugagcugaugcuaauuagguuuguguggaacugaccaucucuccaaagaccuugauaagacauguaacuagggaggaacuggucacccaaauaaggcauaugaaugaaggcugcaggcagagaauauaaauuuauaugcuaauucagcaaggcuagcuagcuagcuguguggcucugaaaaaucuuggccaaauucaguuuguauuaaauuaucauguauuaaacauuuaucucuuccauaccagguggcaggcuuuaugcuugccuuuauauuugauucauuuaucucuuuuacacuggaauuccaguuagccuuaauguagauugcacuggauugaaaagaaauuagauuugauaugagggacucuauauaguguccaaagagagcucugggcugggcgugguggcucacgccuguaaucccagcacuuugggaggccaaggcgggcagaucacgaugucaggaguucgagaccagcccggccaacauggugaaaccccgucuuuaauaaaaauacaaaaauuagcugggcaugguggcaggugccuguaaucccagcuauucuagaggcugaggcaggagagucauuugaacccaggaggcagagguugcaguaagcugagaucaugcuauugcacuucagccugggcaacaggucgagacuccgucucaaaaaaaaaaaaaaaaaaaaaaaagaguuugagaccgcguggccaaaauggugaaauaccaucucuacuaaaaauacaaaaauuagccaggugccuguaaucccagcuccaugggaggcugaggcuggagaaucgcuugaacccaggaggcggagguugcagugagcugagauugcaccauugccauccagccugggugacaagagugaaacucugucucaaaacaaacaaacaaacaaacaaaacaagagagcucuguagcuccuugguugaaacuggauuccuucuuuaguugaacuccagaccuuuguuuuuacagugaauuaugguaaaaguuucuuuauucugcuuaguuuuacuuugucauauaccuauuucagguaaauaaaauugaaauucacuaugccaagacugccaaaaagauggacaugaagaaacugaagcagagcauguggagucugcugacagcgcucuccggaaaggaggcagaugcagaggucagaugcucuugccuguucucuaggugcccagcaugcgggaggggagugguugaugucuacagcugaagacaccucgauuugggcaaugccuccaauacagaaauguucguucaaaaauacaaggagcugggcaugguggcucacacguguaaucccagcauuuugggaggcugaaguggaaggaucacuugagcccaggaguuugagguuacagugagcuaugauaugaucguaccacuacacuccagucugggcaacagagagagauccuguaucuugaaaaagaaaacaaaaauaaaaggaagacuucaugcuucuaagagagaagugaaccaaguauacaaguaggcaggucacacagacugugauacaaauagcaaacuaguguguaagacgugauucagccuugcugguaaucaaaaaagacaaaugaaacaaucuugaugcuacuuuaaaacagcagcaguuuuaguaauuaaacuguuuuccauuacugaggaggaaaauuuggaguacuuauucacugcugguagcaauuuaaguugcucuaugcuaugaaauguuuaaaccuuuugaucuaauaauucugauuucaggaauguauucucaguaggaagauaguggaaaaguaauuauuauacugucagauucuacuucuucagaacaagcugaaaccuugauuaacuugguccaccucaaugaaaggaagucucaguuaauuagaauccuucucucuuucugacuucugcucagauaauauucugaguuuagaccuucuguagcugagaaaugaaaacucauaaguugauugagggcccugagcuggguaucagagaaagcucuucagucauauuuauaaaguuuuaucaacuagaacagaaugggaugcaagugugugucuuugucuuaaguggaaaguuugaguuuacuuuuaaauaugaauuuugugcugcccuuagcaguguaguccaguuggagcuauaaauaaucauggcuuuggcugggcacaguggcucaugucuguaaucccagcacuuugggaggccgagguggguggaucaugaggucagguguucaagacaagccuggccaacauggugaaaccccaucucuacuaaaaaauacaaaaaauuagcugggcgugguggcgggcaccuguaaucccagcuacucgggaggcugaggcaggagaauugccugaacccgggagguggagcuugcagugagccaagauugugccacugcacuccagccuggcgacagagcgagacuccgucucaaaaaaaaaacaaacaaacauggcuuuuuauuacugcuuuuuuuucuuguuuguuuucagggcacccuaggacacucuuugcaguguguccuuuaccagggugaugcuggcuguugacauccauguuuaccacaaugucauuagagcagagcugaggcacugguucucuuuguagauccuuuuucuucaaaauaacuaagaaauuuguuuucauuuuguuuagguauagacuuuuuggugacacaacuuuauuuuuguugcccuuucaaaagugcacuagcccuaacuguccgauguauaaaugugcuucuguuaggcaaaccacagggaagcuggaaaagaagcggcccuggcagaaguggcugacgagaagaugcuuagcgggcucacgaaggaccugcagaggaggugcgggcuggcaggcaugggggcuuuguuggggcucaccucucugagcuguccgcguggcaggccuuccacacacaaccuguuuccuaugacauuuauaguggcuguucuguuuucucucuguguugacagauaauacagaccaacuuuuaaaaaggcguuuuucugugucagugaucagaguguaacaggagauauuuuaucucaaauaagaaacuagaaaaaucugcuuauaaaaugcaucugaaagauuuguuucucauuaguuuagucauugcauguguguauuauucauacuugaugaacgagcuuuuguucuaacaguuggcagugaccuaaauacuugccccuuucuuuccagccugcccccugucauggcucagaaccucuccauaccucuggcuuuugccugucuccuacauuuagccaaugaaaagguagguaauuaagguaagcaugggaguauuagaguauucccuguuuaugucaacucauuuagcuuuguauuugaucuuucaugggcuaacauaggauuucuuaaauacagugacuuauguagcaccuucaacccaaaugauuagccaggcaucuagaaguaacuuaggaaaaagccaucagguuugauuagcaaugaaaauagcacagaggacccaaauaguaagauuuuagaugauggaauugugaucgguaaguuccccagccuaagaacacgaggugcuuuuacuucacggggugucaaagacuuuaaaggccaaagccuaguaguaccaaagucaagacauaugggagacauggcagagagaagaggagagaaaugaggaugaaaagaaaacaguugcagaaagagaagaguacuaaaauauggagguaacagucagaaaagucaagcugugugucacaaggaaggagaauccugaagugccagcugggucagcguggcagacuccugugcuaggccagccaacagcugcauagccaugggacagcuguggaaagagcagaggagggcacucauuuucucaggagccgagugguacuacccagggauaccacagagagggcagccagcagcaagcccacacauuugagcaucacugaacacuugguauccauuaggguccccagccagcugaugcacagcccagccuuuggcacgugcaguagagggcuaugggcugggccauggcgugugcggcaagcaccacccuggggcuggggcaccauggccauggugugcaccaacacugucaacuccccaggaggagggggugggcacuggagugcaguuacuaugugaacgccgaaaugugguuuuggagggugauuaugggaauggaaugguagcaaaaauggggugcugguggaagcauccaggauuuccuacaugccaacauuugaccucuggccuccuaaugaaaucaggagcagugaggauuggcuccauuuuccaggucugacucugcuuuggagagaaguugcccuggccuguguggcacagccaucagccaaucccagugaccuaccacuggaagucagagaccaauuuuucucuugucaauaccuugcuuagcugacaaccucaugaagaagaagaaacuguccaguuagcagaagcuaguuuugauucuggguggggagcagguguagaagagccacugggccaggaccaagugcuguaugucuccaacuacugugcugaccauugggcuuguaaccaccagucuggguguucaaaccugaggccuaaguugaagagcccaguguaguucccaagaaggaaugauugugcaucagagcccuugggaaugguuuuaacccaggaaugcugaacuugcauggcugcuguuggggggcaguaaggcggugaccggugacugcggagagaggacaugcccuguucacaagccugugaaggcagacaugcccgugguuaugggaggugguaguuccuauaccugacacauccuaaagcaucugauaucacaugcaaacuauaugaagaaugacuaagaaaauaaaaaauaaauuauuaucauuguucugacaagaaaucuacaaguggcucugcugaggauauaccaucugagguggguggugugcaggccauccaucucucugacuugagaagugucgggggaggccuggaaucucauucgcacaccauccugguggaaauaggugcuggugacucuccaacaugggugcuggucuccuagcacaucaggcuccuaggcuggccuccaaagcucagaaacccuucugaguccaauuuaagaguguuacugcuuucgcucaucagccccagccugaaggucagagugcuucucuggguggugugucuccacagaaaccugacuugagagagcggcuucauggcccucacuuguuucuuaaggagucaggccaggccaacacugcuaagaaauauuagugacucugcggcuucacugaggucgugcugcuccgacuccagcucugcaccccugcucucaguggcagugcaggcauguucauuuugcugugaucaagucucuuuuuaagggucccagagcucuugguguuugaagaaugguggguggcuacagcccaugacuuguugggcugagcaccgaggccauuacuggggccuggcuuugggcuguuugagaaaacugggcuuguaacauuagccacaacaguuacuguuauaaucuacagggaucugugauaacucaacacuuagagccaccaagagaaauauucucaacgcuucacagcagaacuugaccuccucuuggacuucuuucucuccaucuuucacucccgucuggagucuguuccuccaccacugugauaacagucuccccucacauagccaggcaguguguggggcuuaggagccagugauggacgugaggcccucugccuucaugucucugcauguuagcagugugcaacuaccagaaccugagcugcagaaaacccgcgaggugugacuugagcguucugucuuuaguggcaaggaaaggugcgagugacuguugagcccuggcacaucccaucugccuccagugcagagccagggcaggcugguuguggugaaguucgucaggaaaggucucauagcugcuuaguccugagggaaacacugccugggguuggggaagagcugggagguagguagggaaaggccugugcagagacuggcaggaggucacugcugucaggaacuaauggagagauggggcagugggguaguugaggggugccuggaggaggugcgcguggaugggguuaauacaguaguccccuaguuuccauggauggggcauuggggcaguugggggugccuggaggaggcaugcaugguugggguuaauauaguagcccccuguuuccacaauuucacuuuccaugguuucaguuacccacagucacccauggucugaaaauacuaaguggaaauccagaaauaaacaguucauaaguuuuaaguugcaacucuucugaguagugugaugaaaugucaccaugucccgcuccauccugccccggaucugaaccgucccuguguccaacagauccacacugcagacguggcucucccauuagucacuugguagccaucucaguucccaggucaacuguuggugguacugcagugcuuguguuccauucccucuuauuugacuuaauuuuucuauuuuauuauuaguuauuguuaaucucuuacugugccuaauuuguaaauuaaacuugaucauaaguauguauguauaggaaaaaacaagguauauuuguguauacauauauauaaaaaucauauauguguauuugauuugguacuauaugaguucaggcauccaccgggggccuuggaacaccccucgaggauaaggggggacgacugacuauauguauguguuguggcuccucaugaccucccaucugccuccauuagcaucuucagggcagacggcucagcucuuaggcccuuuauaggggguggguugcaggaaucagagccagagaaggcuugcuuuuugcuuuuucaccuaagucauuuuguuauaacaaggauugggaaucagguuuuucaugcaaauuauacuugcuaugaaacaguuuuucuuauaaucaugggacaaacuuucuucuuuguagucacuaccuugugacugugauuggaauuuaugauucuuuuauucuccguauaccaaaguccaugcauguuuuggucuucccucagaaucuaaaacuggaaggaacagaggaccucucugauguucuugugaggcaaggagauugaguucacuauggagaagucagcagcaggaggcccaucccuuacucaguugccgggacauccccagucucgggggaagaagaugccaugggcuuauacccaggcuguagccaacuaccaacgugccuguuuguuuguugcucuuuccuucucuccaucauagucugggugccagcgcccugaagcuccgugcucaacugauuaaacuuuacugcccuauggugaccaucuaggagaggggagggcagagggggugaggguacuauucuggauugagaaaaccuauauccauucuuuauaucaauguauaguuuuagucuccuaaauugaucuguuauuuuccaaacuauucucuuguagaaaauuuuccagugggcacuuaauggugcccuugaagaacuuccuaauccauguacauaaaauacaucauauguacacuuauaaauguauauagaaugcucaaaaauaaaauucuuaauaauagaacuggcaaaauauuugaguguccacuagaugaguaucagaccuaguccuuacccuuagggggaugcaguccugguuguuauccaggauacacaccugucaguauaaggcagaagaugccuaagggccaagaugguuugccucggaggagaauggaagagagagauugcugacuggacauucagaugcaagacuggguccugcuuaaaucccaggauucugcuggagggagcugauagugauacuugucccuucuguacauugcuucauguagccuucucagcaucccuaggagaaacuuacuauugugacucucauguuggaggaggaaacggacacccaagguagaggaacuugcaaaagggcagccggcaaacugucagggguggccugagccuggcaaucugccuccagagucugcucucggccauugugcuaugugcuaccuggauaggucauacaggcucagcaguggguggagagcagugcucagauuuguccaucuccacagaaugcagcacacacacaaauguacaaguucuuccccuaaccucagaggaauaggggaauuaacuuugcuugcaauuuggaacaauauuauagauguugauccaaguaguucuguuacuggcugguccuggaucucugccagaacacccgucaucauugacuggcuaaauagagaucuuggauauaggccagaagcagugaaguauauaauuggaaauugcuccugauaauaacuuccuucuuagccaaaaaccacacaaaacaaaaauaauccccuccccacaggaauaugcuuuccaaauuguguccaaaacauuaccugcucuguuauauugagaagguuagagacuucagagcaugcuuagaaaaagcaguggugccacaggugagacuccacacucugucuugcuggggcugaagccuccaucacuuucccaggccagguuagugcugggcuucuugcuuuccuucuauuccugagaguagaacuggcuaagcccauuccuucccucagucagccccacuucucuauaguggguucuggggguggggggcugaauuaccaguaaaacuagaaagauugggaccaagugcaguggcccacaccuguaaauccuagcgcuuugaaaggaagaggcaggaggauugcuugaagucaggaguucaagaccagccugggcaaaauagaaccccaucuuuaaaaaaaaaguuuaaaaauuagccagguacggaggugugugccuguaaucccagcuacucagaaggcugaggugggauaaucacuugagcccaggaguuugaggcugcagugagcugugaucacacuacugcauuccagccaggacaacagagugagauccuaucucuuaaacaaaaaaaaaaacuggcgaguucaauaccaacuucuacaaugaaauccccuuccccccacaacccugcuucuccuaaguuucccucauuacaugguugcugugggcuaugugugcuguggucugaauguuugugucuaaaauucacauguugguauuaagagauagggccuuugggaggugauuagguuaugagggcagaucccucgugaaugggauuagugcucuuauaaaagaggccugaggaagcuuguucguuccucuugcccuucugccauguaaggaugcaaugagaaggcaccaucugugagcaaggagccccucac

SEQ ID NO: 191237 - RNA, 26811 nt, Homo sapiens
aaugaggacgcguggacgcgcggcacgccgguccuggcuacaggcgcggcguuugaagaaaaacugucacugaagagucaugguggggcccgggccuaccgcugcugccgcugucggugaguacgaccgcuguucccguuauucucaggcguuggaacacggccggggaaguaggaggccaccgagugaguucgucccgcgggaggugcccguccgcucgccugccuaaguuuccccugggcguuuuccaucccgggagcgcagacgggacccccagguagacgucuggguccugggcgggggaggcugugcgcaggcccagauaccucacgggcguauuuccagaaagcccugcagcagccuugcaaagagaugucauugucaccacguuccggauaaagaaacugaggccccuugcucggguuuucaccagcagugggaagcugcgcgcuguuuugauccacauuuggcuccaggcagagccgggcgugguccucugugccaggaggcggggucuggccgaagcccgggucuccugccucuggcggggcucucacuccacaccucucagccugcggugguuagaaguugauugguuaaaucugcacccagggcuaaggcuucugcguucccuaaucucuuagaugugcuuggagcccuuuccuaccuuucaaaauacuccugcucagaugccacuuucuccaagauacgcaccguuguuuuguuucauccauuauuccuguugaugccuacgagguccuaggcacuuuacauaacaagcuuuaaagauggcauuucuguccgccuuauaggcuuagcagcagcaaaguuugcuaauuugcuagaagucacggaggugggacuccaacccccuaugucagccccuacgcucuacauugcccgccaagcugucucuaaggauagauacaugagcaucagagagcaaaacagggcaacuccguucagaugagguuaagagucguuuggcaccccugucgucuuuuugucuuccuucacaucauuauuuacuuuuaaccuuuucuagccaccuacuccccucauuuaugcccuaccucugaacucccauacuucuuuucgucucuuauggcccuuagauuuuaccuuauacuguaauuguugcuguguugauuuuaucuccacuacuaguuugaaaguucuugaaggcagaaauuauugacuugucauccccucacaaauggcuugcguagaaagucaccauaguauaggugucugccgugagcagaccgggcguauuuuauccuuaguaccaacaaaggaagccauauaaggguuuguggguaaaaaucaucaucccuguaaaaaaacaaaagacguaagaccaggccuggcucaccagcucaggugggccaguaacagaaauucuucaaaacagacuguuguagcugagaacaguggcugugagcuccaggguuagaaaagccuguuuucaaguccuggaauugccacauauuagcuggguaacuuugggcaugacauuuacucucucugaauuucagauugcaaaaacucauuggauuguuuuguggauugaaagcaauaauguaaauuuaggccgagugcuuugacuuacgccuguaauccuagcacuuugggaggccaaagcaggagggucacuugagcucaggaauuugagaccaccccuggcaacauagugagauccugucucuacaaaaaauuuuuuuaaaauuauccagcauggugguacacgccuguauucccagcuacucaggagacugaggugugaggauugcuagaaccugggagaucaagucaacagugagccgugguugugccacugcccuccaaccucagugacagaggaagacccugucucaaaaaaaaaaaaaaaaguaguaaguuuaaagaacuuaguguaggccuggcauauaaaugauauuguugauguugauguuagcuugaaggcacauuuauaggacuagggauuuuauaacauuauguugcaaaggcaaaaucacuagagaaaagugucaucuuuuagaauauuaaugaacugguuaaaaucuugaacuaaaguuaugucguuuguuugcuugccuguguugcagaagagcggcagagaaagcuucaggaguaccuugcagccaagggaaaacugaagagccaaaacaccaagugaguuuaucuguccacaguuacgcaaguuuuguugccuucuuuguacuagcaauuuaaagccuuuuugaaaaaugucccuuuugcuuagagucuacucagacugcacugggauucuaugauaacgcaaaaagagcauuucaguccaggcaugacaaaaaccccugggcagugcuuaguccauuggcaaagcuuuaugcauuauuacugugugaaucuccaaaggaaggagggaagaagggucaguauuaccuaccaugcuggaagcuuugccuguuucugcuuuuuuuuucuuggggaaguugauucucaugaaggcaguuuuuggucaagaacuugaaugaccaugguucuggcauuucuugcuaaggcaggagagccaguuacaaucaauccuccguagcagagugauacccucugcucuugggucauucucuuagcauuuacuguuaagguagacagaacauguccacuucauuuuuauccuuuguagauucuuaccaucuuugucguguuauuuguccuuucuuagcauuaauuaauuuuuuccccauuugaguugcuaaguauuuauuugaaaauuaauuuuuacaaaguuagcuuucacccuuuauuuuaucuuggguguuuacucaccucuauuuccuugauuaaaugaaccuaauucacuuauucaacaaauauuuauuuaguaccuauaacaucucagucacuucugaugcuagagauaauggcgcuuaacaagacagacauuccugcccucccagggcuuaugcuguagaugggagagacaaacaucaaacaagucauaaucaaaguccuuguuagucuagcaauuguuuuugguccaugcagauugauuccuucuaaauucaccucuguuuuccaauccuuuuucugcauuuccugucucacuagcuauauuucaugugugucuugguuuuuuuuuuuuuaauauuucuuuacccccuuaaaguuagaagagauaguauuugaagauacugaaaacaaggaaauuuuuuuuuuuuuuuuuuuuuuuuuugagacggagucucacucuguugcccaggcuggagugcaguggcgcaaucuuggcucacugcaagcucugccucccaguuucacgccauuuuccugccucagccucccgaguagcugggacaacaggcaugugccaccaugcccagcuaauuuuuuuguauuuuuaguagcgaugggguuucacuguguuagccaggauggucucuauuuccugaucucaugauccgccugccuuggccucccaaagugcugggauuacaggcgugagccacuacgcccagccggaaauuuuuuaaagaagcaguuaaugguuuuauuuggcauugugucuucggugucuggcacauugcagugcuccaggaaugaugugugaaugaguaagacuauauaaauaugaaggaaacacauauaucucauuaauauugugagaaugcuagauuuauguauagacagucucuguaaggaucacaaggcaaaaaaaaaaagaguaggagcaguugguggucuccaagggggaggauacagaacuaaagaaaugaugauaaggagacuuuauuaaauauaauuuugaauuauuuugccauuacagaaauucuaauuauuuaaaauucuauucauaauuuuuaaucacuguacuucccaagcuuagcuuagaauccuucugugcugaggauuaauuuuaauuugucuuuuauaggccuuaucuaaaauccaagaauaauugccagaaucaaccaccuucuaaaucuguaaguagaaauuagucuuuuuaaaaauaugcauucauaaguaugauuaguaauaaaaauaauaaagauguuagcaaccuaaagaacauguauuugaaagguauuucuuacagauauaaaaacaguuugguuuaauaagagacaaucauuuuuugaaaaguaugacauuuuuugaaaaguaguuuaguuuuauuaaccaagaaaagccucaagugaacuuuaguccucuugauagcuaacauuuauugaaugcuuacugugugccugauacuuuucugacuugcauuaccucacugaguccucacaaucuuaugaggcuacuauuaguagccccacuuuacagauaagcaaacuaagucacagaaagguuaaauaggucguauagcuauuaagugacaaagcugagagccugugaucuuaaccacuuugguaugcugccaugaaguuaaauagcucaguagucauuaaaagagaacauuugcauugaaccuuccaagccacuuaacaaguauaugcuuccuaaucaauuuaauuuagcuacauuagauagaaugguaaaggauccuuaacuuaaaguuuaaauggaagaaauuagcccucugaaagaggcacagauuauucaucugcaauaaaaaucucaccuuuaguuuuuuaaaacauaguuuuuaucuguguucugaaauguaacuaaaacagugcuuccugaagugaaaaauucucacuggugagaauuuuaauaaguuuuaaugauucaccaaaucacuucagucauauuucagucauaugcauaugcauauauagacauauaaguuuuuaucuguguucugaaauguaacuaaaauagugcuuccugaagugaaaaauucucacuggugagaauuuuaauaaguuuuaaugauucaccaaaucacuucagucauauuucagucauaugcauaugcauauguagacauauauauguuguauguauacaugacaucauuagacacugugaaggauagcaaaauguauauaaggcaaaauuuaugaacaaugguuuaacguuugggaagcacuggguuacacuuuuacuuuaugcagauugaaccaguauaguaugcaagucuuaaggaaaaaucuacuggaaagggcccucauucagacuucccagaggcuucucuggaaguugacaauacugacuucaguacaucagcucguaaaugaggaugauaccuaccuuaucugcuuuacacaguuguaaaaguaaaaagugaacucaggaagggaauuacagaauuuaggagaaacuaaaagcacgauguaaauaauagucaucauuacaguuauauaaugcuugacaauuuauauaacacuuucgauacaugacaacaauaacuaacacccagacauguuuauauacauuaccucacucagaacaaccaugugaggaaguuggccauaugcuuuaauguccaaaccaggacacuuugagaguaaaaagcaguacucuuugaccaacaggcauaaaucaaaacuaucuugugaaaaccgggauauauggcauccuuccuagauaauagauacuuuuacuauuauuaauuuugcugugaaucuaaaccugcucuaaaaaaguuaauuuuaaaaaguaaugaaguacugauacaugcuacaacauggguaaaucuugaaaacguuaugcuaagugaaagaagccagacagaaaaggccacauauuacaugauuccauuuauaugacacaucuaaaauaggcacaucuauagacauacagagacagaaaguagacuagcgguugccaagaacugcagggagcagaaaauggggagugacugccaacaaguaaaccaaguuucuuucuagggugaugaauauguucuggaauuagacaguggugauugcuguauaauaguguggcuauacuaaaauccacagaagugugcacuuacuaaaauggugaauuuuaugguuuguggauuauaucaauuuguuuuuaauauauaagaaagcaacuaaaaaaacacauuuggaagcuuucaugccaacgucccuccaccucuucaguaagcaaugauggagagauccgagguguauauaaauguuggugcucaaagauuaauccagauauagccauuguggguauaccauccaucucucugccucccacucccaacuccgcuguuucacuccuaguaacaccacacacaccgcuaucauccagaguagacaucucuuugcccucaaugccaaaugguucugguuagaaauccuuuacauacucgccaaguuuauguagugauucuucacaauauuugucaaaucaaaaauagagugguaacucuagcauucccauaucuuacccuggaaacauauuccauaaaucucugugaaauucuccuuucugaguaauugcuuucaugagagaugcucaggaauucauaguggcuugcccaauuacuuaccauaugaauucuaaacucccuucccuaguuuucaaaauucucuguaaucgaguccuaccuuucuuauccaaacuuaaaucacaugacuaaacauuuguuuauuauuaacauagacucuaaccuuaaaacccuguccuggcugauuuuacaaauaugacuauuaagauguuacauguuuauugagagcuguggcagcauaucucaggccucacaucaucugccaccuaucuccuugucacugaucuccagggaugagacagagguucuugagugauacugugauguuuacaaaggcagugguuuaaaaaacauauaguguggcuauacaaaguacuaggagagauuuguugggagguacccuaacauaaguucauuauguauguauuuuuucaggguucuuuggagggcacuuaggauauaauaggcauucaacaacuacuguuugaggcaaauucauuuuugaaagagcaaguuuuguauauucacugcaucucugcuuaauucugucaagcuaaaagauucuaauauacuucugauaggaacucaaguuguaaaaacuaccuguuaggacaggugugguggcucauaccuguuaucccagcacuuugggaggccaaggugcguggaucacuggaggucaggacuucaagaccaaccuggccaauauggugaaaccccaacuuuacuaaaaauacaaaaaaguagccagguguagugacaugcgccuguaguccagccacuugcgagguuggggugggagaauugcuucaacccaggaggcagagguugcaaugagccaagauugcaucacugcacaccagacugggugacagagcaagauccugucucaaaaaaaaaaaaaaaaaaaaaacacaaaaacuaccuauuagugagucuuucuuuacuuucugaggauucaacuuucuuagaugaaauucuaaaaaugauuauuuuuuuuagcauguguuaaacacaguuauuauuuuaaaaacaauaagauauguuaaggauuuuuuaauauguauuuucuuuguuuuuucagacuauuagacccaaaaaugauguuaccaaccauguuguuuugccugucaaaccuaaaagguccaucagcauuaaacuccagcccagaccaccuaauacugcagggucccagaagccgaaguuggagccaccaaaacuucugggcaaaaggcugacuucagaauguguuucuucuaacccauacucuaagccuucuagcaagaguuuucaacagugugaagcuggaucguccacaacaggagaacugucaagaaaaccuguggggucacuuaauauagagcaauugaaaacuacaaagcagcaguuaacagaucaaggaaaugguaaauguauagacuuuaugaauaauauccauguugaaaacgaaucuuuggauaacuuucuaaaagaaacaaacaaagagaacuugcucgauaucuuaacagaaccugagaggaagccagauccuaaauuauauaccagaaguaagccaaagacugacucuuauaaucaaaccaagaacaguuuaguuccuaaacaagccuugggcaaaaguucaguuaauagugcuguucugaaagauaggguuaauaaacaauuuguuggagaaacacaaagcaggacuuucccaguaaaaucacagcaacucucuagaggagcagaucuugcaagaccaggaguaaaacccucaaggacgguucccucucacuuuauucggacccuuaguaaaguucagucaucaaagaaaccaguagucaagaacaucaaagauauaaagguuaauaggagucaauaugaaagaccaaaugaaacuaagauacggucauacccuguuacugaacagagagugaagcacaccaaacccagaacauaccccaguuugcuucagggugaauauaacaacagacauccaaacaucaagcaagaucagaaguccagccaaguuuguauaccucagacaucauguguacugcaaaagucaaaagccauaagccagaggccuaauuugacaguuggcagauuuaauucagccauuccaagcaccccuagcauaagaccaaauggaaccagugguaauaaacauaacaauaauggcuuucagcaaaaagcacagacuuuggacuccaaguugaaaaaggcuguuccccagaaccauuuucugaacaagacagcucccaaaacucaagcugaugucacaaccguaaaugggacccaaacaaacccaaauauuaaaaagaaggcaacagcagaggaucgaagguacuuugcuuuaauucuaagcuuuugcaacuuaagaugauuaggcaaauugaccaucaagaagacuaggucaggaaauaggccauaaauaauggcuccuaaguaauuuuuaacuacagucugaaaaaagauuugaagcaaauauaacaaauauuaagacuugacagggcuaggugguacauacacauguuauaaaucauuuucuguaaucguauguuuacaauagcuuuuuuuuuuucuuuuuaagaaauugaaacagaauggaugaguaagaaguagggggugcagauguagacacucguucaauaagugccgugcuagacugaacagcaauagagcagauaagugaguucacauagcuaggaagugagaagaugguaaucucuugucaagcaaaccagugguuaaguucagaaaaguuaccagggaagaaccagaaacuuccgugagucugagugggccaaguuuuggccaguaagcucaagcaggagcagucaguucaaauacagaguucagaugguagaaaucaagaucuuaggccgggcacgcuggcucaugccuguagucccagcacuuugggaggccgaggugagcggaucaccugaggucgggaguucgagaccagccugaccaacauggagaaacccuguuuuuacuaaaaauacaaaauuagccaggcguggaaaucaagaucucagguugguuaauauuaacauacauugauuaaaacugagccaguggauuuuguacacuuucuacccaggaccaaauguagucucaugaagugggugagccucccaggagaagcacauauguauaccugcuugaaguagaaaauaaggaaauuucugacgagugaagggagcauguaaaauuagaugguugcuaaaaaguguagcagggugaagcaagguacagcuugguacagcccugaacaccaccaccaagcuccuugcccuccugaagagacaguaaguaaacaacuuaauucagggugcuaugaucaagagaguagggcuggaauggcugcuuuagauaaaaggaucaguagaaguacuuucaacagcaaugucugagcugagaccuaagucugagaaaagacuggugacaagaagaaaaacaauccugagcagaaagagaagugagugcagagaccuugagguggugaauaaggaagucagggucccagcccuggagcucagccuaggucagacaacagaggauuggucauaagacuguguugcagguugaacauguuugauuacaaaagagaaggagucuagagagggagagauucauucacucauucuguagguguuucuucagcaccugcagugugccaggcgcuaggagacacagugaugagcacacagugagucuuuaccuuucuggagcuaauuguuugguguauauauagaaaguacuagagaaacaaaauuauggcaucgagguccuaggaguaaguugccuuuagaaagggaaaguucacucuucguuuaugauuagaaggaaggcuaaggagauagggaaaaugcuaggaacauggaggaagcacaugccaaaugucucaccuuguaucaucaaguaggugguuggagugaaggugagggggcaguauuuggggcugaaauaauaaauauugcauggauguugcucuggagucagaaaugagaguuaauagcauucauucauucaaaacuuaguuauuggcauucuggaaaaaccaaaacuauaaagacaaaaaacggaucagugauugccaggaggggggcguuaggggugagacugacuaccaaggagcaugagggaauuagugauaguguugcaaccaucuuauagcuugauaauagucagacuuaaaugacuugaugcauuugucaaaacucagaauugcacacuaaaaggugaauuuuacuguguguuauuaaauaccuaugugugcuaggcacugugcugggaacuggacugccaagguuucugccuucauagagcuuacacucuaguggaggagacagaaaaccaacacauugacuaaauaagacacgguaauuacagguaauugcgucuucauggaggugucauuugaggggaggacugaagaugcaagaccuuaaggcaggaaugagucuggaucaagaaacuucaaggaggcaggguacaaugguucacgccuguaaucccagcaccuugggaggcugaaguggucagaucacuugaggucaggaguuugagaccgguuuagccaacauugugaaaccccaucucuacuaaaaauacaaaaauuagccgggugugguggcacgcgccuguaauugcagcuacuugggaggcugaggcacaagaaucacuugaacccaggaggcggagguugcagugaccugagaucaugccacuucacuccagccugggcaacagagcaaaacugucucaaaaaaaaaaaaaaaaaaaaagaaaagaaacuuuaaggauaccugagcuccuggagggggugagugacagggagacuagugugauacgagguuggagagguaggcaggagccagauuacacugugccuuucugccuuggaaaauauuuugaauuuuauuccaagagcuguggaaaguucuuggcagugacacagccuggggugcuauuuaccaaaguaagaaaaauuuguaacagaugcagagaugaaaaucaauaacuuuguuugugacaguauuaaauuugaaaugccugucagacaucaaaagauaucaacuaggcgguggguuuuacaaaguuuggggauccagggagagaucuggacugaaauguacacuuggaagucauuauuaauauguaguuguaauuuaaagaaacuggagugucuacauccaaacaugaggucuauaugucuuggugccccuacccccaaaaagcagucuaucaccuguuagaagcuggaguggaaaaugugaacagugggggacacuuggcacuaucagagaucagcuacuuaagagcccugacuuuauaggucuagcuuaugaaagagucaugucuggucaagagagggcuaaggaacuaggugaagugggucaguuuacacaccaagaccuuauugaggguagaaugcaggcuugguggguuuggguugagugacagcuuaugcgugagagaaaugaauugcugaguuagucaucucaaaaauagagggaugucuuaggaaagcaagugucaaguagcauauagugaagugaaaacuuuccgagaaaaauaaugcauaaucacgaauucuauuugaagucugaagugcuggccacgugugaucuuagaaucuuggugucugccuucucgugggugggcgcaacccaaugcugccauuacccauuuguaaauuguuuuuuaauuccauucuccugauuuugucuguaguugaaaguauuuaauuauacucuaucuauacauaucauauacuuuagcagcuugacuauguuuaaaaauaaauaaaaccacucucccuuuaauugaauuucaggaaacaacuagaagaauggcagaaaucuaagggaaaaaccuauaaacggccuccuauggaacuuaaaacaaaaagaaaaguaauaaaggaaaugaauauuucauucuggaagagcauugaaaaagaagaggaagaaaagaaagcacaacucgaacuguccaguaaaauuaacaacacucugacagaaugucugaaccucaucgaagggguaagugaagaagauaagcuccuccagcuuuggcccaaagucuuauaauuuuuaaacauauuccuaaauauaauauaggagagauagccuucaucuaaguagaaauuuagcuacucuuguaaauacagaguaauaauaauaaugacaugcccauaaacagugucuuuuguguaucugugcuuuuauaagcacuuagcuaagauuaucucacauaauuaucauaaccacuguuacuaugaccacuuuacaaacaaaacugaggcacaaagaaguuggaaaacuaauccaaacaaacuggcuccaaaaggaacuuugcuuucuuuggguaucaaguucugaagaguacacauuuaacauugaaacugaggucagaaggcaaguuucuguguaaaguuggaguauucugaauacucuggguagcuacaaauaguauuuaaauuuuaucuuggauucugcagauaaggauaaaauagaugguaggcaaagaguaugauccuuaggagaaauuuuuccugaaggaaaaauauauuaauaaaaaaugauggaauaaacuucuaagauccuugccuagagcaaaacucauucaguccuuuggcugguaauguugaacaucagcaaaaaaaaggaaaaguucaguuuaagucuacuccaggcaacauuuucacaacauccaguuaaauauuaacuauuucuccuuguggaauugaacuugaguucuuuuucuuauccucuuuuuuuguuguuguauuauuuaaaaaugaguaccuuuuuauuauugaaaucauuucaaguaaugcagauaaaugaucagcccucucccucuacaaacauacauacuuaggcaucccaaacuucucucuggaggugaccaccauugccagucauucauucuguuuucaugcauguccauacaguauagguaugucgagaaaugaaguauuauauuuuugugaguugcaauucuuuuauucacauuuuuguguacuuugguugucuuuucuuguguuuuccuaguaccaauguuaugcugacuuaggcagaugaguugaguauuuuccuuuuugcccuauaaacugaaaauaguuuguaugacaugagaauuauuuuuauuuuuugaagguuugauaaaaacuugcccauaaaaaucaucuggaccguguuucuuuggaggauaauuuuguauauauccucucaauuuguuauggggucauuguucuagaguucauauaucuugagucaacuuuaguaauuuugugacuuuuuaaagggauuuuuucucaaucuuuuuaaaagaucucagguuuuauugccaaagauuuuuucucauuaaucuuuuuaaaagaccucagguuuuauugauuauuuuuucucuugcaucaaugucugcaucuauuuuuauauuuauugcucuuuuccuagcuuuuuaauugaaaccuuagaucauuuaaaagugagucuuucuuuuuuuuuuuuuuauaaauauguucagugcuauagcagauuugccucugaauuuuacuuuggucauaucccucagauuugacuaaguaauacucuuuaucagucaggaucaagucugaaaaacaaaccacagaaagaauguaauugguuacacaguaucuuauguggguucucuagagguggagccuaagaggagaauccaugugaaaguaguuuauuaggaagacacuccagggaaaacugggaggggagugaaguuguaggaucagaaaagcgaauccauggacggugacucuggcacagccccacaggggagcucuggagacaguguaggucacaucucucagagucauccugaucagaggcaagggagcuacauuguuaaagcuuccauggucauuuauucauggcugccucgggcggacaagaauugucaggcacuucucacucucugggcacauacgagggagcacagaugcuggcugugaaagcacgcgguaagccugugugcacaagaugcugaagggaucagaaggagugugggugcuacacacagggcugacagcacacaggaaccugagguaaugugauaacuguaggaagcagcuuguacccacugggucuaggagaacaaagagagguuaggguaucagaaccaagaagcaggagagacaaacccugguagaaaugggacuccaacuguaaggaaggcauacuacccagcagaugauggaggagaggcccugcagggcuggggcucagauuuugaggaaaagaugcuauccauuuggugcuucugcucugaagcugcacagggaggugggcucugagggggaaaaaaagaugcuagaaccaacuguuacugccagggugagggaccguugcuggggugaugaaagcaaauaggaagaagcaagugucuuccuucuccaucccugcagccucccucucgugcccccugcuggcagagcugagcagggagcugcugcccagcagaaaguuuuacagaguuuuauccccagcaucacaaagcagaggaugggguuuggggccaauagacaaaagcuucauaacugacauaucuugucauuguucauuucuaaauagcuugagauucccauuuugaguucuuuaacccaaaaaauaucuuagaaaaguaucuuuuaauuuccagauguguagauuuuuuuuuucugcuguuaauuucuaauuauauugcauuguaguuggugaauguggccuauguguacucuacuugauggauuuuguugaaauuuucuuuguggccuuaauaucugaucauucuugguaaauguuccaaaaguguuugaaaauaauguauauccuauuuguuuauuugaucuauugcuuucugaaagaaauaugccaaagucugucacuggcacugugauuaaucauugacaauuucucuucauaugucugucaauuuuuacuuucuauuuuuuaaaguuauguuguuagguacagaaagauucaugacuugcuuugauuucuuuugucugauuaaucuugccacaccugcuuuuuguuguuagaauaugucugguagcucugguagcucuuuuuccaucccuuuacuuuaagccuucaugggcugacuuauuuuagguaugucucauauaaaugcacacaguuaaauguuuuaaacaaauuugaaacucucugcuuuuaaaaagcaaauuuaguucguacacauuuauuaugauuacuuguauguuuaaacuuaugccugcuauuuuauuuuguaauucagcuuacaugaauuauuuuuuccucauuucuguguuuaaucuaguuuuauuucauaaaauaauacacugaaaugaaaauaaagugauagauguaagcucaaacaugauuugcagaauauauaucauauucuucuugcaguuccuuuuuucauuuuuuuuuuuuuuuuaagagacaggguuucacucuuuugccuagauuggagugcagugaugccaucauagcucacugcaacuuuaaaccuccuggguggacccaagugauccuccaccucagccuccugaguagcuaggacuacagguacacaccacuacacccauuauaguuuacauuuuuuuguagacacagggucucacuguguugcccaggcuggucucaaacuccuagccucaagcaguccucugccucagcuucccaaagugcugggauuacaggugugaaccacccacugcaccuggccugcaguuacuuuuauuucaagucuuucaugugaauucuaaaguuuacucacuagugacuuuaugauuuuugaauggcaaaccuuuugagucuguauucuugugaaacuuguuauuugccuucaugcuggaaucauaguuuggcugggggaaauuucuuaauuucagcuuguuuucccuggaaaaauuuaagugacugcuucauuuucuuucuugcaucuggaguuguugauuuguuaaugucucacgucagucugauucucauuccuuuauagguaauccuuuucuucccccucucuggaagcuuguacgauuuucuuuuuaucuuugguuuucuauuauauuuuuuucucccauucauccugcuuaacuaucugagagccuuuucaaccugaacaacuguuucuuuguucauuucuugaaauucuucuucuacaaccacuuuguguguugaacuuuuuuccuucuagaaacucucuuagauggauauuggaguuauugaguaauggauauauccuucagaacucuaaauguuguuuucauacuguucacuucauuguuuuauuacacugguuucuaggaggauuucacagcugaauuuucagcucacagauguauucuucagcgcuguccaugcaguuguucugccuuucuguugguuauuuuucauaacagcccauucuaguuuuaggauagcaauacucucucuuaucacucugaagauauugacugugauacucuuaaaaguauuccucuuugcuccaguguucauucuuguuuguugaguuuuaugccucuuucauguaguguugguuuucucaaauguuagugauucucaauugugaacuuaccuuugcgucucccccauuucuagcaguagaaggugcugcuuggcugagugugccaguaccuggauuucugggcaugguagugcuccccauucguuggguccaugucacuguccugcuuacggcacaagccagaagggaaccaaaccagugaauccauuucaaauuaucuuuuugugggauuuaacccucuuucauaaacaccugcauaaaucccugacacuuacacauauacaccccuaugaccuucgcaugccugugucauucuuuacacugcuauuaguccuauggaaauucucaucacuacucaguguucucguuauuauaaauauggaauauuaugaauauguaaauguuuacucuaggauuuguuuuguuuuuguaccauguaaaaaugaacauauuucuuaccuucagcuaugauaaacauuuucuauuuggucucauauaacucuuaaaauuuaaugaugaggaagccaggcucaguggcucaugccuguggucucagcuacucgagaggcuaaggugggaggauugcuugaucccaggagguagagguugcagcgaguugugaucguaccacugcacuccagccugggcaacagaguaagaccuugucucaaaaaaaaaaagaaaaauuaagccaggcaugguggcucaugccuguaaucccagcacguuaagaggcugaggugggcggaucacgaggucaggagaucaagaccauccuggcuaacacggugaaaccccaucucuacuaaaaauacaaaaaauuagccgagcaugugguggcaugugccuguagucccagcuacuggggaggcugaggcaggagacuugcuugaaccugggagguggagguugcagugaaccgagaucgcgccauugcacuccagccuggacgacagagcaagacuccaucucaaaaaaaaaauaauaauuauuauuaaucucaaaucauuaaaauggauaauuaaaacaggugcauuuuauuacauguacauuguaccucaguaaaauugaaauuuuuuuaaaaguucaaaaauauuagugaucaaaccaauuucugcauaccugcuguaauaaauauuaggagaugugagacuaacagugaaaugguaauaauuaccucuggauauuuugguuuauuucaggguguaccuucuaaugaaauacuuaacauauuguccagcauuccugaagcugaaaaauuugcuaaauucuggaucugcaaagcaaaguuguuggcaaguaaaggcaccuuugauguuauugggcuauaugaagaggccauuaaaaauggggcaacagugaguaucugucuuggguggguaacuucuuaaaauucucuuucaugugaguucucuguuguuguuuguaauaugaugguuagaaguuugcaacaucaauauccaacacuuauaaagucauaccuuaccauaaagaacuuaaaaauauauuaaacccaauacgucagcauccuuaaaucaauaauucagagccauugcaugaaauaacuuuuaauucuaaaauuuagaaaaaaaaacuauauaauuauuauuuacaaaaacugcaucaaauaguuuuauaaugcuuuuccuuaaaaugucauuuuccaugucauguucuguauucugugugauaccuuuuuccauaaugguucaaaaucagaauuguacaugcacauaguuuaagcagucaaguaguuugauaaguuucguucaguaagaccucugccuuccuucccucccauuuuccccuuccuagagcaaacugauuuauuuuuauauuaaccucuauaguuucagaaaacguguuucuguuucuugauuuuucaguuuuagauaugauuuauggacuuccagcuaugcagagugaagauuuagcccucuuucacacauacauacacagauccccagcacacacaaauacacaccccuauuuaccauccuuauagaccuuugccauuccuuauacuuucauuagagucauggaaauucuggucacuauuuagcauucacauuguuaugaauauauaagaaauauaugggcugggcacgguguuucacgccuguaaucccagcacuuggggaggccgaggcagguggaucacaaggucaggagaucgagaccauuuuggcuaacauggugaaaccccaucucuacuaaaaaauacaaaaaaguuagccgggcgugguggcgggcaccuguagucccagcuacucgggaggcugaggcaggagaauggcaugaaccugggaggcagagcuugcagugagccgagaucgggccacugcacuccagccugggcaacagugcaagacugucucaaaaaaaaaaaaaaauacaugaauauguugagccaugcaauauauacuaugauuacuuugccuuucaagcacaacuuucuacuuuuccuggaguuauugucuuguuuugccuuugcuuaguuuucugaguauuuauuauauaauuaauucacaaacucuucgcuaauugucuaaguuccucaauacuuugaaaacaucagauauucuauugauuccuuuuucuuagauaaagagcuuucuccuagacccuucuggcuuauuccagacugaacaaguuacuuuuuacugccgucuucaccagcugucuuucugggaucucuuuaccaucaccuuuagauucccuuuacauccuucuuaaguuggguggaucccuuguuuuuagaacccauauuaguuuucuucuuccuacauugucuauuucuucuccaauguuuuucauuucuuucucucuuguuauuguuuguuuguucuuuuuguuuuguucucuauuauucuuuaaaggcuuuacacagaugcuggugaaacugggcuguuugcacauauaaaaggugggucugaaaaagcuuauuuaaagcccgagacacauggauggggcuucaacacagggugaucuggcugaguugacuaguuagaaaacccucaauaucaguaucuuuaggucuuuccucuuaagcuggucaaguuaucuggagaaaucuguuccaaucuccuuccugggagcuagacaccaggcugccagugcugugggagagaagagagcagggagucucaacccucaacauagaaacuuuugcuuaucuccuuuucucagaaagcacccuauccuaaucuugcaugauaucccucagagacuugcagaauacauucccaguuuucuguuaggaugaagggagucagacacaguuacuaggcugcauagaguuuaggggugcaggauggauuuggaggucugacugcuuuuugaacagaugcuaaagaguccuccuaauuugggcccuaccacccauuccuuagccuuucugucagguuguuucuuagccacacugccagcuugggauucaacucucucaaguagaucaaauuguuuaccucucuuccuucugcacugcagcuuccaaaaccuuauugucauuucuucucuccuauguuuugugguuauugccucuucuuaaucccuuuauuauccuuucagucgauuuucaagagagauuagaaauaaacguauauuuaauccaccaucauuaaccagaaggcuauacaaauauaaaauaugcuugaugaauguuguauagaauucacucuuuguaauauauucuauacauuuauucccauucauuuagcugaaaucauaauucuauuuuggauuuugaaaaaauguacggaaagcuuugcuuuuaugcuuuauugucaguuuauaucuauuugauacagaguuccagguaaggaagacaaaccuccaacuauaauuuucuugugggaaagugcagcuucugcuucauggcaugguuuacauacuugaaaaauaaagccuaucucagauaauuuuaucagaaaauuacuuuuccaugaagguuuuuuuuucuaaguauguuaacaaauaaaagaagaaagacaggaaaagcuggagaaaauuacucaaaaugccuacaaagauuguaucugggccaggcacaguggcuuaccccuguaaucucagcacuuugggaggcugaggcaggcggaucacuugagaucaggaguuugagaccagccuggccaacguagcgaaaccccgucucuacuaaaaauagaaaaauuagccagaugggguggcgcaugccuguaaucccagcucuucgggaggcugaggcaggagaaucacuugaacccuggaaguggaguuuguggugagccgauaccgcaccauugcacuccagcuugggugacagagacuccaucucaaaaaacauuguguuuggggccagguacaguggcucacucguguaaucccagcaguuugggaggccgaggcggguggaucacgaugucaggagaucgagaccauccuggcuaacacgguaaaaccccaucucuacuaaaaauacaaaaaauuagcugggcgugguggugggcgccuguagucccagcuacuugggaggcugaggcaggagaauggcaugaacccaggaggcagagcuugcaaugagccgagaucgcgccacugcacuccagccugggacagaguaagacucugucucaagaaaauauaucuauaucuauauauaaaaugcauuuucuguguggcuagcuuuacaucauugggccagaauuuuuauguaggaauacauauuugacaguauuauacaaaucaauaggaaaauagaauuugauguagacaaauuacauuauggacaacuuuaaauacaucuguucauuaagucgagugugccaacacuuaaucagaauuuucucuguuccuuuacuuuucucaugaagcuauaaaacugucaagcuagacaaaagauuuauaguuagacgagauuuuaaaaggaaacuuuuauuauaaaacauguauuugaaguuaaaguuccuuagcaaauuuuuugcaugaauguuuuuaagauuuuguauguuuucuuccuuccuuccagccaauacaagaguugcggaaaguuguucuuaauaucuugcaagacucaaacagaaccacagaagguacuauuauuuuugaauuuaaauucaucuucucuagcuguaccaguaaaaaucauccaggacauauaggaaaaagaagaaaagaaucauccccugaaaugcuucucacuucuugguuuccaugaccuggcccuuucagccauugucaucagcugacuuauuuguauuauuacaaguaaaugcacuacucaauacugaacaaagguuguuuccaccaaaacagccuagacuggagugucccacuuccuuggaauccuagauggcagaagacaaacagcucuuugcuggaagagacugaggcagaaaggagaaaugccuuaaguuacauguuuaaucauaauaaacccaccaacauacucaucuaaauuuguguuacgcuuuaaaaauagcuaucucaggaaucucuucaauuggaugaccaucacugucaguggucauaaccuuuagaagacucuucuaugagacauauauugugccaaacacgagugacauuauaauugcuuacgauacuuguuauaugaauggaaagaaaaaacaagcuaucuuuagaaaauaaauuggauucuucuuguuaucuuaaaaggugacaaaucuuuuuccuuuaauaguagauuuaggcugcauacgguagcucacgccuguaaucccggcacuuugggaggccaaggcagguggaucaccugaggucaggaguuugagaccagccugaccaacguggugaaacccugucuugucuuuaaaaaaaaaaaaaaaaaaaaaaaaaaacagaaaagaaaaauuagccaguugugguggugcgugcuuguaaucccagauacucaggaggcugaggcaggagaaucguuugaacccagaaaguggaauuuggagugaaugaagaucacgccacugcacuccagccuggacaacaagagcgaaacuccaucucaaaaaaaaagaguagauuuaacuggggaacaaucaagucauguagcuaaguaacccacuacaugugguaagaaggacauaaaauagauaauaguagauucuuugagaaugaggcuacaauucaguuauuugguuaaaacaugguaguguuuuaaaaggaauaaaaagagaagacaggaauccaugccuuuguugcacccuauugaccucacuuagggugucagccucuagccacagugugccuggcacagucugauuuccuuccuuucauuuuggugauuguguuugggcuaccaugaaaacuauuaaugcaagacaguuuuugcccacuguccaaggcaguaaccauguggucauccuggggaggaaugggauugggagguugugugaguuaaccuuagugagucaagaaaauugauccaaggugugguguaaggguagaaggccagugauuagucccuaagagagcucucuugagagugaauaggagacuggagauauguucagagucuugaaagggugucaagaaucuacguacagcagucucgggggcuggcuacgaggguagccugauguagcaagacacugcuacagagcuuaacgugaaaaaacaaguuauaagucacacuucaaaucaaucacuauucaguauguggagcccaugaagaucacugggaaaucauuguauguauguauuuuucauguuauugacuucuaguugaaguauuaaauugguaaaucuuacuuuccuucaugaucuuacauacacagggauuacuucugacucuuuaguugcugaaacuaguauaacaucaguggaagagcuggccaagaagauggaaucugugaagucuugucuuucuccaaaagagagggaacaagucacggcgacaccccgaauagccaaggcagaacagcauaauuauccugguaucaaauuacagauugguccaaucccuagguaagcaaacucuaaagcagacuuuguguucacagacuuaauucuaguccaagucucgauuuuuccuucacagaucuagaguaacugagaccugaccugcagugaggaaggugcugccagagucaggagggguauuagaaugcauucacccccguccuauggucucgccuaccuuuucacucucauuuguccugcacuugcagauccuaucugccuuuccugcaaguccugacacagcuggguaugguuggggugauaagauggggcacaaagucccaagcgggagcaaacucuguagcugugggagaaaagggacagugaauaccccucuaagaacggagagcaguggaguauguacuagucagagacugcucauaaagucagaaacguuuuauuuuuuaacaaauauaaauuuaaggcagaauccauaguaauuuaaggagcuaugucagggcgucagugucauuuucuaaaaugugaguguagcaccacucuucucugaucaugaucuggaaagaauuccaaacaagggcaccaagacaacaguucuuuguuuuaguuaccuggaaagcacagccgaaucucuuccaauccuaaacucucugacacacaccauuuucccacuacagucagcucauaagaggaugaaaacaguucaguucauaaguggaugaacuacagucagcucauaaguagaugaaaacaguuaauccaaaaacuaccucuuaauggcucuagaauucacaaaaccacuaauuacauuagccuaaggaaaacuagcaggcaagucugccaagauugcaccauugcacuccagccugggcaacaagagugaaacuccaucucaaaaaaaaaaugaaaaggcugggcacaugguggcucaugccuguaauccugucacuuugguaggccgaggcaggaggauuacuugagccuaggaguucaagaguggccugggcagcauagggagaccccaacucuaugaaaaauaaaaaauuagccaggcaugcuggcauacguuugugcucccaccagcuugaaaggcugagguggacagaugccuugauccuaggagguugaggcuguagugagcugugauugcaccacuggacucuagccugggcaacagagugagacccugucuuuaaaaagaaaaagcuagaaagaaucuuggaauucauuaauucaaccaaauuugguauuaggccccauuuccuuaaaacuugucaucuguuuugaaaguuuauagaauaaaugaacaccaacugccaaauauuugacuucaaauaaaaaccacacuucauacuucauucaauaaauccuuaugcuuacaccauccaagaacagauggacaccacccaguacauucuggaaaucagggaaaagccuuuuuuuugagacuggggucuugccauguugcccagacuggaguacaauggcauaaucauagcucacugcagccuugaccuucugggcucaagcaguccucccacuucacccuccugaguagcugggauuacaggugugugccaccaugcccagcuaauuuuuauauuuuuugguaaagauaguguguugcuauguugcccaggcuggucucgaacuccuagaaaaagccaucugaagaugaaagcugcucuagacauaucucuuguaucacccuauguuaaaaugucuucccuguuuuauuauugaauaagaaacaaaaaauaauaaagauaauuuuuuuaaaugauaagguuuuuaaugcaucucuugcugucucucagaauaaaugggaugccggaagugcaagacaugaaauuuaucacuccuguacggcguucgucgaggauugagcgagcagugucccgcuacccagaaaugcugcaggaacacgauuuaguaguggcuucucuugaugaacuguuagaaguggaagaaacaaaauguuuuauauuccguagaaaugaggcgcugccuguaacauugggguuucaaaccccugaaucauaauuucuugaugcuuuuuuuaaaaaagguguuucagaaccaacauaagacaagaaauauucuuguccaagugaccuggaaaaaaagagaggcaucauggaugcagauuauggacgcucaggacuuaaguaauucacugggcuuacucucaaauuuucucuccccaugggaaaaucuuugcuuuauguguuuaagaccaguuugccaguuuuacaguauacauaaauuucaaacuuuugaauauuuacccuacaacuaugauaaauauuuauacuuuauugaucuacuuuaaucccaacauaguuuuuuauaucagaagguuggucccacaauauaaugggacuuuucuuucugcauccaccuuagcagagggcaaguucuuucaucguggaagaucugaacuuugacgcuagcuugacaggcugaauggaccuugacagauggccaagucaaaaccccucauuuuacagaugaguuuaugcuagcugugccuuugcucagagaucauaaauuuaugugugaucuuugacuuucaucacaguauccuuguaaaugagagagaauucuuguuuuuucuaugccaggucuccucagaugaaacacaauccugaauuggcauggucgucuagcuuuuauauucaaaccuaguuuugcauuuguuacucagaaacacuucaaguaacaaaaggggggcaggggagagggguggggaguggacacuugcuucuucaguucuuugcucagcuaggguauagcuggccugagaaggcagugcaagccccagagacuguuguagguugcuuuuucuuccuccugggcaacuauuuguggaaagguuuuaccuuagucauuauguaaauauaauuguguagaaaaaccuagucaacacauuuuaaauuuuagcuuucuuaauauuuaaguauuaucuuaaaacaacauuaaauuucuauuaguuccug

SEQ ID NO: 191238 - RNA, 52322 nt, Homo sapiens
ugacagcaaaagaaauuuuauucccauuuucuaggggacagaaacagagcccaguggugccuagcauguuucuggcaaggguagugaaaagaccacuuccuuuugggggaagucuuucaauuaagaaaaacacacgcaacuccuggggguggcuccaccuguacccaggacagggccugccacuccaggggcucccaggcuggauuuuccaccagagcagucuugggggcaggagccuguuagaaaugcagauccccagggaccugcagcggucugggcaguaccuccaacacagcugcuuaaggggaggcaguccggcccucaucugggagcgccgugcugacgcugacugcacgcuagggcucucgggguuggguggacaggguuucuccgagagaugggcucccagcagccagagcacacugugggugucaagcugcuggugggaagcaggcuguucccugagaccaugacagggugaaggugggaaucaccagcccccacacucaccaagaaaugcuuuugcuacaugcuggggcuuuuuucuuuuuuugagagggagucucacuccgucgcccaggcuggaguacaguggugagaucucggcucacugcaaccucugccuccccgguucaagcgauucucaugccucagccuccugaguagcuggcauuacaggcacacaccaccaugcccagcuaauuuuuguauuuuuaguagagaugggguuuugccauguuggccaggcuggucucgaacucuugaccucaagugauccacccaccuuggccucccaaagugcugggauaauaggcaugagccaccaugcccggccaugcuggggcuuuucuaagaacacaagcacaccggaggguaagacaagauucuggagaggcacagacccagaaagccaggggcacacaggagccucgccagcgagggcggcacaggccauccaugcggacccucaaaucucaugugaaggcugcaucaaggucagugccaagaggaagcagagcaaagcaugugaccaccucucugaagccaucuuuguggacaaaugauguaggaacucaaaaaaaugcaggcuuggcuaggcgaaguggcucaugccugcaauccaagcacuuugggaggaucgcuugagcccaggaguuugagaccagucuggacaacauagcaagaccuugucucuacaaaaaauaaaaaaauuagcugggcaugguggcacaugccuauaguuccugcuaccugggaggcugagguagaaggaucccuuaagcccaggaguucgaggcugcaaugaguuaugauugcaccacugcccucaagcuugggcaacagagaccaacccugucucaauuaaaaaaaaaaaaaaaaaagcaacuaaccccaaacccagaucucuaaaguauuggguguggacuagagcucuggacggccuaaaggaaaggaaugugccgguucacagggacccgcggcuaagcucaaggguaaaauacagcuuuacaaagcaucuuuaggcuguuccuucccaaacgugcuuagaagggaacagggaaaggcggguguguuuucucacugagguucuucuaguggcuggaaucugauagaguaccaaguuguagggauauggauauauuuucccuuuggcacuccauaaagcuaaauguugggcugaaaaaaggaugcagccuauaaacaaguauuuuuccugaaaccaacugcaugaggaaacgcugcgcucccccucagggagcaguuucugaagccagcugagcacagcuggcacuggccagagggagcccuccacccucccaccacguaugcccaccugcaaaccuggguucugaguccccaugcaggggacagaccugaaaauuccaguuuguguccuuucaggucaucgacaggaaugacagccuggcaagcugcagugacugcacacagcuacccugugagcuccacuugugugggugcaggugggcgacaggagugugugacacagacaggcacuccaccaggaggaaacccacagcagacgucaaccaucgcuuuauuaaggcugcgagucggggggcugagucaugcacuccacagacacccccacugcucccaagguccacuuuuggaugacccugaaggcagagacuccugagaucugggccacaaucuagggugagccacccacagugcccugcuggacagggggguaugcggacugcacgggggggcccucagcaggggucuuccugccuaggguggggcuggcuccaguggguccugggcucaggcaggggggguggcagggaggcagggacauccccccgcccucuggccuauggcuuuguugcccuauugccaccagcgcagaagcaaugugcuauaccgugaggugaugaagaagagccccgggagggagcaggcagcucugugccuggggccuggccagaccucaggggugcuguggcccugcuccuguucccccucagcuccucccagcaaugggucuccuccaguggaggucagucacucagaaguggacccgcagcacgucuuggcuagcaaccggccgcuggcaggcugugcacgucaugggcagggagcguugcuucucacccaggcagggucggcacaggagguggccgcagggcagcugguacaccggcuccuuuuugaaguagggagaaaauacucuuuugcaggaggcacauucggggcccaggaugcucccaggcugcucugguaaaucaggaaggaaaacaggccaggguuaggaaagcugcuccaugguccaggcugcucugaggggcagagccuucccaccgugcugcugcagcaucuggcuucaucccucccgaguccaucccagucugaucagguaggggaguggaagcgggagagggagccugggaacccgggaggccucuucucuaucaucuuugaccaaaucucagugccucuacgaaugcuugagaagagcuggcuucugagggcagcaggcaggacugggcccuuccuccuggucucccagcaagguuuacuuuccccugcgauagguggccaaggcuggagcaaggcacagcucacucugacaagauaaacugcaagaaaugugagaggcgacaagagaaggaaaaggcaggucagugggguggcucaagccuguaaucccagcauuuugggagguugagacaggaggaucacuugaagccaggaguucgagaccagccugggcaacauagugagauacugucucuacaaaaaagaaaaaaaaaaaaaaaggaaaagcagcacaugguccagugcaccaagguuggggaagugugagaagggaggucagcagagacaaggcugaggccugcagugcaccugccacuggggccuagcuccugcucccuucagcccugcagccugcagcccccucacugcuacuggcagcccugcuccugacuccucagucccccuccugugcugcccuggcccucucggcaggcucucccuucuuccgcaacuccuucagggcauccuugaaugagggucacagugagcagcucuggccaugccccaccaggcugcacccacggcucuuccuuuccucauggccccucuggagagugacaggggaugggcuugccuguccuccuugugguccaugucuccauuccuagccacuacucucuggaggaccccaaaggaaccucaaaccaauuugcuucagaauuguuucuuaaccccccuucucucuguccauuucaucaccauaauccaggccgcucgacacaucucuuccuaacuauucaccugcuccaggcuugucuucucaaucuguccucaaagcugccuccaaugacccaccuauguaacuugaccaccccauaacucugcuuucuaccucuuaggagcuucccaacuuucgggacagucaagacucccugcacggcccacccagccuccucaccucucuucacaccagucucaacuuuuagaguccagcagcuuccaaucacuucuuugcacacucugcgcugcuggccuccucacuuugugcuugcuguucccucugccuagaaugcccuuaucuggagaccuggcuuagaccacacccauuccaugacgccaccccggauugccccuuuccugugcuuucagagcccaccagcccuucucagccuccaagguaggaugccuacuuccuccccaggcuuugcagguccugagggucaggacuauguccauguuucucauccggccucaggaccuggcgcagcaccucacagggcaagugcuccauccacaugugaugaauggaccugccaucuacacucgggcaccaggcaccaaagaagggagggcaggggugcccuacacggggagcaggaacugaaguguuccugccuccgcaucccugagaacuguagccaggaaagaguggccuggcugcggguguuuucuuugggccaaacauuaagcaacauaaaaguaccgggugccucuccugugcacacaagccaaaaauuccccagugaguggaaaguugaaccucuacagggaagggaaggagggaggaaugaagguggggagggaggggggaaagaagggaggggaggaagcaggaggaaagagccacugacugcuuuucaguggugccccuuucaugcaggcucugccagaggcuucagagaucugccugacccacagugcaugaugagaauuuauuuuccaucaguuuuaaaaagcacaccuggcacaacaccacagaagcaugcaagggccccaauugcccccagcacugaccagaagucccauuaaaagaucucagaggcccagagccccaggggcaguuucagugacagaaaaaaaaaaaaaaaaaucaucaaggaaaagacaauuauugugcccugggcaggauggaaacccaaguauauaacugcaaacugaggugacagagaggauaaaaaagagggcuugcuuugaaaagggugggcuaacauggccuccuguaggaagagcugugagaauaaaaaggggccagccacacagaaugaaaggagagcaagcacaaagaacagccuauccguuaaagaaaaagacacaguggucgggcacgguggcucacaccuguaaucccaguguaaucccagcacucugggaggccgagguggguggaucaccugaggucaggaguucgagaccagccugaccaacauagcgaaaccccguuucuaacuaaaaauacaaaaauuagccgggcgugguggcgggcgccuguagccccagcuacucagaaggcugagacaggaggauugcuugaaccagggagaaagagguugcagugagccaggauugugccacugcacuccagccugggcgacagagcgagacuccaucucaaaaagaaaagaaaaagacacagugaagcugggugcagaggcucacaccuguaaucccagcacuuugggaagcugaggcagguagaucaccugaggucaggaguucgagaccagccuggccaacauggcgaaacgcugucucuacuaaauauacaaaaaaaaaaaaaaaaaauuagcugggcuugguggcguuugccuguaaucccagcuacuagugggggcugagacaggaagauugcuugaacccaggaaguggagguugcagugagccgagauugcgccauuguacucuagcccgggcaacagagcgaaacagagcaagacucugucucaaaaaaaaaaaaaaaaaaaagacacagugagagugggcuucagauaagacugcagaggaggagacaugggggcuccagcaggcaggaccucagagggaguaggaguugagguuuuauccuaaguucaggggaugccaugguaggauuugaagaaguggagcauggugaugggcugacaugauaaaaagauccaacugcuaugaguaugaugagccacaguaaggcgaggauggggggauaccagcaggggcuacugcaggagucugggagugaggcagugggagcugcagccaggggaggggccacagaaggagagcaggggacuaaccugaggucaccuugggggaggauggacaggaccugauaaugaacagaaugucaggauggggacacugaaggaacucgagaaugacuucuguguuagaagccucaccacaagacagaagaugcugcccuuacccagguaggaugaugggggcagugagggggaaaagcucuggagggcagaugugagcaguacagagucugaauguuuccuuuagagaggaugcugagccuggccaugauggcucaugccuguauucccagcacuuugggaggccgaggcagauggaucaccugaggucaggaguucaaaaccagccuggccaacauggugaaaccccaucucuacuaaaaauacaaaaauuagcugggcgugguggcgggugccuguaaucccagcuacuugggaggcugaggcaggagaaucacuugaaccuaggaggcggaaguugcagugagcugaaaucgcgccaucgcacuccagcuagggcaacaggggcaagacuccaucuuaaaaaaagaaaaaagagagaggauguugagugcugucagggcggcaggaugaguuccaaggagaagcaggagcuacaggggaacauggacaguugccggagaugugaguuuucacuuggguaacagagaauauugagauuagagaguccagggccagagcugguagagaaggcaauuggcaauggaaacugaagagggaccaccgaagauaggagaaaagaagcaaaacagccuaaaagccaagagagaaggcguuucgcacagcaggagcuccaucucguaaaaaaugccucccguugcaaucaguuucuguugcuuuguauccuaauagauucuggcauacaaugggggucaagguucauuuuaggcaaaauuggcccauaagcugccacugcucuuucuaagacacugacggaaguguuaaucugaagggaugaggacgacaaacccaaccaaaccucucuucacauuuacauaaagugccccggaugucagacugcagacuggcuagaugagaaaaaaauaacaaaaaaggccaggcgcgguggcucacuccuguaaucucagcgcuuugcgaggccgaggcgggcggaucacgaggucgggaguucgagaccagccuggcaacauggugaaaccccgucucuacuaaaaauacaaaaaauuagccgggcaugguggcgggcgccuguaaucccagcuacucaggaggcugaggcaggagaauagcuugaauccaggaggcggagguugcagugagcugagacugugccacugcacuccagccugggcaacagggcgagaugcagucucaaauaaauaaauaaauaacaaacaaaaaaaagagaaacaaaaauccucaggagaaaauaauuaacauuagaucucacaaggaaacacaucagaggguggccaagcccuacauccacagaauuacuaaggauugacuaaagaaagccuuucuuguggggaguuuaaguucauaggcagccccucaacuaccccuggaaaaggcaagagaacagguucucucccaggguggguguuggaacugacggggaggcuggccaggcagguccacagagcccccagggacucggcccagcauccagagacagaaaacagaccacccauuccaaggcuccaaggagauggcggggcccauguuacccgagccggugccaggccuccaggaaguguugcucccucuugugccaaggugcuggagcuguccccuggucagccgugccgugaaggagggcauagagccaaggguggaugccaaggcaauuuccaagcuuugugacagcuucugcucgugggacaguggaccugucgagagaugcgcacagcacaacauccagagacaggcuccgcaaaagagaacagccucaaguccuucgagggcuguaaaaacggcaccuccaaucucacacaucaauguaaugaaacuccauccuaaugucuacuggcggaccaugacagaacaccgggagguaaagcccuaggaacaccggcaguuccugcccaucccaccggcuucaggcuuuucuccuccuggagaaacugcugggcagacaugagccaccucguggcucaacugcagaacugcacgcuccuuuuuuuuuuuuuuuuuuuuuuugagauggagccuuggucugucgcccaggcugagaaggagugcaggggugccaucucagcucacugcaaccuucgccuccuggauucaagcgauucuccugucucagccucccaaguagcugggacuacaggugugcgccaccacgccuggcuaauuuuuuguauuuuaguagagacgggguuucaccauguuggcuaggagaucuccugaccucgugauccaccugccucagccucccaaagugccgggauuacaggcgugagccacagcgccuggccuccuuucuaaaggccuccuugcuggccaagaaaauaacuggggcaagcaaacgccagcuuuggacugcugcucccugccccccauucccuccccagcggccuuagucuucucuuucccuaacuccacccuucuggggaccccaccaccccccagagggguucaucugcauuuucuagguguucauguccucucucuccuguuaaguaaaacaaagcaguuuuuaccgaauagaacuaagaccccacguugaccacgccacaauuuaggggaccuuuaguguaggaucaacagaaagccaagccauggaaugagggugaaggccaaagggguagggggacagcugcccaagaaagaccccagggaccuguguggcagaaaaauuugcaaugcugucucaaagaggagaauggaaacuuuuguccacuguuugcaggacacaggacaucagcucagggccuugaaggagcccuagucagcgugguccugagucaccaagucugucaaggccaacaggacugagaccuccacaaacugacgcugaagucuaaggaccuuuuuccuuguuccaccccacugcgccucagauguuuccaggaguuucugaaggucauguuaacuagaauuuacucuuaaaaccaaagacacagaaauaaacguuaagcauaguauuugcauagucuuuuagaagaacauaggaaacuaaaagaaugaucaaccuaaacagaauaauuuccauaaggaaaaagaaaagguugccaggccaggcacaguggcucacaccuguaaucccagcacuuugggaggcugagacaggcagaucgccugaagucaggaguucaagaccagccuggucaacauggcgaaauccugucucuacugaaaauacaaaaauuagccaggcguaguagugcgugccuguaaucccagcuacucgggaagcugaggcaggagauucgcuugaacucaggaggcagagguugcagugagccauaaucacacuacugcacuccagccugggugacagagcgagacuccaucucaaaaaaaaaaaggaaacgugucaaagagcuacccuccacaagcaccaagcacugacaaucacaaggacuucuacuagacaggcagaguggguauuccaauacuauucaauuguuccacagcacagaaaagaaaaaauucuaaauucuuucuauggaacaaaaaaaucaucaaugacaccugaccaaagauggcacacacacacacacacacacacacacacacacacacacacuacaguccaaccccacuaaugaauacaaaaauccuaacacuagcaaacagaaccauuaaaaucuauuaacaggggccaggcgcuguagcucaugccuguaaucccagaguuuugggaggccaaggcggguggauugccugagcucaggaguuugugaccagccugggcaacauggugaaacaccgucucuaauaaaauacgaaaaauuagccggguguggcggcaugugccuguagucccagcuacucaggaggcagaagcaggagaauugcuagaauccaggaggcagagguugcagugagccaagaucgcacaagugcacuccagcccgggcgacagagcgagacuccgucacuauauagauaaauaaauaaauaacagggcugggcgugguggcucacacuuguaaucccagcacuuugggaggcugaggcaggcagaucaccugaggucaggaguucaagaccagccuggccaacauggcgaaaccccaucucuacuacaaauacaaaaauuagccaggcaugguggcgagcgccuguaaucucagcuaaucaggaggcugaggcaggaaaaucacuugaauccgggaggcggagguugcagugagcagagauugcgacacugcacuccagccagggcgacagaaugagacucugucucaaaaaauaaaaauaaaaauaaaaaaaauuagccaguauggugcugugcgccuguagucuuggcuaccgaggcaggagaaucacuuaaaucccagcagcagaggucgcagugagcagagauugcgucacugcugcacuccagccugggcgacagagggagacuguuuccaaaaaaacaaaacaaaaagaaaccauuaacaggccgggcacuaucgcucaugccuguaaucccagcacuuugggaggcugaggcagguagauaaccugaggucaggaguucaagaucagcuuggccaacaugacaaaacccagucuauacuaaaaauacaaaaauuagcugggcacgguugugggcaccuguaaucccaacuacucuggaggcugaggcaggagaauugcuuagaccaggaggcagagguugcagugagccaagauugugcuauugcacuccagccugggugacagagugagacucugccucauaaaaauacaaaaaucagccagguguaguggcucacaccuguaaucccagcacuuugggaggccgagguggguggaucaugaggucaggagaucaagaccauccuggcuaacacagugaaaccccgucucuacuaaaaguauuaaaaaaauuagccaggugugcuggcgggcgccuguagucccagcuacucaggaggcugaggcaggagaauggcgugaaccagggaggcggagcuggcagugagccaagaucgcgccacugcacuccagccugggcgacagagcgagacuccgucucaaaaaaaaagaaaaaaaaucagccaggcguguuggcacgcaccuauagucccagcuauuccagaggcugaggcaugagaauugcuugaacccgggaggcagagauugaagugagccgagaucacaccacugcacucuacccugagugacacagugagacuccaucucaaaaaaaaaggaaggaaggaaggaauuauuuagguugaauuacacagaaguuugucacugaucuguguucucgaacuaagaaauaugaagauggaggcuaagaaaucauuucucuuaauauuauaaauaagcaauuaacaaauaccuugggaaaaauaagaauacaauagaagugaggagugugacuuucaagauuacauucuaaaagauggauuucccucgucugugcacucucucuggaacgcacagcucccacacaguacacugcccuauggagaggcccacaaggcaaggaaccgagggcagccuugggccaacagccaaccagcaagugaggccucaguccaacaaugcaucaacgagcugaaucuugcaacaaugaugugggugagacuagaaguaaaugcuuccccaguugauccuugagaugaccacagccucagccaccaguuugauggcagacuuggaagacccugaagcagagaauccagccaaguuacgcugggauuugugauccacagaaguuaugagacaaugaauguuuguugcuguaagccaguaaguuuugggguaauuuguuaccuagcaauagauaaccaauacuucuuuaacaugauaaaaacaucuaucucaggccaggcgcgguggcuuauaccuguaauccuagcacucugggaggcugaggugggcgaaucaccugaggucaggaguucgagaccaaccuggccaacauggugaaaaccugucuuuacuaaaaauacaaaaaauuagccgguguggugguacaugccuguaaucccagcuacuugggaggcugaggcaggagaauugcuugaagcugcgaggcggaggcugcagugagacgagauugcgccauugcacuccagccuggguaacagagugaggcuccaucucaacaacaacaaaaaaacaucuaucucagccuaagauccaacauccagcuugcccugagguauucacacugaacacauucagcugcagaggucacccagugaaccagggcugcucaccucaggagagagcagcaucaccggcccuagaaaucacuggcaaugccccagggaagaggcaggaagccaggauccuuaaaucucauacucaagaauguugcaggccaggcacaguggcuugcagaucccagcacuuuaggaagccgaggcagguggaucacgagguuaacagguugagaccaucccgggcaccauggugaaaccccuucucuacuaaaaauacaaaaauuagcugggcgugguggcgcgcgucuguaaucccagcuacuccagaggcugaggcaggagaaucacuugaaccugggaggcggagguugcagugagccaauaucacgccacugcacuccagccuggugacagagcgagacuccaucucaaaaaaaaaaaaaaaaacagaagucgagugcaguggcuuacaucuguaaucccggcacuuugggaggccaagguggguggaucacaaggucaggagauugagaccauccuagcuaacaaggugaaaccccgucuuuacuaaaaauacaaaaacuuagccaggcgugguggcgggcgccuaaucccagcuacucgggaggcugaggcaggagaauggugugaacccggaaggcagagcuugcagugagccgagaucaugccaccgcacuccagccugggcgacacagcgagacuccaucucaaaaaaaaaaaaaaaagauuguugcaauuuuaccugguggauccugccaaaugcaauaaagaagaaaaacagaaaaaaacacaaagagaauauugcaauuuguccacacauuuacugagugcacccucuucaguguggcuuuucucuucaguaacccucuccugaaaggaaggcccacagaccuaguccuuuuuccuuuucuguguccucaugccacauggugaggggggcgcacagagaaccuccaugcaauauauccuuguaccucugugacgguuagaaauaacacccagaggagcccacugucacaugaguaacacaaagaaggcaccagaagagauucucugcuuugagggacugguaucuuuccucccagcagcucugaccagaggcuucaagcccaggaaaaaguguugaccaggccagggcacauaaagggaccccaaggaaggcaacagugcccaugggaccaucaccaacagaggagcgaaacacgcagacugaagccucggaacagaugagaauagacgagaacacauggaaccccuccaaggcuccagguugucccuggucugaagacaaagcugaggggccccaggaugggaaacgggaaggaggcagcacaggcacagccucgggaauguaagcuggccaagcacaaagcaaagggcagcagagcugagagcuccugggaaggagauggaugagccuggcugcggacacaggaugcugaauuaccugucgagcaguccauaugugucaggcugggcucauugguggcuuucauuuucuuagcagugugcucugagguaguggguaagaccaaagggcuuguggcagaaaaacaggaagcauuuacaccaaaguuacugucugggacauguucagccugcucuaucuuccuuuucugagagggcagaacaauggaagaagggaucacugccaaugccgucugugcucucccaagcagguggcagccagggauggagugcuggagcaggaaauggucaauccgggccuugagggaggggugaggcaggggcugagagugcggaguaaaagcuacccccgugaaagggucacugggcacucggccccauguggcuucacugcgguuacacuucuccagugugcucuggucgaugaccuugccugagggcagcagcaugggacaaggcaugaucuccagggugaugggauccaggaacuccucaggcacauccugaaugaucucggccagcuucugcaggcuggagggagccugcuggcucucaggcugguccccagggucacagucacuuuccaugggcaaggcuggagccugcagagccacauccugaggcagguucucugaggugaccagcaggaugcugucuaucacuuccugggagcaggucuuggccggcugaccccacacuuccaaccgcuugauacaagggauaccgccgccugucacaugggugauacagauccuuaagugggccacguggcuaagggaaagagccccuuuauuccagagcuccugggccacaacagcaggggaggggaguguggcuuccaucgcgccaaaagggggccuggccuugaagccccuguggcuaaacaccacuuggcucugguuuuucaguaagacuuugccuaccaaggugaacgccuccuugucugggacagauggcucagcugggcccaggguccggcacuggggcguauuccaagacacucugcuagaugaggcagauguguacauuuccaggccagugacguucugaccucccccagcugugaggucuauguugauccuacagauuuccacauuaaagggaaaugaaacugucacauagacugguggcuuaaugaaauacucuguccugaaaccaugacuucucuuugugagaucuucagagaugagauuuucuacuucguaaccaucagcugauaucuagauuuaauaaaaaacacaagauacaaugauccaaaugaagacaacuugucacuuguaagaaaacucuuaagccugagguuccucguuuuaaaauuuccucuauuaaacugaauugucccagaucagggcacccaagaucagaucaaaggccaagggcaauugucccagaucggggcccccaaguauugcccaaccuuaaaaauaugagcaacugagcugggcauguugguacacaccuguagucccagcuacucaggaggcugaggcaggaggaucccauuagcccaggaguuagauaggccugggcaacauagcaagaccccauaucccuuuucccugccaaaaaaaaaagcaagcaacaaaauccugcccaauccaaccaaaacucccuucaaaacaguaucuggggagagaagugcaggggagagaaaguauuucuaccuuugcuaugacuuugacgagacuggagauugaucaucaaagaacaaagagcacagugaagaggacccugcacaaaaugagucacagcucaccucaccauggcgcugugugauucuagaggugagccugccccaugcuuaccuaaauaccaucugauggaaucuaaaguaacaagagcaaaagugcaguaagccugaaucaaauccacacacacaaggcaggaaaugaugaaacacaugacaaacauagcauauauuuauguguauauauuuguuuuguuuaccuuguugcagugaauucuuggucugaacugugggaggcaaagauuuauuaccaucuuuguggcugagaggauaucuuccaagcaucagaagcagccuuaaauaagaaauaaaacuauguauuagaaaauguaaaauucaauucuaaacuuucagaaguugauucuuaagagaaucaaacaggauggcaacaaaaacuugaacacacacacucucacgguccacacugacuuuccuuauauccuauacaugauguuggggaaaaauuagucacugaaaaauuauagagaagacuucuauggcaggcucaacagguuggcaaagacugccaguucucuggccaacagcuguuccaaagacccaauggaggcaaggcccaucagcugugcuggggguugccacaggaagggaguggcaaaaguaucugagcucagagaaaggacagaguguucggaauggaaagggucauaaaaaauaauuauaguggugguaagcauccuugucauuuaauacuugucaaugcaauuauguuuucuuauuaaaaugaaaacaaugagucaaaaacaucauuauugagacauagaaaauuuauuagaggccaggugugguggcucaugccuguaaucccaacaauuugggaggcugaggugguaggacugcuugagcccagaaguucaagaccagccugggaaacauagcuggucuuguuguagagaccccaucucuacaacaaaacguuguagggaucuugcuaugucugauaugcaccuguagucacaacuauuugggaggcugagguggaucacuugagcucaggaguucaaggcugcagugagcuaugaucacaccacugcauuccagccuaggugacagagugagacccugucucaaaggaaaaaagaaaagccucuccccucuccccucuccccuuucuucggucucccucuguugccgaggcuggacuguacugccgugaucucagcucgcugcaaccucccugccucgggcucccgugauucuccugccucggccugccgagugccugccuugagugaucugcccgccuuggccucccgaggugcugggauugcagacggagucucguucacucaaugcucaauguugcccaggcuggagugcaguggcgugaucucggcucgcuacaaccuccaccucccagccgccugccuugaccucccaaagugcuaagauuacagccucugcccggccgccaccccaucuaggaagugaggagccucucugccuggccacccauugucugggaugugaggagagccucugcccagcugccccaucugggaugugaggagcaccucugcccggccgcccugucugggaggugaggagugccucugcccggccgccacccugucugggaugugaggagcgucucugcccggccgcccugucugggaggugaggagcgccucugcccagccgccaccccgucugggaugugaggagcgucucugccuggcugccccaucuaggaagugaggagcgccucugccuggcugccccuucugagaagugaggagcgccucugcccagccgccccgucugggaggugaggagugccucugccuggccacccaucaucugggaagcgaggagcgcugcugcccggccaccccgucugggaacugaggagcgccucugcccggccgccccgucugagaagugaggagcaccucugccuggcagccaccccaucugguaagugaggagcaucucugccuggccgccccaucugggaaguggggagugccucugcccggccgccccgucuggaggugaggagcgccucugccuggcagccaccccaucugggaagugaggagcgccacugcccggcugcaccaucugagaagugaggagugccucugccuggcagccaccccaucugggaagugaggagugccucugcccggcugccccgucugggaggugaggagcgccucugcccagccgcccaucaucugggaagugaggagcgccucugcccggcugccccgucugggaggugaggagcgccucugcccagcugccccgucugggaggugaggagcgccucugcccggccgcccaucaucugggaagugaggagcgccucugcccggccgccccgucugagaagugaggaguaccucugcccggccgcccaucaucugagaagugaggagugccucugcccggccacccaucgucugggaggugaggagcaccucugcccggccgcccaucgucugggaggugaggagcgccucugcccggccgcccaucgucugggaggugaggagugccucugcccggccaccccgucugagaagugaggagcgccucugcccggcagccgccccgucugggaagugaggagugccucugccuggccgcccaucaucugggaggugaggagcgccucugcccggccaccccgucugggaggugaggagcgccucugcccagccgccaccccgucugggaagugaggagcgccucugcccggcugccccguuugggaugugaggagcgccucugccuggccgccaccccgucugggaagugaggagcgccucugcccagccgccccgucugggaagugaggagugccucugccuggccgcugugcaaucuuccaagugugaagugacagccuuucugcagguguacccaauagcuccgaagagacagcgaacaucaagaacgggccaugaugacaauggcgguuuugucgaaaagaaaagggaaauguggggaaaagaaagagagaucagauuguuacugugucuguguagaaaguagacauaggagacuccauuuuguucuguacuaagaaaaauucuucugccuugggaugcuguuaaucuauaaccuuacccccaaccccgugcucucugaaucaugugcugugucaacucaggguuaaauggauuaagggcggugcaagaugugcuuugucaaacagaugcuugaaggcagcaugcucguuaagagucaucaccacucccuaaucucaaguacccagggacacaaacacugcggaaggccgcagggaccucugccuaggaaaaccaaagaccuuuguucacguguuuaucugcugaccuucucuccacuauuauccuaugacccugccacaucccccucuccgagaaacacccaagaaugaucaauaaauacuaaaaaaaaaaaaagaaaagaaaaagaaaaaaaaaagaaaggaaggacagaaggaaguaaguugggcagggacagaaagaaagaaaaagacagagaaagagagggagggagggagugaaggaggaagggagggagggagagaagacagagaaggagggaagagagagagggagggagggaagaaaggaaggaaaagaaagaaagaaaauauuaggguuggaaagcaccuuaaaaugacaucuaggccuggcacgguggcucauaccuguaaucccagcacuuugggagacagaggcaggcagaucaccugaggucaggaguucaagagcagccuggccaacauggugaaacuccaucucuacuaaaaauacaaaaagcaguugggcaugguggcaggcaccuguaaucccagcuacucgggaggccaaggcaggagaaucacuugaacccgggagguggaguuugcagugagccgagauugcgcuacugcacuccagccugggcgacaagagcaaaacuccgucucaaaaaaaaaaaaaaaaaaaaaaaaaaggacaucuaaugcaaguagucauuuuaauggccaauuccaauggcuucugguaacucuguggagaaggagggaagccacugaaaacaccccucgcaguggcagaccucuccaguggaacucaacuccuuggugaggccagccagccauuuaugcuuuucucccugacagucguggccauguaaaauuguuagcccgacagggauagggucacccucugggccccuuuugcugucaaaaucaguaggagccacuugcaggagccaggcauacuaagcguccugcaacaucugaguggauaguugcugcacagugaagaucugucaugggccuuguaaaugucuauuaucucagcuuagccccuaacucaguuuuacauauuaacacaaaguauuuuuaaacaugguuuucauauaugcuaaauuuucuaggaggggaacuuccauguaagccagaggaaggucauauauuguuuuguucagaccuuuaccaagagaugcccaccauuucugaaaaucacaucaccgagagcaaagcucuccaccucggucagucugcauuuguagcagucugcauuccacaugcgcuccugcgugaugguaaaagcuucugaauacuucuuuaugccuucuaguauggucacacccaaacauuuauacacgagaauaaauuuuauuaucauaccuaaaauuuuuuccuuuaaaguacuguuagggcauucuguguguugguggggggaggguguguauguguguguggaccuacacacauuagcguguguacauaaguagguuauacuauuuggcuuuaaguucaucaugauagaagaaacaugaaucucaugggguagaaagccccuggccuaaagccuccuguucuuugugagccuguguugaaacuccuagugcuucccacuuugaggcacauacaccuuugcuuugccagagaauuuuagaaucuggccuggcauccacauggacuaaaguuucuacaauuccuuuucugaaagauuauauuaacaaugucuccaggcuucugauaccuuucguguucuccacgauaaguaaaaacaaaugaaguaucugaugcauugugucuacaaauauccucagaagcccuauaguuaccucuuuuuggccaggacaccagaacucauuuagagcagcauuucccccagcuucccugcccaacuagcauaguagcuuccugucgguuuguuuuaaauguaaaauuaagccauucacuuuaauugaauauagaaccauuaaaauaaauauauagccaagccaaugaaauaaaacauuccuccuuggaaaagcaagccuaggaugccaaaggaaagcagacaauaugcuacugacauagaugaugacacuagagacagacauaugcagaacggugcuggccccaggcagauggcugagguuggggcccugggacuugagaggguuuucuuuucacugcuccaggcaguucccucuuccccucuuggcccugacagaaagccaagaaaaaacaaagccgggcggaguggcucacaccuauaauccgaacacuuuaggagguuaaggugagaggaucacuugagcccaggaguucgagaucagcccgggcaacacagcaagaccccgucucuacaaaaaaauaaaaagauuaguuaggugugguagcacacaccucuagucccagcuacuugggaggcggaggcaagaggaucacuugaagccaggagugcaagguuacagugagcuaugacugugcuauuguacuccagccugagugacagugagacccugucucaaaaaauaaaguaaaauaaaauaagaguucuucuagacuuaaaugugguuauuaugcucuaugauauagaaauguggaaaccuugacugcccuuuccaauauguguuagaucagaccugaaauuaaggaaaaucuugguauacccuuagcuacuucuucccaccucuguguggaagcgagucagccuucuguucaagcaucucagcucaugaggcuucuccacccgcgucaggggcugucaacuaccccagucaacuacaaaagcauauggaccuaacccugaccagacacagacuaccugcucuccacagcacucaucaaaauauaaguugagggaacauuuacagaagaguguucaguccagccccguuacaugcuccuuggugcugguccaaguagcuucucuugccucuugucuggcacuccucguggcugcugcagaucuuaucccacaccacuaucugacagauuucuuagcaguuuugauccucaccaguugcaaaaauaaauguaacacauugauaaaaauucaguggccgacuugugacgauucauaggacaccagaguagcaggacauaucaggugauaaccauaauuuuaaucucuaaaauauaccacuccauugagcugacccucagaccagugcaccggccuauccucauguucaucccagccacaaccaucaccacccucaccacccccugcaaauacucuucaccaagcuacucauuggcacugugugacaaggaacuucaauaagaaacagcucuuuaaagucaguuacuguuuuguuuaguggacaaaaugaucauugucuguucuauaugguauccucucuuggagacccauaagaaaauuuucucuuuggucucaguacuagaagaguuguuuaucgcaagcaauucaauauuuuaugguaugaauauggaucacauuccuucuugacucuggcuguuagaaagcuccgaauaaaaucuguggcccaucccucaaauuucucccuaccugaauuauuuauuuuuauauaauagagcauaauauguaagguagcuuaaaauaauuuuggaacaaagugggguauaaauaugcugggcauaggggcucacgccugugaucccaguacucugggagaccaaggcaggaggauugcuugaggccagaaauuugagaccagccugggcaacaaagugagaugccaucucuacaaaaaauuuuaaaaauauuagcugggcaugguggcauguguccguagucccagcuacucaggaguauggcuugaccccaggaguuugaggcuacagugagcuaugaucacaccacuguacuccauccagacugggugacagagugagacccugucuccaaaaauaaauaaauaaauaaauaaauaaauaaauaaauaaauaaacaaacaaagaggguggggggcauaaauaauucuccuuuugggagacauuuagguuguuuaugccuuuuuuuuuuuuuuuuuuaaagacagggucucacuauguugcccaggcuggaguguaguggcuauucacaggugccauuacagugcaccacagccucaaauucgugagcucaagcaauccuccugccugagugccccaaguccuggaacuacagguaugggucaccaaacccaacuuguuugcaacuuuuuacuacuaccuuaagaucaaaaucuuaaguagauuuuugucauuauuuuuuccuuuaguacaauuuucacuuuuuuacucaagggguccuacauguuucuaguuaagguugcuauuuaugaaagguucuucuuaacccauuaauuuuucuaacuggucauuccuauauaggaaagcuuuucacuuugguaucuuuacuauauguucagcugucuuauugaacucuuauugauuuuaacacauuuucaguuguuuuugcuuuuuuuuuuuuuacaauccuauuaucucaauaaugagaauuccuuucucaaaaugguaacucuuauuucugucucucauuuacugcauuagccagaacuuccggaauuacacaaaacaguaagacaguugccauccucguuugugcccauuagaaaaugccucuuugggccaggcgcaguggcucacaccuguaaucccagcacuuugggaggccgaggcgggcagaucauaaggucaggaguucaagaccagccugggcaauauggugaaacccuaucucuaugaaaauacaaaaauuauccaggcaugguggcgugagccuguagccccaguuacucgggaggcugaagcagaagaaucgcuugaaccuaggaagcagagguugcagugagccgagaucaugccacugcauuccagccugggcaacagagugagacuccaucucaaaaaaaaaaaaagaaaaugccucuuugaacauaauguugauuguuagauugaaauaucaucuuuauguuaauaaagcauucuaauuuucauauuuuuugaagucaggaauaugcucugaauucugauuuuucucuauauauugucuuuuauuauuuaucuuaucugacagacuaaugggauacauuaacacuuuuuucuaauuuuaaaccauccuuuuuauucccaggagagauucuauuugguuguagcauauuguucuuuaaauguacuguacuacugaauuuauuuugcucauauuuaauuuuagaugggauauuauugcacauucauggaacauuugcaagcccugugcuaggcacuggaguauagagauaaaaaugaaauggcagugaaacuauucuguauuacacuguaaugguagauacaugacauuauacauuucaaaaccuauauauucaaaaccuguaauucaaaaccuauagaauuauacaacacaggcugggcgugguggcucacgccuauaaucccagcacuuugggaggcaaaggcgggcaaagcacuugaggucaggaguucgagaucagccuggucaacaugaugaaaccccaucucuauuaaagauaaaaaauuagccgggcaagguggcgggcaccuguaaucccagcuacuggggaggcugaggcaggagaaucgcuugaaccugggaagcagagguugcacugagccgagaucgagccacugcacuccagccugggcaauagagugagacacugucucaaaaaaaaaaaaaaaaaaaaaacugggcguggugguucacaucuguaaucccagcacuuugggaggccaaggcgugaggaucaguugaggccaggaguucgagaccagccuugccaacauggugaaaacccgaugcuacuaaaaauacaaaaauuagcugggcaugguugcgcaugccuguaaucccagcuacucugaaggcugaggcaggagaaucacuugagcccaggaggcagaggcugcaguaagccgagaucacgccacugcacuccagccuggacaacagagugagacccugucucaaaacaaaacagaacaaaaacaaaacacaaagaauuauacagcacaaagaaugaaccuuaaauuauaaacuuaauaauaauuaaucaauauuggcucauuaguuauaagaaauguaccgcacuaagauguuaauagcauuaauaauacucaauuuuuagguaaaucuaaacugcucuaaauuauaagguguauuaauaauaauaauaacaaagaaauggcugggugaaacgaggcgugauuggucaugccuguaaucccagcacuuuggguggcugaggcgggcagaucacuugaggucaggaguucgagaccagucuggcuaacauggcgaaaucccgucucuacuaaaaauacaaaaaauuacccgggugugguggcaggugccuguaaucccagcuacuugggagagugaagcaggagaacugcuggaacccuggagacggagguugcagugagccaagauagcgccacugcacuccagucugggugacagagugggacugucucaaaaaaaaaaaaaaaagaaauggcugggugggguuguguacaccuauaaauuccagcacuuugggaggccaaggcagggggauugcuugaggucagaaguucaaggcuagccugggcaacauagcgagacccagucucuacaaaaaaaaaaauuaaauaauuaauaauaauaaagaaugauugggggaaaaagugauugaaaacaacucaggacugaagaucaaauugaaauaugcaaauugaaacgaaugaguguguugucacaggagaauggcagaucuuuuuuaaaaauaucuuacaaaugauauguuucugugggaaacagugauguccaaacaguaggauuccguaagaaccugguugcuaucaaagucuuuaauagguauaaucucaucaucuaucuuguuccaauacccuggacuuuuaaggucagaugccuucugccuuaacagaaaaaaaauaauggcucaacauaugaaaaugcaaacagccuagcccagaaagacggccucccuaguccugcugaggaaauggccauguaacuugaacucacugcaaacacuguccaguacuuacaaagcauagccacuuucuccagauguggcaucuaaguacaagaaagacaaggcuugaguauaacuuaaucuaaaaccucagauuguggcuaaugugcccugcuuucagagaaguagcuuggagacagauaauaauggcauuguaagauggcaauacaguuuauaagaaaaaaaaaagaauauaaaauaguagacacucuuguaccuaccaccuagauuuagcaaauguuaacauuuugcuauguuugcuucugauuucaguguuaaaagcaauauuuaaaagauaaaaacaaaacccagcaccuauccuauuuccucucucuuuuugccaagggguaagcucuuuuuuuuucuuauuuuuuuugggggggggaaacaggcucucacucccaugcccagguuggaaagcaguggugcaaucucggcucacugcaaccucaacuuccagggcucuggugauggguauucuccuaccucugccucccgaguaucugggacuacaggcgcgcaccaccacauccggcuaauuuuuggggguuuuuuggguagagaugggguuucaccauguugcccaggcucuucucaaacuccugggcucaggcaauccacccaccuuggccucccaaagugcugagauuacaggugugagccaccuugcccggcuaagguaagcuuuaucuaauguugucugucauucaaaucaguauagguaugcauauauauauauaaacuacauauaguagucauguauuuuaauauaccuuaaugauaauauauuauguguaucaucuugcaacuugcuuuuccauuaagcauuauauuaagguuuuccauauugaaauguuuacauuugguguauucauuuuaacuuccucauauuuaauuguaugacuaaaacaguuucuccacugcccuauuacuuauguuguuuaaaauuuuuuacuaugaaaaaaaugcugcaauaaacauucucuacaaaucuucuugugggaaaaauaagaaaugaaaugaacggccuucucugugagucaugagacaauaaagacuucuuucuaacagugauuauauaauagaauauaugcuugaacccgggagguggagguugcagugagcuaaguucgcaccauugcacuccagccuggguaacagagugagaccccaucugaaaaaaaaaaaaaaaaaaaaggccaggcgugguggcucaugccuguaauuccagcacucugggaggccagacaggcggaucaucugaggucaagaguucaagaccagccuggccaauauggugaaaccccaucuccacuaaaaauacaaaaauuagccaggcaugguggcgggcgccuguaaucccagcuacucgggaggcugaggcaggagaaucacaaucacuugaacccgggagguggagguugcacuuggccgacaccgugccacugcacuccagccugggcaacaagagcgaaacuccgucucaaaaaaaaaaaaaauuuauauacauaauauaaagguaacagagcauucugcggaugacacaguaaggaaagauaaccuagaucaauguuuuucaauuugugguuuuuggaaucaaguaauggguuaaagaaaagaaauaauuagaagagaauacaaaauaugaaggugcaaauaguauggauaugucaugaaauuguuucaguuuuguacaaauauauuuaacaaaugcauguauaucaucuaauauaaaaugcauuucuuauugugacuugauaaaaaaaauuuuuuuaaaaaaacguuggucaaaaguuuugaccaaaacauuggucaacucaggggaaaauucacaggaguaaacaugugaacuuagggugacuaggacacaugccugaucucauggacaacucugaagagggacagacacuccauauuaaugcuaccacagacuguagacuacaggagccaagaggugagaacaugaacaaaagagaaggagcccuggggaaagggaucaggaagugucaaggcacagaggagggaagugugaggcugguucaggagaugcugaacaugccacuuagcuauggagguggaguaggagccacagcugggaaggcaaacggagccggaugaggaaggccuugaacgucaugccaaaaaguuuagacuacuucacuuaguaggcugagguaguguuucccaaacugcagguugagaauuaagaacuuaaauuaccgagccauaacuaguauuuuuaaaaauuaaguagaauagaaaaugucagcaugcaccacauacaagggugagcacuguuuugugaaaguuuuguuucaguuacauauauaugugaacacacaaacacacgcaauuauucauuugggguuuugauguaaaaguuauuucuuacuaaagguuguaguuaaaaaaaaaaaaguugaaagcuacuggucagaaguaagucaucggugaaucauuaucaguaucaguaggcugguuaugaaguucuaguauagcuaugcaagauguuacagccaggcacgguggcucacaccuuuaaucccaacacuuugggaggcugagguggguggaucagagagagaaaugacacuaaugaaaagucugcuauuaaccuccuagaugacaacagcaauucugaaccacuuagaggcaauucacccuucaagaggucaauuucccuuuucucuggcugauguguuccccacuaucuuuucuguacuacaugaggggcuccuggcaaauggcuuccugaagacaucaaagaugaguaccaagguacuaacuacuuaggaauaaacugguaaucccauuuuuccuucggcauuuucuuccuuuaguuuuucucuuuuuauucuuuuuuuuuuuuugagggaggggcauucuucaaaaggaggaaaaugaacuauguauaauguauuacugagcaucucacaaggauuucaaagcuacuuucuaagagauuguuuauuuuuauuuuuuauuuuuuuugagacagagucucucucugucaccuaggcuggagugcaguggcacaaucucggcuuaaugaaaccuccaccucccagguucaagcaauucucccaccucagccucccgaguagcugggauuacaggcaugcgccaucacacucggcuaauuuuuugcauuuuuaguagaaaugggauuuccccacguuggccagaguggucucgaacuccugaccucaagcgauccacccaccucagccucccaaagugcugggauuacaggcgugagccacugugcccggccuuaauauuacuauuauuuugagauggagucuuguucuguugcccaggcuggagugcaguggcaugaucucagcucacugcaagcuccaccucccagguucacgccauucuccugccucagccucccgaguagcugggacuauaggcgccuggcaccaugcccagcuaauuuuuuguauuuuuaguagagacgggguuucacuguguuagccaggauuaucucaaucuccuuaccucgugauccacucaccuuggccucccaaagugcuggguuuacaggcgugagcuacugcacccagucccuguuuuucugagacagugucucacucugaugcccgggcuggagugcaguggggcaaucucgacucacugcagccuucaccucccggguucaagcaauuuuugugccucagccucccaaguagguaggacuacaggcaugacccaugccuggcuaauuuucgcauuuucaguagagacaggguuucaccaugguagccaggauggucucgaacuucugaccucaagugauccaccugccucggccucccaaagugcugggauuacaggcgugagccaccacacccaaccagaaauuguuucuuuuuaaaagaucuaauuaaacuuuuaaagauaauuguagacucauguguaguuguuaaaaaacaauacagagagaucccacauacucuuucaggcucacugcaaccuccgccuccuggguucaagugauucuccuugaguagcugagauuacaggugcccgccaccaugccuggcuauuuuuuguauuuuuaguagagacgggguuucaacauguuggccaggcuggucuugaacuccugaccucaggugauccacccaccucagccucccaaaguguugggauuacaagugugagccaccgugccuggcuguaacaucuugcauagcuauacuagaacuucauaaccagccuacugauacugguaaugauucaccgauuuucagauuucaccaggucugcaugcauucauuugugugugccuaucuaauuaguucagugcaauuuuacucuaugugcaaaguuggguaaucacaaccacaguugauacagaacacuuuuaucacaagaauuucauguuauccuuuagaaagucuuuuaucuuauaaauccaaauacucuacuuccacagaagucuugaaauuuuucacccagaucuaagccuuggcugaagacuccaguuaagcucacugcccacacuguaagaaacaaacuugagugacacauuuagucuuggcauucaugucacuuaaaugauaaauauaacuaugcaggaaaaugcaaaaguauauauaggcugggcaugguggcucacgccuguaaucccggcacuuugggaggccaaagugggcagaucacuugaggucaagaguuugagauaagccuggccaacauggugaaaugcuguuucaacuaaaaacacaaaaauuagccagccaugguggcgcaugccuguagucccagcuacucaggaggcugaggugagagaauggcuugaaccugggaggcggagguugcagugagcugggaucacaccacugcacuccauccagccugggcgacagagggagacugucucaaaaaaaaaaaaaaaaguauuaugaaaguauuaugaucauacauuuguuaaaaaucuaugucuaggaauauguauacauaaauaguuggagagguaauggugggcaugcagaaauguaaacauccgacauacuaggcuggugggauaaguuguucuucuuuuccuuuuauguauugaaaguugauguaugccugaggucucaggauaacagcggagaagacugagauuuauguucagaguacuuuuugcagcugccaguacuagggcucagaaagggaagugcaagggaagggccaagaagggauccaggaguugaguggccaacugucuuggcauacccacagcuaaggaguuuuccagaacauaguacuuuuggugcuaaaaccugggcaaacuuggaagaguugguugcccugucucgaagguuguugucugugcuuccuuggagcuugaagcaaccaacaaaccuuuuguuuuugguguugagguucagcaccuggggguagggaaguguggaaggauaauuuagaagagaauaaggugaccaugacacuuucugaacaccucagcauccagcuuccuucagccuacaaaguuaccauagcugcguuauacaaucugauuuugagucucauagagauguaaugaaaaguaauucuggcagacacacauauuuuaaagacuagacucaaacagguuacagaagggaaaaaaaagaagaagaaaagauuaccugucaaguaagagaaaagcauuucaccucaaagaguggguggaauaucaaugcacugagcaauuucauaaauugggcacuucagcuuuuaaagaagugcacuacuucuuauaauuucuaaauugaguuaccuguccauccaugaaaaaaguuugacucaugugccuuuuucuuacaacugguuaaaaugaaagacaguugucccagcccaucccacacaguuacccaccagugagagguaugcaaaaaaaccagaacacagguuagagccccaaagaagccugcaguuuuauaccacguggagccaagucacccucuaagggcuuaacaugugcuaggcacaaguagacucaguuuuuccucuuuauuuuuaauuuuuauuuauuuauuuauuuauugagacaagaguuuugcucuuguugcccaggcuggagugcaauggcgcgaucucggcucacugcaaccuccccgucguggguucaagcgauucuccugccucagccuccugaguagcugggauuacaggcacccaccaccacacccaacuaauuuuuuuguauuuuuaguagagacgagguuucaccauguuugccagccuggucuuaaacuccugacagccuggucuuaaacuccugaccucaggugauucacccaccuuggccucccaaagugcuaggauuacaggcgugagccacugcacccaaccuauuuuuauuuuuugagacggagucuugcugugucaccucggcuggagagcaaugguacgaucuuggcucacugcaaccuccgucuccuggguucaagcgauucuccugccucagccuccugaguaacugguauuacaggcaugcaccaccacacccagcuaauuuuuuuauuucuaguagagaugggguuucaccauguuggccaggcuggucucgaacuccugaccuugucaucugcccacuugggccucccaaaaugcuggcaucauaggcaugaaccaccacacucggccuuuuuacuuuuuuuuuuuuuuuuuuuuuuuuugagauggagucucacucugucacccaggcuggagugcaauggugcaaucucagcucacugcaaccuccaccuccugggcucaagcgauuguccugucucagccuccugaguagcugggauuauaggcacacaccaucaugcccagcugauuuuuguauuuucaguagagaugggguuucacuauguuggcuaggcuggucucgaacuccugaccucaggugauccgcccaccuuggccucccacaaugcugggauuacaggcguugagugagccaccgcacccagcccaguuuuuacguuuaagaaauguauaggcucaaaacaaggcacagauaagccgucuuucuccugagagacucagucucaaaacaagaucuacaaagguuuuuacuaccauuuacucagcaccuuaguaacagugucagcaaaauucuacgggaacccaggugagguggccagucucuccaacauaaaaccugacccuaacccuaacccuuucccucuccuccauggccuacuccaucugcucuugcuucucuccugaauuuucaacuuaccucugacuacugaaaccuaucgucaacauguaaacacauucaaggcucuucugccaacuccucccacaaaaaaccacgcugguuuaauggugcaucuuucuuaggguuaccagauuuuuuuuuuucaacuuuuauuuuagauucaggagacacaugugcagguuuguuaccuggguauauugcaugaugcuuaagguuugggguacaaauaaucaugucacccagguacugagcauaguacuaacaguuuguuuuucaaccuuugcugcccccucuccccucccucucucccaucuauuuuuuuuuuuaggguugccagauuuuuuuuuuuuuuuuuuuuuagacugagucucacucugucacccaggcuugagugcaguggcacaaucucagcucacugcaaccucugccucccagguucaagugauucuccugccucagccucccaaguagcugggauuacagacacgugccaucaugcccggcuaauuucuguauuuucaguagagacgggguuucaacauguuggacaggcuagucuugaacuccugaccucaggugauccgcccgccucagccucccaaagugcugggauuauagauguaagccaccacacccggccaguugccagguuuaacaaauaaaaauaaagaauguucacuuaaucugaaaaguggugugugcugaaaaaauuuuaaaaauaaagaauauuugcugcauauuauauuuauugaacaaucagcaaacuaggaauaaaaaauaacuuccucaucaggugugguggcucacaccuguaaucccaacacuuugggaggccgaggcagguggauuaccugaggucaggaguuuuugauaccagccugaccaacauggagaaaccccgucucuacuaaaaauacaaaguuagcuggggguggugcaugccuguaauccuagcuccuugggaggcuuaggcaggagaaucacuugaacccgggaggcggagguugugguuagccgagauuaugccauugcacuccggccugggcaacaagagcgaaacuccgucucaaaaaaauaaauaaauaaaaauaaaaaauaacuuccucaacaugauaaaagguuuauaaaaaccccauaguuaacaucauacucagccgggagugguggcucaugccuguaaucccaacacuuugagagacugaagcaggaguauugcuugagcccaagaguucaagaccagccuuggcaacauagaaagacuccacucuacaaaauauaaaaauuuagccagaugucguagugugcccacagguggucccagcuacuuggaaggcugaggcaggaggaucacuugaaccugggauuuugaggcugcagugagccauaaucaucccacugcacuccagccugggcaacagagugagacccuuuuucuuuucuuuucuuuucuuuuuuuuuugccucagcuacuuggaaggcugaggcaaaagggaucaccugaguccaggaggucgaggcugcggugagccaugauagugccacugcacucccaguaugggcaacagggugagacagucucaaaaagaaaaaaaaaaaaaaaaggucaguauugguggcucacaccuauaaucccagcacucugggaggccaaggugggcagaucacuugaggccaggaguucgagaccagccugggcaacauggugaaaccccaucucuacuaaaaauacaaaaaaaaauuggccaggcaugguggcuuaugccuguaaucucagcacuuugggaugccaaggugggcagauaaccugaggucaggaguuugagaccagccuggccaauuuggcgaaacacugucucuacuaaaaauacaaaaaaaaucacccaggcguaguggugggugccuauaauccuagcuacuauggaggcugaggcaggagaaucucuugaacccgggagguggagguugcagugagcugagaucgugcuacuacacuccagccugggugacagagugagacuccgucucaaaaaaaaaaaaaaaaaaaaggugccgggcuugguggcacacuccuguaaucccagcuacuuggguggcugaggcacgagaaucgcuuguaccuggguggcagaagcugcagugagcagagaucacgcuacugcacuccagccugggcgacagagagaaacucugucucaaaaaaaaaaaaaaaaaaaagaaaaguauguguauauacccaaugguaggugaaagacuggaaacauuccccuaaaauccagaacaagacaaagaugccuacuuucauuguuuguauucgauaucuuauuagaaguuccaaccagagcaauaaggcaagaaaaaagaaaaaaaaggaauccaaaguggaaaagaagauauaaaacuguauucacagaugaaaagagccuauauauaggaaauucugaaaaauucacacagcaacaaaaaaaauuauuagggcuaacaaaugaauauuaagcacaauagcagguuaaucaucugucuuuuuuuuuuuuuuuuuuuuuuuuuugagacagagucucuggcucuguuacccaggcuggaguacaguggcaugaucucaacucaaugcaaccucucugccuccuaggcucaagugauucucaugcuucagccuccugaguugcuaaggugugugccaccacaucuggcuaauuuuugcauuuuuaguagagacagguuucaccauguuggcaaggcuggucucaaacuccuggccucaaguggucugcccgccucagcuucccagagugcugggauuacaggugugagccgccaugccugauuaaucaucuguauuucuaaacacucacaauuaacaacucauaaaagaaguuuuaaaaacaauugcaucuacaauagcauaaaaaagaauaaaauaauuaggaauaaaguuaacaucgggguacaguggcucacaccuguaaucccagcacuuugggaggccgagguggguggaucacgaggucaggaguucaagaccagccuggccaagauggcgaaacccugucucuauuaaaaauacaaaaaauuagcugggcgugguggcaggugccuguaaucccagcuacucgggaggcugggcagagaacugccugaaccugggaggcggagcuugcagugagucgagaucgcaccacugcacuccagcugggugacagagugagacuccgucucaaaaaaacaaaaaaaaaauuagccaguuaugguggcaugcaccuguaguaccagcuacuugggaggcugagguuagaggaucgcuugagcccaggauuugaggcugcagugagcuacgaucacaucauugcacuccagccugggugacagagcgagacccuauaucaaacaaaacaaaacaaaaaacuaagaaaauguaagauuuauacacugaaaacuauaaaacauuccugaauuaaaaaucuaaauaaauuaaaagauauauaccaugauuauggauuagaaggcuuaauacugucaagauggcaaaauuccccaaagcaaacgacagauucaauacugucccuaucaaaagcccaaaggcuuuucuugcagaaaugggcaaacugauccuaaaauucauauggaagugcaaggaccaugaguagccaaaacaauauugaaaaauaacaaaguuggaggacucauacuucccaauuaugugguauuggcauaagaauagaugaauggaauagaaaugaaaauccauaaauaaccccccacauguauggucaauugauuugacacagaugccaaaaccauucaaugcaggaagaauauccucuucaacaaaugaugcugggacaacuagauauccacaugcaaaagaaugaaguuggacuguucccucaugcuacauauaaaaauuaacucaaugugaucaaagaccuaaauauaaagagcucaaacuaugagaaaagacauagggguaaaucucccugaccuuggacuuggcaaugguuucuuaaauaugauaccaaaagcacaagcaacuaaagaaaaaauaauaaauugggcuucaacaaaauuaaaaacagaaagugaagacaacucacagaaugggagaaacuauuugcaaaucacauauauuguaucuguuaccuguauuauguuacuuauauauauacaaucuccuuauguuugugcucuaacauaaccaaaccugaaucccaccagacuuccuaauauaacacauagcauguuuccuucucaucugagcuacuugcuaugaaaaccauucugccuaagcgucagacuugggaaccauuggcccaacaggugcuuguguaauucuguucuucuagguccaauuuuaagaagaaaaauaugaggguagggggaguuuaugcaagacaaguagaaaugugaaagagggagcuaaaagaaaaauauuaaguucaccaauucugaaauggcucuuaaagcaaaaggaaucagcaacuaaggacaaacaaccacaucuaaacaagaauaagaauuuuaauuuuagagcacgugaaaagauguguuggaggaaaaauccugaaauauaagugaagcuuugagagccuuuuuuuuuuuugacagggucucacucugucagccaggugggagugcacugacacaaucacagcucucugcagucuugaccuucuaaacuacggugauccucccaccucagccuccuaaguagcuggacuacaggugugcaucaccaugcccagcuaauuuuuuguauuuuuaguagagaugggguuuugccauguugcuggucuggaacuccuggguucaagagaucacccaaagugcugggacuacagaccugagucaccacacuuggccuuuuuuuccuuuuuuuuuuuuuuuugaguuagggucuugcucugucauccaggcuaaagcacaguggugucaucucagcucacugcagccucaaccucccaggcucaacagauccucccacccagccuccugaguagcuaggacugcgggggcacaccaccacgccuggcuaauuuuauuuuuuugcagaggcaaggucucacuauguuggccaggcuggucucaaacuccuggacucaagcaaucuucccacuuuggccuccuaaaggcugagauaacaggcaugagccaccacauccagcaugagauucuuauuuuaaaacaagguauaggccagccacaguggcucaugccuguaaucccagcacuuugggaggccaaggugaguggaucaucugaggucaggagugugagaccagccugaacaacauggugaaaccccaucucaaauaaaaaugcaaaaauuagcugggcgugguggugggcgccuguaaccccagcuacucagguggcugaggcaggagaacugccugaaccugggaggcagagcuugcagugagccaagaucgcgccauugcucuccaaccugggcaaccgagggagacuccgucucaaaaaaaaaaaaaaggccagacgcgguggcucacaccuguaaucccagcauuugggaggccaaggcaggcggaucaccggaagucaggaguucaagaccagccuggucaacauggagaaaccccguuucugcuaaaaagacaaaaauuauccagguguagugauacgcgccuguagucucagcuacucgggaggaugaggcaggagaauuguuugaaucugggaggcggagguugcagugagcugagauugugccacugcauuccagccugggugacagagcgagacuccaucucaaaaaacaaacaaaaaaacuggcuuuaaaaaaaaaaaaaaucuguaaggguggggggagggucuccagaaaagaauaaaauuuuuaaaaauuggcuuuauauaaugucugacuauacuuuuauucuaaaaacucugugacauaaggcugguaaacagaaagaaaaauccaacaaggacuuacuugaccguaggacauauuaagauguuuauuauuuacuaagaguaacauguauacauuugcaguaauuuguacaauccaacuacauuacaauucacaguaacauacacuagcucuaaccugccuuggauacaauuaagucuccucaacacacuauuuuaucgccaaacuuacauucuggcuuuuauaaucauuuugcaacaccugguacaguauacaccuauagcuuugccauagaaaugccccuaaaugcccuucagagagcagaggugaauacuuucucaugaagaaacgccaacuuuucuaagcgaguucguuucaguagugggagccauucccaguaggauaacucuaccacacgguagccaagccgagccagcugccgccucuucauauugugcaguccaaggagaucccuggagccauagcaauacugguuccuguuugugaacugaacagccagcuucauucuuggggucugcaugcaggcugcggggcacaggccagccaucuccauggccccugauuuaucugcuacauugcaaaggaagccccccagagguacagcugccuuauucuccaacuccaugggcugcugcccaggcucugacucaguuuugcccuggaaauguccucuugcuuucccuuuuaguaacuuauucaucaaaucaucuguaaggcugacucccacaugcucaagccuuaauuuggcuacauuuucagccggcguggcuucucuauuaaaugguaauggcuucagguuaacaucaagcuggaccucuaagucagaagaucggguaugaggcaaaaucauauggugcuugacguacuggggcccccccagcauggucuccaguaaaaagacaguuucuaagaauucaggcuuugaauucauauccuucucugcuaaauaccacagcaauucagaccccucuugcugaaggugaguacuaagacgauugccucuguaaucuggacacucaaugccaacuguaccaucgaggguauauaguuccuuaaggaggucaaacuuaguucucuccugagcuaaccugacaaacccuggacugagagcgaaaucaauuaacucuacuggaaaguacuccaaaaaugccaggcccagcaggcaggugggcagguguucuggguacugguugaauucaggcaucuuucugugaaucucacuuaucaggcuggaguaaaauucuucugcauuggguggcuuauaauucagaguuccaaaugaccacagaaucuuggcaacaucuuuacuucgacagugugccacucuaggaggcaaagacgcagccacugcauucauuacuccuucauucaggaagcguaaggccgagcaguaaagagucaggugcaugacaccuugaacucccagggaaggaauucgcugaggagcuaucucuccaaucugcuucaugaaauugaugugauccacgugagugaaacggaacauuuuaacaauauucacuaaggagcgacuacucagaugcugaauguuagcacaagccaagucuccaauuuuccgcaugacaaauucagagagauuaguacuugauuuaaagaaccccaaacagaugguaccaaccuccuccaaauugaucaaaucuauauauuuaaggaucaaugauuccaauuuuugcauuagguccugggauaccugacgauuuucaccuauaacauaaauuaagugaacuagcugagacaaggauagauccuuccagugcaaauuaagauaacuagaaaaaauguuuaaaaaccuagguacuuugcggccuaaguaccuccagagaucagccaccaaaaggagcugauccauauucaucucccauaccugauggcaacacuuggucucauacacaucuagcauugaaugggagugagggauuccuaaaaugacaaaagcuuucaaaacauugaucagaucuuggguaucaaagagcuguaucuucuucacacucagcuggcagagcagagcaaagcugguacugcccagcaagacaggaugcugcucugcaggcaaagagcucagcuuacacaaauaaucaacaaugacuugagccuggagauuauuuugauuaacucugacuuugugcaaaauuaguucaccuucugaaacagacaggagcugagaagucucagaugcauuauagcugugaacacgguauucuggucuuagcuguaggaaaacucgcauguuuucaaaggaaucaaacacuucuacguccucuucaucaacuccuguggcccugggugagcccagcugcaauguacuggccuuagaggaagaagucuugcugaauuccaaaccugggugggcacugcugguugucaggauucuccgagaagagaaggugcuacauauguucuuaacuuuuuuggcagaauggcagaggcuaauguguucuggaggguccugucccccaugcugugugcugcucacauuccaguaugacacacuucggacugcaccaaaggcagaaggacugcaaaaugcucgguaucuuacaaguuuuaaugacuugagaguagcugccauucuggugucaguauugaucucuuuggcagucagaauacaguccucacagauuugaccaggcaauuucuuguuuauauggugcuugauuagagcuggacggggagguguuccacaaaaacugccuggaaaucuucagcauaucacaagagccagggaucacaaaugacugggucagaauuggugccagauacugaaaaaaggguagaugaagaaugaguggcuucuaccuauaaaagcauccaaauuuacacauuauaaaaaacagguugaaacuacacugcugucuacucaaauaaguucaaugcuaguaaaugcccaaaccacaugacagcauauaucaaggauaaauucugcggucuguguaaaggccuaggaaaacccccaacccaggguacccgugggcaguuccuggacugcugcucaccagacuuccuucacuguacaaggcaagcagugacggcuaaagaagagacggugcuccgcuaacauuugauaggaagaaggaaggcagauuucuagaaagaaggcugggaacaaaagugagcaacuccuuccaucucuuugauaucaaggcaaacagguccuaccugaagaauguuuauaaaaacugcuaugcuaacagcacuaaguaaaaagugggaucugguauaaaagauaauuaguuggcuggguguggguggcucaugccuguaaugccagcacuuugggaggccgaggcaggcagaucacuugaggucaggaguucaagaccagccuggccaacaaggcgaaaucccgucucuauuaaaaauacaaaaaauuacccagguguggcagcacacaccuguaaucccagcuacucaggaggcugaggcaggagaaucccuugaacccaggaggcagagguugcggugagccaagaccgugccacugcacuccagccuaggcgaaaaagugagacuccaucucaaaaaaaaaaaaaaaagauuuaauuaguuauaccuacgauaacccucccuguucuuauagcgcaaaacuguuaauuccaaaauucugucauucuaaugcuguucuuuuacuuuuuagaagaugccuacucuccucuucaggaagcuuauaacagaauuugagucacuauuagagaguagucacagaguaaugguguuauuagaaaguauacuaaaaaacucacucauuuuggugggagaaagcagaagguugagggucugcucacugucacuucacgggugggaagcaaagaguaccccaaagcugggcucaggguucagggaacgccaauugacgcaacugccccgcugacaucuucuggagaaggcagcuuagcaauguuuccagugagucuuuauucugccugugagcaguauaaugcccauuuuucucccauggcagaaaccaugagagacuaugaaauugauucugcugugcucucgcuuuccuuaaugcuuauucuuuuucuuuccacuuaagugccaaagccugacaagcaagacccaaggagaccugaguugucaacugauguaccagacagggcuguugcugcagaaaacuccauaaaaguuccaagggugccagaaugacuuucugaaaugccugccuaacucugcugucagccacuuucuuccagagcccauagcacaucaucauuuaguucaucaaagaacagcagggcaggucaguggcucuguuccaguagcccagcuacacaggcuucucuagauggcaggaacauauguaugaauuucugugugaaucagagcagaauucucucacauuaaauuuuuauacacuugguucuuuacuguggcuuguggaccauucuuuuuuucuuuuuugagacagucucacucugucacccagguuggaguauaguggcaugauaacugcagcuuugaccucccacuucaagcaauccucccacuucagccucagccucuugaaguagcaaaaacuacaggugcacaccaccaaacccaguuaguguguguuuguguguguguuuguguguguguguguguggagauggagucucacaauguugccaaggcuggucucaaacuccugggcucaagugauccuccuacccuggccuccugaagugcuaguauuacaggcaucagccaccaugccugaccaccuguggaccauucugcccaccaaauuucaaucugugguucagaucaagggugagcagacuauguccuggggcccaaaucuagcucuucacauguuuuuguaaacaagguuuuuucagaacauagcuaggccauucauuauauauugucuaugucugcuuuccugcuacaagagcagaacuguguaacuguggcagauuguauggccugcaaagcauauuuaguguuuggucuauuacauaaaaagucugcugaucucugcuacacacuauuucuauaaaugcagauagccagcuuuuuaaaaauuagaaaaacuuggccacgccuauaaucccaacacuuugggaagcugaggcagaaggauugcuugaggccaggaguuugagaccagccugaacaacacagcaagacugucuaaaaaauaaaauaaaauaaaaaauaaauuaaaaaaauaaaaaauuuuaauuaaaauuggaaaaacuauagaaaaauaguacuaaaauaauguuuuucuuuaauauuuagaugauaauugaagauuacaguccucaaaauagucauuaggaaauccaauuaauacuacagcacaggaaaggugggaacaaaagagacagcaggauggccaggcgugguggcucaugccuguaauuccagcacuuugagaggccaaggcaggcagaucacuugaggucaggaguucgagaccagccuggccaucauggugaaacccuaucucuacuacaaauacaaaaauuagccaggugugguggcaugagcguguaaucccagccacucggggggcuggggcacaagagucgcuugaacccaggaggcggagguugcagugagccaagauggugccacugcacugcagccugggugacagagacucugucucaaaaaaaaaaaaaaaaaaaaaagaaccaaaaaaacagagauagcagguaacagaacucuccagcugacagaacagggcuuuuaagaagaccuauuuuuggcugggcacagugacucaugucuguaaucccagcacuuugggaggcugaggcggguggaucuaugaggucaggcauucgagaccagccuggccaacauagugaaacucugucucuacuaaaaauacaaaaaauuagccaggcgugguggugggcgccugcaauugcagcuggggcaccugcaaucccagcuacucgggaggcugaggcgggagaaucacuugaaccugggaggcagagguugcagugagcugagauagcgccacugcacugcagcccgggcgauagugcaagacucugucucaaaaaaaaagaagaggaagaccuacuuucgaauuuggaauuuaauuuaauccaccacaaugugcaacuaaagccauauacuguucaaaucuguagucuucaucucauuugaggaaggagauccuggccaggcacaguggcucacaccuauaaucccagcacuucaggaggccaaggugggcggaccacuugaggacaggaguucaagaccagccuagccaauauggggaaacgccaucucuacuaaaaauacaaaaauuagcugggcgugguagugcgccuguaaucccagcuacuugagaggcugaggcaggagaauugcuugaauccaggaggcagagguugcagugagcugagaucauacuacugcauugcagccugggcgaaagagcaagacugucucaaaaaaaaaaaaaaguagauccuaaaaaaauagauuuaaaggucccauuuuuuaaauaaaauagcugugccauaguaaagcgaaaaacagaaaaugucugucuagaaggaggcugguuuacaagauaaauguguggcaggcaucaacacaugaaaaaguacacacuaauauugaguggaacaaauagcacauaaacaagaauuaacaaauaucucuauaaaugauauuaauuuuaaaacauuaaauaauuaaaauuacuucaauuaauucuaccuaagaguacuuaaugaaauuacuauacguggucuggaaauaaaagaaccaucuccuagaacaucaauguuuggugcagcuccaguguuuugaauucaugugacacuuuuugauuuguaaaaacacaggcuaagauccaagauggaaauaaccagagcuaugccuuagggccuccucugugccaaggcuuagagccuuguaaagcugcuuuaucugcauuaguucccauccuuauaacaucucuguaauguaaguuuauaauccccauauuacugaugagaaagagaccacaagauuaagaaaccugccaaaaguuacacagccaagggauugaguggagccuaauauuaaagacugucugacucuucagcccacauuauugguguacuagagagacaagaauggaugucagaaaacagguucggggggcaguacggggugggauggcugaacaaucuauggucuucuaggauuuccaggugccagggagcuggaggguuagaacuagguaagcuugaaagucccuuccaccucuaacagucuacgauucuaucacuacgguuuauacugcaaguugaguaucccuuguccaaaaugcuugagaccagaaguguuucagauuuuaaacuuuuucaguuuuuggacuaugugcuuuauacugaccagugagcauuccaaauucaaaaauccaaaaucugaaauacuccaaucauuuuuuuuuccuuugaguaucauguuggugcucaaaaaguuucagauuuuggagcauuuugcauuuuggaguuucagguuuggaaugcucaaccuguacuuuaaaaaagaacaaagagaagaccucaaaggcugaaaucuacaugaggcaaagaguucgcaggaugcuccaggaucaaaguaaggagagcuaccacaauugaagaccugaaaguuggcaguagagauaugggauccagaaacuaggguucaauacagagaagcaaagggaaaucccaggaaaaaggugaaggaagaucccaggacaagagcugugaacagacauaaagagcaaccagcucaugcuggacgacauagacaguacccaggagaggagaaucauacuucuaccggauaauccgggcaugaacaagagauaaggauacaaaaagccaugcuaauaaaaacaguaacaaaaauuauuaaugccagggaagacaaaaaaguuauacaagauagaauauguuaccacaggcaggaugcaauggcccauuccuguaaucauaguacucugggaggccaaagugagaagaucacuugaggccgggaguuugagaccagccugggcaauguagugagacccccaccucuacaaaauauuuagaaauuagccaagccugguggcacacaccugugguccuagcuacucaggagguagaagugggaagguugcuugagcccaaaaaguuaaggcugcagugagcugugauccugcuauggcagggugacagagagagacccuaucucaaaaaauaaauaaauaaauaaaaagaguaaagaaaauauuaguauaucauacucccuauucaguugagaauaauacuaacauaauuuuauuaauauaaaucuugauauuagccuaaccaaaaauuaugagcaaacuauauugggaggauaaagugaguaagaggaggaguagggggagguugaugauacaagagaccuagagccucaaaguccauaauaaagaaguacaauuggacaggugugguggcucacaacuguaaucccaauauuuugggaggcugaggcaggaggaucacuugaacccaggaggcagagguugcagugaaccaagaucgugccacugcacuccagccugggcgacagagcaagacacagucucaaaaaaaaaaaaaaaaaaaagaaaagaaaagaaaagaaaaaauaaauauagugauggccaggaucagugaguggcucacaccuguaaucccagcacuuugggaagcugaggugggcggauugcuuuaggccaggaguucuagaccagccuggguaacauggugaaacccugucucuacuaaaaauacaaaaaguaggcugggcacagcggcucaagucuguaaucccagcacuuuggaaggcugaggcaggaggaucaccugaggucaggaguuugagaccagccuggccaacguggcgaaaccacgucucuccuaaaaauacaaaaaauuagccaggcaugguggcaggcaccuguaaucucagcuacucagaaggccgaggcaggagaaucacuugaacccgcgaggcagagguuguggugaggcgaggucgcaccacugcacuccagucugggcaacagagcgaaacuccaucucaaaaaaaaaaagugggucgggagaggaaacuauuauuuaguguuacaagcucuacugaacuauuugacuguuuaaaccauguacauguacaauuuugacaaaaauuaaauuaaaaaauccauguauuaugaagauauuaugguauuguucaagauaaugaauggagaaaguagcuuaauagauaaggaaaauguugaaaaguuauuuuuagugcaagcacuuucuacuaccuaagaacuucuuuaaagauguucaauaacagaaaugauaacaaaauaaggaaucuuagaggcaugaagagccaaccuacaaaugguaaacaguggcuacuuacucuuuucacuaugcaacauuuacaguaacucuauagaaacuguaucuacauacacaggucugaaacagaggacuucagaaguuggucuugaguacuguggagaaggaaagaaaaacaaggaagauacagaagcagcagagaagaacaguagggagaaaagacacugcaaagaagcagcagucaggaugaccagauagcgaaaacauaccugagaagguuaguuccuccuuacucaaagacucucagaaaauccauaggaaagcuggaaagagaacacuaugagaugcucagucaauuaacuucugacucuuuuuuuuuuuuuuuuuuuugagacagagucuugcucuguugcccaggcuggagugcaguggcgugaucucagcucacugcaaccucugcaucccggguuuaaguaauucuccugccucagccucccaaguagcugagacuaaaggcucacgccaacaugcccaccuaauuuuuuuguauuuuuugguagagacgggguuuugccauguuggucaggcuggucucaaacuccuggccucaagugauccaccugccuuggccucccaaaguacugaguacaggcaggagccaccacgcccggccugacucuuucaauaaaggucaaagauaccugauaugauuucacaaaacuccuuuccuaguuuaagugccccaaguauaccuuucuccccuuuagggguccuaacgaaacagaguagagccucagacacuccuggacccugucaguuccaaaaggcaaugcccaaaccucccugaaugaugugauuucacaggacugaagaaucuuaccuuucucccuuccacauaccggucugagcagagccgaauagcuucauuuuaaacuagagucuagaaguuagaggaggggggccaggcagaggaaggagcgaugcuaacuguagacugaguauaagacaccuuaaacacauacaauuuaccacuuaccagaucugaucccucaauucuaacacuuuuccuuucuaugucccaauaaaauugccacaaauaaaugaacacuccaacccuauucuugucucagcaaauaauuuguugagcaaccuuaagaauuaaaaaggcaaaaaaacuggcuagacagguggcucaugaccauaaucccagcacuuuggaaggccgagcaggcagaucacgugaggccaggaguucaagaccagucugggcuacauggcgagacccugucucuaccaaaaaaaaagggcaaaaaaaccgaacuuucucuaggugcugagguauucugcugagaaucuacaaaacuucaaagccccuagugagggcuuagagacuggcaguaaggaccuuagcuguuaauguggauguuaacugggcuagacucuucuguguuucuguuuccacacgggagcagggccucagagaggagucuaccaguacugcgaaggugaagcacuagugcaaagguguuuaggucaaguucagugucacucgcaggucuaagccaaacuaaaauuauucagucuagcaauccaucccuuccuuuuuguucuagacuccaugcugauaggagaaaaacagcacaucacaaacauuugugaaacuuuuucagcuacacagcccuuccgcuucucuuuuaagacucugcuauuccucuaucagaauggcaagaaggauguggguagauauaguaugacuaagcccuguagaugauucuguuagagcuacugcuuuuaaaggguuucauaaaacccugucuuuagaaaaccucuccauauaacaacaggcaguaggcacucauguccucucagcccaucuaaauggggcuucuagaggaauuacaaaauccaggcagguaaagagaaguagcugcaugcacacagucgucauaagagaaaauucccaaauaaaugguccaaguaccuauaacuguuagcucaauaaacacuugguuuuaucugcuuuuacaauuugcaaggcuguauagaggcuguauaguacauacuucagacaaauaaagaaggaguuucagaauucuuuuguuuuuuuuuucagacagggucucgcucuguuguucagucuggagggcaguggugcaaucuccgcucacugcauccucgaccacugccccccaccucucaccccggcaaccucccgggcgaggaucgcucaaggaucucaaacgauccucccaccucagccuccuaaguagcuuggacuacaagcccaccaccacgccuggcuacauuuuguuuuuuuguguguuuuuuuuguuuuuuguuuuuuucguagagacagaguuucccuauguugcccccagguuggucucgaacuccugggcucaaguaauccuuccacuucggccucccaaagugcugggauuacaggcaugagccaccgcaccugaccuuagaauuauuuuauaucaaaguugacuuauucacaugaugaauggcaaggccuuauuagggacuaaaaaaauaaaccaauggauggggaagaaaaucauacugacuaauaaacauuagaccugcauaacugccaaaggccucacuuuuuaaguuauguuaugcagcacagagucuucagauuuuauuuacuuauuuauuuauuuauuuauucauuuauuugagacggacucucgcucucucgcccaggcuggagugcaguggcgcgaucucggcucacugcacacuccgccucccgggguucacgccacgcuccugccucagccuccagaguagcugggacuacaggcgcccgccaccacgcccagcuauuuuuuuguauuuuuaguagagacgggguuucaccauauuagccaagauggucucgaucuccugaccucgugauccgcccgccuugaccucccaaagugcugggauuacaggcgugagccacuguguccggcccagauuuuauuuuagucuaccagguaguagcaaacuauccaaggacuugcccaggaccauucaggucagugagcuacagaaucuaguucuggaaaggcagccauucuuacuauucacaaaguguagaaaacgugaauucagauuccagcagcaacaaaugacuggagcacaaaacgccagccacaguuggugcuaacgcagcuggcuaucagcuccacaggaugaagcacuguccaagggucugaucagugaagcaucacccaagacugaugaacacagcugauaugaggggacccaaaguucccugagucaagacagaagagcugugucacgguuugcacagaaagagaaagagcaacuauucuuacccacggaaagaaaaagggagaaggccaucaauacuacccuuaggcuugugcaacgagaaacugcuaaaaauggggggaagguauauauccuaucauacugauguuuaccgaagacuccgcaucccaaaugcuaagcaacauacuguagggccuugcuacucaguguguggucugcgugccagaggcuucagccucgucuggaaucuaguuaggaacacaguuaucucagaacccaccccaguccuacagaaucagaaucucuaagcgauucgcaggcacaucaaagugugaugagaggcgcggcagaauaucugacuacauucucuuaacagcaccgugagacaaguacuguuacgaucuccauuucacagaggaaaaaaaaucaagggucagauaagcccccugccaaagaucacaaacucaggagcggcgagagucacugaaguucucaccacagccaggccugcgagaggcacuggcaacccaggccaagagcugaacaaggccucgaugcgcuccagcucugggccggccgggaggacaggaggcacaggccaaggcccaggacggucgugaacgcggaaagaggccgccgcgaccuccuccccggccgccgccacucaccugauccucccgaaggugggcgccgcaacaccaaaccggggacgccgcgggcggcggcgacacagauacuggcuccuccggcgacuccgagccucacagccccacuuccggccaacugcccgcuacuuc

SEQ ID NO: 191239 - RNA, 14284 nt, Homo sapiens
uauuuucuugaaugaauggauucauaauaagaacaggacuucaccagcuuccaagggacccuccccaccucucggauauauucugaagccuaaauuucaccugcuuaucuaggauccuaggccaggccuucugccacaccaagccacaccaagcucagcaguacucacaggccuuuaaucuauaacugccuggccacaccaucacuuccccaggaugguggggagggaugaagauguauagccagguaggccacaccaacucugaguccaagagggaaggacuggggucaggcuggggcuugggcaggggacucccggccccaggcgaugagggaguugcuggcuugggcaagcucggcgauggacacccggccccgcugucggaugaaguuggccacggcggccaguuccucugggguuauguagaugaacuugccccggucgucaaucacaccuguggggacaugcagguuguggggcugaggccuccugggcguuccccaucuggccugagaaugcccaccuacuccuucacagcuggcucagggcccuuccggccuccugccugccuggacuuuccuggcugcauccaguccugcuaggagagucgaaucaggcugcccugccuguccucucccacugcugccaccuccaggcccuggcauguccuccuuguaacugcauccagcuacucagugccccuccuugcacaccccuccccccaucuuggguggucauccugccucugcagcacaucccugcagccccuguggcuagacacucuccaaggccaggacugcagugauuggcucucaucaucucaccuguuauaguccccucagccagcagguccuggaugcgauuuaugguguccuaugaggagaacaacucucagaauagagauaggcaccaauguccccagaaaaagcacugaaaccucccucccacuacagccaaaucucuuuauuucccucucaugccacgcccaaaugugacucugugcuuugccuuuggaagggcccuggguagaaggggcucugguccugggcccugcaagacccccaaaagaguaucucuuccuguuagaagcggggcagugauguuugcaacacaggcuggugcagucugugcaugagaguugucaagguaacugauuugggcugcuuuggucacaggggcuggcagagugaugggguuuggguuuuuuuuuucuuuccugccuguucguccauuaaaaaugcaggauucccagggugccaggagacuucugugcacuacucacucuugguuggggacaagguagacggugcaucaagacucuaucuuuagggcagguccucucugcuagccacagaccccuggccacacugcacacagcaggccacguuccagggcuuaccugagugcguaggcccaccugggaagccaggucuuccaagagcacaaccuuggacugcuacaaaaagaaggaggaaaagaaagagaggcugagcuugggcaaaucccucuaagcaugggcacccuccagguuugcauucugaucugaucuguucucgguggcuggaaaaacacuguacacacuccuguaggacagccuugcuccccugacacacacacacacacacacacacacacucacuaucacccauugacagagacccgcacaaucauaaacccucucauuccccuucuugcgaggaaggaaucuacccaaaacaaccaccugccucaugggcccuguccuggacuccgagacacacgagugguaaucagagcacagcagccaccauccucugcauccagccaucucuuuuuaacaucauggacaaguucaaggggacgcaccauagggaggaaggaggcggugagagucaccaaaagcuauuuuaaauaacugucaccaggacuuaugcuugcugaggaccuacuagaacaaggcccugagaagguaggagggacacaugcugaacaagccauaguccccgcccuggagcucgcaguccggcuggugagacaggugaguacauggacaagagggagagcagauaaaagcccgagcaagccaaggucucucaguagaggcugugggggcccacuccugccuugccuucgcuggccgccccacuggccuggucccccacaaccugacacacccacacuuuuuauccauccucuuuauaccaucugaggcacugagcccacccuugaaaucacugucacuaauaccgcugagugcuuuccagcacagccacguucugugcuccaagugcuucuucauacccucaguagaaaccugaguucccaagggcgcagcgaaggguccaccgcuguguccacacaggcaccugcccccacuaccccaacacacagcacaggacuugagaaaaggcaguucuuuugcauuucugugaauccuccaccgcaaaugagcugggggaggacugacauggugacaccucccugacugcagauagcaugugacuuguuugaaaugccaaagccguauguacaagcaagaaggcaagcgagaggcagcugggucaggaugggcaaggacaaagugacguggucagcuggucucuaccuacaaaacagggaucaggcagcgggcucucagugacaguguggugcgagaacaugaagucaccccaggugcucccugaugaccuggccugaggugcugcuggggccaaaacacguuugauaaaacaagcuaggugugguggcacccaccugcaaucucagcuacucaggaggcagaggcaggaagaucgccugagcccagccauggucagacaggagaauggaacaagaucgagugaacccuacaccucucauaaacgaugcugggugcaggcauguuccuccaguucugaaaucuuaaggcaaaaaaggucuauccccuuggagcaaggaggaaagcagacagacugaauuucagaaguccuccuuuuccuugcaagacagcagcucuagaagaauuagccagcacaggcuggaaaaacuuuuuuucuuuuuuuuuugagacagagucucacucugucgcccaggcuggagugcaguggcaccaucuugccucacugcaaccuccaccuccuggguucaagugauucuccugccucagccuccugaguagcugggacuacaggugugcaccaccaugccuggcuaauuuuuguauuuuuagcagagaugggguuucagcauguugcccaggcuagucucaaacuccugaccucaagugaucugcccgccucggccucucaaagugcugggauugcaggcgugagccaccaugcccggacaagcuggaaaaacuucuaagcuccaaaagaguuuggagaacucccagagaauaguuaccuccagggagccaccaaaagugagggcuagaacuggggaccuuucuucugguuucugcagaguaaagggggauguugaagcugacccccuccucuaauuccaccugggaaggcuuccuggggaggggcuucaggaccaucuuacugccuacuggguagguggggacaaguuccaaacagcagcaggcaagugugagaaauaaccugcccggccacagccccuaaucaagugugccaggguagagagagggcuccaugagaggggagugcacacagccugaacagacaggacccucucaaagcugccagcauuucccccacuuaagaaccccagacucaaggcugugagcccagccccucgcugcuggcaggcgucuaaacccugcucucuuucaggagagguggcgggaggauuaugcaagcccuggguccuuggcagccccugguagcacccccaccaccgcccccgcucccucugcacuccuucccucagccgccucugcaccucugaguugcacuugaaaaccucuccccucauggcauccuucgugggagagaaguugcuuagcagcaaagcaaaguaggaugugcuuaugcaaccuggagcagcaucgaggcggccugcgcaguggcugcggacagaaggggacacacugccgccccacccuaaacuccaaaggaaacaccauccuguucccccugaaagacccaaguucccagucaggagcacauggcagaggaugcuuguuucaacucaguggagccucagugugacagaacugacagaaaacacaugugaagagacuugaaaacacacugacucacugagcguggggucugaagagcagggaaacugucaaacugagugugaggaagugaucaaaggcuugcgccucccacacagacccagguccuucuccaccuucgggguuggagggagagaaacucuccuggccaggacccugcggcucugccccucugggccccccuguccacuccugcaugagccugaaugcccugccugcagcccccgcuggaggcauccaaccugcacaugccaggcagggagcugacacucaggcucuguucaguggcuucuuaccuugauguaguugaugaacucugucaggaagcucugggacuagagaagcagagaaaucagggugagcacccccuagcaagcccacaggguucuguacccauucacccaaguaccaccugcucacuugagggccaccugccugcagccugccuuuggcccgcccaaccaccugcacauaccgcuugccuacacaagcagcagagccuuccagggugagaguuucggaggcaccagccucugcugaggacaaggccucuggccacuaaagccugcugguacugaugcccacccaccucucacugccuggccaggggcgucugggaugggguggcuagccuugcgucuggcacaggcugcacugaugggugcagagaggggcuucccaggggcagcaggcccaccuguuccucagucauggucucuccuacgccuuccuccuccaccacaaaggccuccuucaguuucagguacuccucaugcucccgcugggccugcuccucgcgggccuuccucuccuccuccuccuguggacauaggaggcaaaagucagguaucgggggcagaacagggcaggcaccuguucugguugcugcuaccccugcaggacaccagagcauauagcccagccuuuucucagagacagagcuccuucaggacccccauuucuccauucccccaagcugaaccaugggccgaggccccucuugucaucgguuucaucaucaccuggacaaaugcugcucagccccuucucccgcccuccgugcucaggggaucuuagcaaaaaucuguugaaaacccugccaugaccccacucuacaauacccuccaaucaccugccccauccucuccuuguguaacucaccaagcauaccccgucauguccacaccucauaagcaaaugugaacccugcauuuccucaccacccacucacccagucagcccacuccagucuggcuucuguguucccaguucuaugaaacaacuccugccacagucucacccaugcccuccacucaccaaacucaagguacaaccuucaggucucauaugucuguccucucagugauccuucuuuccucccuuggcuuccagaucccacccucuccuggauuuccuccugcuccuugggccauucuucccgccuccuucaucauucagcccugccucuucucucuccuccacauucucugggccaccucgcccaugcccaaagcaucaaccccuuccuugccagugacuaccacacuuguagccccacccgaaucucuucucccaaacacacaacgguccaugugacacagcuacugggccaucucacaggcagcagacagacccugggaccuacucuucuacguuuagaccuccuccuaggucccuggcucugugaauuaacacagccaacuggucagaaaugagguccuauugaccccuucuuucucuaacuuccagaaaacucccuggucugucuauguugcuccaucaccacuacugccugguaaaacagccucccucaacccaacacauuuuccagagcacucagaaaaauuuuuaaauggaaagcuagccgggcgugguggcucacgccuguaaucccagcacuuugggaggccaaggcgggcggaucacgaggucaggagaucgagaccauccuggcuaacacggugaaacccugucuccacuaaaaauacaaaaaaaaaauuagccgggcgugguggugggcgccuguagucccagcuacucgggaggcugaggcaggagaauggcgugaaccugggaggcagagcuugcagugagccgagacugugccacugcacuccagccugggggacagagcgagacuccaucucaaaaacaaaaacaagaaucagaaagcuaaagcugaggcaaguaauauacaagaugagucuggggcaucuugcagugccagaaacuaagugcucaaaaaacaaaacgaguguguguuaaagguacacaggagccaacugaaagggcucccaauggucaaagcuggaacaaucucaacaacguaauaaauaacguuacuggauuauaacacaaaguacaaaauaaauacucaugagucuauacaaauauaaaaaaaauggcuggucgggcacgguggcucacgcugguaaucccaccacuuugggaggcugaggcaggcggaucaccugaggucaggaguucaagaccauccuggccaacauggugaaaccucgucucuacuaaaaauacaaaaauuagcugggugugguggcgggugccuguaaucccagcuacucgagaggcugaggcagcagaaucgcuugaaccugggaagcggagguugcagugagcccagauugcgccacuggacuccagccuggaugacagagugagacuccaucucagaaaaaaaaaaaaaaaaaaaaaagacugcaugaauauuuaaugaauagggaaggagagacauaucuccuguaagagauuuccauauaauuuauguaagaacucuaacuccccaacccuuaagugugggcugugcacagugacuucuuuccaaagaaauacgggaagaggggaaaaaaacagucacauuacaguggagaaagcuggcaaacaaaaccgcagccaggcgaccaagguuaacaacauuagggacaagugaagcggauaacuugcauauuugguauguugcauugaagauggaacuucacuuauugucuucuucagucagauccauaaccccagucuaaccaugagaaaaacaucaaccaaacucaaauuaagggaccuucuacaaacuacuugcccaggacuccucaaaauuguuaaggcuggacacaguggcucacacauguaaucccagcacuuugggaggcugagguggguggaucaccugaagucaagaguucaagaccagccuggccaauacggugaaaccccgccucuaccaaaaauacaaaaauuagccaggugugguggugcacgucugucauccuagcugcuugggaggcugaagcaggagaaucauuugaaaucugaagguggagguugcagugagcuaucgcgccacugcacuccagccuugagagcaagacuguaucucaaaaaaaaaaaaaaaaaagguuaagaucaucaaaagcaaggagucuuagcugggcacaguggugcacaccuguagccccagcuacuagggaggcugaggcaggaggauugcuugagcccaagaguuugaaggugcagugagcacuccagccugggugagagugagacuccaucucucuuaaaaaaaaaaaaaaaaaaaaaaaaaggccgggcacaguggcucaugccuguaaucccagcacuuugggaagccaaggcaggaggaucacaaggucaagagauugagaccauacuggccaacauggugaaacccucucucuacuaaaaauauaaaaauuagcugagcgugguggugcaccuguagucccaccuacucgggagaaugaggcaggagagucacuugaacccaagaggcagagguugcagugagccgagaucgugccacugcacuccagccuggagacagagagggacucugucucaaaaaaaaaaaaaaaaagccuggugcaguggcucacgccuguaaucccagcgcuucgggaggcugagguggguggaucaccugaggucgggaguucgagaccagccugaccaacauagagaaaccccgucucuacuaaaaauacaaaauuagccgggcgugguggcacaugccuguaaucccagcuacuugggaggcugaggcagcagaauugcuugaacccaggagguggagguuguggugagccaagaugaugccacugcacuccagccuaggcaacaagaguggaacuccguuucaaaaaaaaaaaaaaaaaaacaaaacagaaauucugauaaacugucaugacacagaagagccuaaggagacaugaccacuaaauguaacauggcauccuagaugggacccuggaaaagaaaaaggauacugggaaaaaacaaauaaaauaugaauaauggggucaggugugguggcucacaccuguaaucccagcacuuugggaggccaagggaagagaauugcuugagucuaggaauucaaaagcagccugggaaacacggugaaacccaaucucuaccaaaaaaaaaaaaaaaaaauuagccaggcaugguggugcacaccuauagucccagcuacucgcagggacggggaacugaagugggaggauugcuugaggcugggaggcagagguugcagugagccaagaucgugccauugcacuccagccugggcaacggagcaagacccugucuuaaucaaucaauaaagaaaaaucugaauaauguuagaguuuaguuaacaauaaugugucaauauuaguugugaggaagguauuaaagugagguaggacguuaaggauaagggaaacugguuacaggggagaagagccaggauauuuaagguacauuaagcgggaccaauauucagaaaggaaaaaacccucucugcuaaugccucccccaugcuguauucuggcuuaucagccacagcacccacauccaggcuuccugccauccaggauccugggacaacaggucagucagaggucacaggucuucccagcuagggcagcccuggcucuaacccuauguaccccacaucuuuaugguguucucuuuuugggaaaccugguucucagaacaaagaaagcaucuggcaaacaaauguucauuagucacuacugcaguggaccccauucccugagcaccuucuguaugccaggcccucgauguaagaaccaucucuuacaaugaucuuccucagccucaaggccuucaggauccagacccccaucaccucucugccaucuucuccuccucuccuggcuuucucugcccagcuauccuccucgccucgcguuccucacaugcuccccgaaaguucaauagucacgugcacaaaaauccccacuccaggcucugcuuuucagcaguggcuuuucuaggcugugguggagccuagggaccaaauaaaccaggaccugcccuugugccaggucuauggcccaccuucuagguuggaggugccagggagcugcauaagaagcaaggcugccuugccuggucaagggucagaggucaggguaggggcuggccucaccuucugcuccuccuccaggcgaagccgcuccuccuccuucuuccacucagcuucgcgcugggacucgagucguuuccgcuccucacguucagccuccucugccuggagagaggucuucauaggggcacaucccucacccccggcuagagugugcccaccgcccagacagacuagggaaggcaaugccugggccagggcacagacccaggcggcaggagacagagccagggaagcagcaaacaccagcccagcaggcaacaagcccucagucugccuuagggaaaaaggaaggcagugcccuuucgcacuucccagagcugcaccccaucccuccggcuugccucacgcugggccuuucgcgcuuguuucuccuccagcuuccgcaguuucuuagcuccaauuuuccccgacaggugaguuuccgcuggcuucucgacaccuuccuccuccugggcuggguauggucaaagaaagacaguucagguucugaccagagaggacugaugacgauggauccccaaccccucgucccuccccuaacagggggauccccuuccacccaccugcaaaugucacuagcccagcucugcccuccagaggcaucugccaugagugcgugugugugugugcaugaauauguagggaugggagaacggugaggggcccauagggcaagggaaaagaugagaacuuuaggccgggcacgguggcugaagccuguaaucccagcacuuugggaggccgagguggguggaucacaaggucaggagauugagaccauccuggcaaucauggugaaaccccaucucuacuaaaaguacaaaaaagggcugggcacgguggcucaugccuguaaucccagaacuuugggaggcaaaggugggcggaucacgagguuaggagaucgagaucauccuggcuaacauggugaaaccucaucucuacuaaaaauacaaaaaauuagcugggugugguggcgggcaccuguagucccagcuacucaggaggcugaggcaggagaauaaugugaacccaggagccggaacuugcagugagcugagaucacgccacugcacuccaaccugggcgacagagugagacacugucucaggggaaaaaaaaauacaaaaauaauuagccgggcaugguggcgggugccuguagucccagcuacucgggaggcugaggcaggggaauggugugaacccaggaggcggaacuugcagugagcggagaucgcgccacugcacuccauccagccugggcgacagagcgagacucugucucaaaaaaaaaaaaaaaaaaaaaauuagccagguguggugguggccacccguagccccagcuacuagggacgcugaagcaggagaauggcaugaacccagcaggcagagcuugccgagaucugcugccaaguggugugagccgagaucacgccacugcacuccagccugagugacagagcaagacucugucucaaaaaaaaaaaaaaaaagaugagaacuuuagauauugcauagccacaaagaaggagguaucagauuaaaauaugcaagugucucggggucacagauagcgcugccuggauauuuaagguacuguggcugauaagccagaauacagcauaggggaggcauuaggagagaggguuguuuuuuuugguuuuuuuuuuuuugagacggagucucgcucuguugcccaggguggagugcaguggcgcgaucucggcucgcugcaagcaccaccuccuggguucacgccauucuccugccucagccuuccgaguagcuggaacuacaggcgccagccaccaugccccccugauuuuuuuauuuuuauuuuuaguagagaccggguuucaccauguuagccaggauggucucaaucuccugaccucgugauccacccgccucggccucccaaagugcugggauuacaggcgugagccaccaugcccagcccagagaggguuuuuuuuguuuguuuauuuguuuuuggagacggagucucgcucugucgcccaggcuggagugcaguggcgcgaucucggcucacugcaagcuccaccucccggguucauggcauucuccugccucagccucccaaguagcuggaacuacaggcacauaccaucacgcccggcuaauuuuuuguauuguuagccaggauggucucgaucuccugaccucgugauccacccuccuuggccucccaaagugcuggaauuacaggugugagccaccacgcccggcccagagaggguuuuuuaccuuucugaaugcuggucucaccuaauguaccuuaaauauccuggcuaaugaacuccagaguucucuggcuucugucucuggugccaaacccccaggcaagggaagucccaugaggaaauuuaucccgccucaaaucugaaauccuccucacaaucgucaggaguugcugaggauucugggcuuagucccuggccaggauuaucccuuugcccaucaaacccuggcugaaaugacagucccaacacuaugacuaccucagggccagcugcaaguuaaagacccacugaugccugugcagcaagggucucugaacccaagucugagccagaagguacggcaaagaaagggccucuucuugagcuaaagggauaauccccaaagguacaaggcaaaagccucaaaugcccccaguuucugagaaacgcccagacgcccccuccucaggcucaagccagcugccaaguacuggagaagacaauccugagggcucuccuggucuccuggaagcagggauauggaggccucugugucaacagaaugucucuaucuuuaaacuguuuuccugggguugugggugaccccacuccaggaacugcagaaacucuuggccaggcacucugccucuagggugaaauccucagggaauaagugugcccauaacaggaagggugcgaggauagaaggggugaauugaggaacauucugaaucaaacugaagacccuugcccucugcuuggacacugagagccaagaugaagguaggggggguugacccaguggaacaaaugccaggucccaagucccccccuacucuaccguguggcucccagacgucccuccuacccugaggcuucauacccuacucccccacuuagcuuugggggcccuuuuaucccccccuccaacccaaacccucuccccaccaggcugggccccucucaccuaggaugacagcuuccuccucguucucaucugcuucugcccaggccacccgcugggcucgacgcugggccuguaggcggcugcccaggucccuccggcgccgaggccugccuccagcucucggcuccucaggcuccaggggcccaggcugggccacccggccugcuccugccagcuccucauugugcaguggcucuuggccggcuguagggaagacagaaaugacaaugcugccuauaagcccagcccggcccauggcaggaggagcggcagcccggaagccucaccuccucugcuuagcggccugcugcccacagcacaaggccccgacuucucagucugacuggcaaggccuuuuccaccaggcccacagcuuggucccaggcgggggcucagcccuucccucgggccugugugaauacuccucuccccucccggcuccaccuuuccagcuggccugucaggaggccccuauccugauguccccagcucucaucgaguacccccugcaggaauccacugauuucucgccuaacaccaccugugguuuuaucuggcuccccagccagagaguacacuucccggcgguggccgagccucccccgggaagaccugcuggaucuccgccuucccucagcgugucccuuccgcuccugggagcgcgcaggugcucagagguagcuugugggcccagggagcaggaaaacacauauacaaacccgcccgcugaccagaaauggggggaaagagggaggauggguguaucuguucugugcccuggccaaugacauggccuucugaucggggagcggauuggggagggagagugggcccucuccuuggcgggaagggagagagcuucaggaauuuccuggagccgccucgcgcuucuccagcucgugggggacaggcagaaaauauucagaugcccccuuccuggcaccugcucuggagccaggcugggaggaauggaaaaccccugcggccucccuaacaggugcagagggaaagggccccgacggugacggaugggagugugcgccggccagggccucaggccuuuggagguauggaguucccgggggugaagagagggaugaggccagacucuggcuuggagucgagagaaagggguagcggcgcggccaccgauuccagguagggcacugcggaagccccacccggcacacgacuagcgcacggacgcgcaugcgucccgcccgcccaggugcgcacgcgcaggagccgcggcgcgacgguccacaaaggcucagaaggccagaaaacccgguaccaccaacccuggugcagcggcaucuccuaccugaugccgcccggccccggcugcgagucaggaagaggauaaagccgacuagcagagccgccgcuaccaaguaccacacaggcgccaccaugacgagggccucagugcagaac

SEQ ID NO: 191240 - RNA, 14284 nt, Homo sapiens
guucugcacugaggcccucgucaugguggcgccugugugguacuugguagcggcggcucugcuagucggcuuuauccucuuccugacucgcagccggggccgggcggcaucagguaggagaugccgcugcaccaggguuggugguaccggguuuucuggccuucugagccuuuguggaccgucgcgccgcggcuccugcgcgugcgcaccugggcgggcgggacgcaugcgcguccgugcgcuagucgugugccggguggggcuuccgcagugcccuaccuggaaucgguggccgcgccgcuaccccuuucucucgacuccaagccagagucuggccucaucccucucuucacccccgggaacuccauaccuccaaaggccugaggcccuggccggcgcacacucccauccgucaccgucggggcccuuucccucugcaccuguuagggaggccgcagggguuuuccauuccucccagccuggcuccagagcaggugccaggaagggggcaucugaauauuuucugccugucccccacgagcuggagaagcgcgaggcggcuccaggaaauuccugaagcucucucccuucccgccaaggagagggcccacucucccuccccaauccgcuccccgaucagaaggccaugucauuggccagggcacagaacagauacacccauccucccucuuuccccccauuucuggucagcgggcggguuuguauauguguuuuccugcucccugggcccacaagcuaccucugagcaccugcgcgcucccaggagcggaagggacacgcugagggaaggcggagauccagcaggucuucccgggggaggcucggccaccgccgggaaguguacucucuggcuggggagccagauaaaaccacaggugguguuaggcgagaaaucaguggauuccugcaggggguacucgaugagagcuggggacaucaggauaggggccuccugacaggccagcuggaaagguggagccgggaggggagaggaguauucacacaggcccgagggaagggcugagcccccgccugggaccaagcugugggccugguggaaaaggccuugccagucagacugagaagucggggccuugugcugugggcagcaggccgcuaagcagaggaggugaggcuuccgggcugccgcuccuccugccaugggccgggcugggcuuauaggcagcauugucauuucugucuucccuacagccggccaagagccacugcacaaugaggagcuggcaggagcaggccggguggcccagccugggccccuggagccugaggagccgagagcuggaggcaggccucggcgccggagggaccugggcagccgccuacaggcccagcgucgagcccagcggguggccugggcagaagcagaugagaacgaggaggaagcugucauccuaggugagaggggcccagccugguggggagaggguuuggguuggagggggggauaaaagggcccccaaagcuaagugggggaguaggguaugaagccucaggguaggagggacgucugggagccacacgguagaguagggggggacuugggaccuggcauuuguuccacugggucaacccccccuaccuucaucuuggcucucaguguccaagcagagggcaagggucuucaguuugauucagaauguuccucaauucaccccuucuauccucgcacccuuccuguuaugggcacacuuauucccugaggauuucacccuagaggcagagugccuggccaagaguuucugcaguuccuggaguggggucacccacaaccccaggaaaacaguuuaaagauagagacauucuguugacacagaggccuccauaucccugcuuccaggagaccaggagagcccucaggauugucuucuccaguacuuggcagcuggcuugagccugaggagggggcgucugggcguuucucagaaacugggggcauuugaggcuuuugccuuguaccuuuggggauuaucccuuuagcucaagaagaggcccuuucuuugccguaccuucuggcucagacuuggguucagagacccuugcugcacaggcaucagugggucuuuaacuugcagcuggcccugagguagucauaguguugggacugucauuucagccaggguuugaugggcaaagggauaauccuggccagggacuaagcccagaauccucagcaacuccugacgauugugaggaggauuucagauuugaggcgggauaaauuuccucaugggacuucccuugccuggggguuuggcaccagagacagaagccagagaacucuggaguucauuagccaggauauuuaagguacauuaggugagaccagcauucagaaagguaaaaaacccucucugggccgggcgugguggcucacaccuguaauuccagcacuuugggaggccaaggaggguggaucacgaggucaggagaucgagaccauccuggcuaacaauacaaaaaauuagccgggcgugaugguaugugccuguaguuccagcuacuugggaggcugaggcaggagaaugccaugaacccgggagguggagcuugcagugagccgagaucgcgccacugcacuccagccugggcgacagagcgagacuccgucuccaaaaacaaauaaacaaacaaaaaaaacccucucugggcugggcaugguggcucacgccuguaaucccagcacuuugggaggccgaggcggguggaucacgaggucaggagauugagaccauccuggcuaacauggugaaacccggucucuacuaaaaauaaaaauaaaaaaaucaggggggcaugguggcuggcgccuguaguuccagcuacucggaaggcugaggcaggagaauggcgugaacccaggagguggugcuugcagcgagccgagaucgcgccacugcacuccacccugggcaacagagcgagacuccgucucaaaaaaaaaaaaaccaaaaaaaacaacccucucuccuaaugccuccccuaugcuguauucuggcuuaucagccacaguaccuuaaauauccaggcagcgcuaucugugaccccgagacacuugcauauuuuaaucugauaccuccuucuuuguggcuaugcaauaucuaaaguucucaucuuuuuuuuuuuuuuuuugagacagagucuugcucugucacucaggcuggagugcaguggcgugaucucggcucacaccacuuggcagcagaucucggcaagcucugccugcuggguucaugccauucuccugcuucagcgucccuaguagcuggggcuacggguggccaccaccacaccuggcuaauuuuuuuuuuuuuuuuuuuuuugagacagagucucgcucugucgcccaggcuggauggagugcaguggcgcgaucuccgcucacugcaaguuccgccuccuggguucacaccauuccccugccucagccucccgaguagcugggacuacaggcacccgccaccaugcccggcuaauuauuuuuguauuuuuuuuuccccugagacagugucucacucugucgcccagguuggagugcaguggcgugaucucagcucacugcaaguuccggcuccuggguucacauuauucuccugccucagccuccugaguagcugggacuacaggugcccgccaccacacccagcuaauuuuuuguauuuuuaguagagaugagguuucaccauguuagccaggaugaucucgaucuccuaaccucgugauccgcccaccuuugccucccaaaguucugggauuacaggcaugagccaccgugcccagcccuuuuuuguacuuuuaguagagaugggguuucaccaugauugccaggauggucucaaucuccugaccuugugauccacccaccucggccucccaaagugcugggauuacaggcuucagccaccgugcccggccuaaaguucucaucuuuucccuugcccuaugggccccucaccguucucccaucccuacauauucaugcacacacacacacgcacucauggcagaugccucuggagggcagagcugggcuagugacauuugcagguggguggaaggggaucccccuguuaggggagggacgagggguuggggauccaucgucaucaguccucucuggucagaaccugaacugucuuucuuugaccauacccagcccaggaggaggaaggugucgagaagccagcggaaacucaccugucggggaaaauuggagcuaagaaacugcggaagcuggaggagaaacaagcgcgaaaggcccagcgugaggcaagccggagggauggggugcagcucugggaagugcgaaagggcacugccuuccuuuuucccuaaggcagacugagggcuuguugccugcugggcugguguuugcugcuucccuggcucugucuccugccgccugggucugugcccuggcccaggcauugccuucccuagucugucugggcggugggcacacucuagccgggggugagggaugugccccuaugaagaccucucuccaggcagaggaggcugaacgugaggagcggaaacgacucgagucccagcgcgaagcugaguggaagaaggaggaggagcggcuucgccuggaggaggagcagaaggugaggccagccccuacccugaccucugacccuugaccaggcaaggcagccuugcuucuuaugcagcucccuggcaccuccaaccuagaaggugggccauagaccuggcacaagggcagguccugguuuauuuggucccuaggcuccaccacagccuagaaaagccacugcugaaaagcagagccuggaguggggauuuuugugcacgugacuauugaacuuucggggagcaugugaggaacgcgaggcgaggaggauagcugggcagagaaagccaggagaggaggagaagauggcagagaggugaugggggucuggauccugaaggccuugaggcugaggaagaucauuguaagagaugguucuuacaucgagggccuggcauacagaaggugcucagggaaugggguccacugcaguagugacuaaugaacauuuguuugccagaugcuuucuuuguucugagaaccagguuucccaaaaagagaacaccauaaagaugugggguacauaggguuagagccagggcugcccuagcugggaagaccugugaccucugacugaccuguugucccaggauccuggauggcaggaagccuggaugugggugcuguggcugauaagccagaauacagcaugggggaggcauuagcagagaggguuuuuuccuuucugaauauuggucccgcuuaauguaccuuaaauauccuggcucuucuccccuguaaccaguuucccuuauccuuaacguccuaccucacuuuaauaccuuccucacaacuaauauugacacauuauuguuaacuaaacucuaacauuauucagauuuuucuuuauugauugauuaagacagggucuugcuccguugcccaggcuggagugcaauggcacgaucuuggcucacugcaaccucugccucccagccucaagcaauccucccacuucaguuccccgucccugcgaguagcugggacuauaggugugcaccaccaugccuggcuaauuuuuuuuuuuuuuuuuugguagagauuggguuucaccguguuucccaggcugcuuuugaauuccuagacucaagcaauucucuucccuuggccucccaaagugcugggauuacaggugugagccaccacaccugaccccauuauucauauuuuauuuguuuuuucccaguauccuuuuucuuuuccagggucccaucuaggaugccauguuacauuuaguggucaugucuccuuaggcucuucugugucaugacaguuuaucagaauuucuguuuuguuuuuuuuuuuuuuuuuuugaaacggaguuccacucuuguugccuaggcuggagugcaguggcaucaucuuggcucaccacaaccuccaccuccuggguucaagcaauucugcugccucagccucccaaguagcugggauuacaggcaugugccaccacgcccggcuaauuuuguauuuuuaguagagacgggguuucucuauguuggucaggcuggucucgaacucccgaccucaggugauccacccaccucagccucccgaagcgcugggauuacaggcgugagccacugcaccaggcuuuuuuuuuuuuuuuuugagacagagucccucucugucuccaggcuggagugcaguggcacgaucucggcucacugcaaccucugccucuuggguucaagugacucuccugccucauucucccgaguaggugggacuacaggugcaccaccacgcucagcuaauuuuuauauuuuuaguagagagaggguuucaccauguuggccaguauggucucaaucucuugaccuugugauccuccugccuuggcuucccaaagugcugggauuacaggcaugagccacugugcccggccuuuuuuuuuuuuuuuuuuuuuuuuuaagagagauggagucucacucucacccaggcuggagugcucacugcaccuucaaacucuugggcucaagcaauccuccugccucagccucccuaguagcuggggcuacaggugugcaccacugugcccagcuaagacuccuugcuuuugaugaucuuaaccuuuuuuuuuuuuuuuuuugagauacagucuugcucucaaggcuggagugcaguggcgcgauagcucacugcaaccuccaccuucagauuucaaaugauucuccugcuucagccucccaagcagcuaggaugacagacgugcaccaccacaccuggcuaauuuuuguauuuuugguagaggcgggguuucaccguauuggccaggcuggucuugaacucuugacuucaggugauccacccaccucagccucccaaagugcugggauuacaugugugagccacuguguccagccuuaacaauuuugaggaguccugggcaaguaguuuguagaaggucccuuaauuugaguuugguugauguuuuucucaugguuagacugggguuauggaucugacugaagaagacaauaagugaaguuccaucuucaaugcaacauaccaaauaugcaaguuauccgcuucacuugucccuaauguuguuaaccuuggucgccuggcugcgguuuuguuugccagcuuucuccacuguaaugugacuguuuuuuuccccucuucccguauuucuuuggaaagaagucacugugcacagcccacacuuaaggguuggggaguuagaguucuuacauaaauuauauggaaaucucuuacaggagauaugucucuccuucccuauucauuaaauauucaugcagucuuuuuuuuuuuuuuuuuuuuuucugagauggagucucacucugucauccaggcuggaguccaguggcgcaaucugggcucacugcaaccuccgcuucccagguucaagcgauucugcugccucagccucucgaguagcugggauuacaggcacccgccaccacacccagcuaauuuuuguauuuuuaguagagacgagguuucaccauguuggccaggauggucuugaacuccugaccucaggugauccgccugccucagccucccaaaguggugggauuaccagcgugagccaccgugcccgaccagccauuuuuuuuauauuuguauagacucaugaguauuuauuuuguacuuuguguuauaauccaguaacguuauuuauuacguuguugagauuguuccagcuuugaccauugggagcccuuucaguuggcuccuguguaccuuuaacacacacucguuuuguuuuuugagcacuuaguuucuggcacugcaagaugccccagacucaucuuguauauuacuugccucagcuuuagcuuucugauucuuguuuuuguuuuugagauggagucucgcucugucccccaggcuggagugcaguggcacagucucggcucacugcaagcucugccucccagguucacgccauucuccugccucagccucccgaguagcugggacuacaggcgcccaccaccacgcccggcuaauuuuuuuuuuguauuuuuaguggagacaggguuucaccguguuagccaggauggucucgaucuccugaccucgugauccgcccgccuuggccucccaaagugcugggauuacaggcgugagccaccacgcccggcuagcuuuccauuuaaaaauuuuucugagugcucuggaaaauguguuggguugagggaggcuguuuuaccaggcaguaguggugauggagcaacauagacagaccagggaguuuucuggaaguuagagaaagaaggggucaauaggaccucauuucugaccaguuggcuguguuaauucacagagccagggaccuaggaggaggucuaaacguagaagaguaggucccagggucugucugcugccugugagauggcccaguagcugugucacauggaccguuguguguuugggagaagagauucggguggggcuacaagugugguagucacuggcaaggaagggguugaugcuuugggcaugggcgagguggcccagagaauguggaggagagagaagaggcagggcugaaugaugaaggaggcgggaagaauggcccaaggagcaggaggaaauccaggagagggugggaucuggaagccaagggaggaaagaaggaucacugagaggacagacauaugagaccugaagguuguaccuugaguuuggugaguggagggcaugggugagacuguggcaggaguuguuucauagaacugggaacacagaagccagacuggagugggcugacugggugaguggguggugaggaaaugcaggguucacauuugcuuaugagguguggacaugacgggguaugcuuggugaguuacacaaggagaggauggggcaggugauuggaggguauuguagaguggggucauggcaggguuuucaacagauuuuugcuaagauccccugagcacggagggcgggagaaggggcugagcagcauuuguccaggugaugaugaaaccgaugacaagaggggccucggcccaugguucagcuugggggaauggagaaauggggguccugaaggagcucugucucugagaaaaggcugggcuauaugcucugguguccugcagggguagcagcaaccagaacaggugccugcccuguucugcccccgauaccugacuuuugccuccuauguccacaggaggaggaggagaggaaggcccgcgaggagcaggcccagcgggagcaugaggaguaccugaaacugaaggaggccuuugugguggaggaggaaggcguaggagagaccaugacugaggaacaggugggccugcugccccugggaagccccucucugcacccaucagugcagccugugccagacgcaaggcuagccaccccaucccagacgccccuggccaggcagugagaggugggugggcaucaguaccagcaggcuuuaguggccagaggccuuguccucagcagaggcuggugccuccgaaacucucacccuggaaggcucugcugcuuguguaggcaagcgguaugugcaggugguugggcgggccaaaggcaggcugcaggcagguggcccucaagugagcaggugguacuugggugaauggguacagaacccugugggcuugcuagggggugcucacccugauuucucugcuucucuagucccagagcuuccugacagaguucaucaacuacaucaagguaagaagccacugaacagagccugagugucagcucccugccuggcaugugcagguuggaugccuccagcgggggcugcaggcagggcauucaggcucaugcaggaguggacaggggggcccagaggggcagagccgcaggguccuggccaggagaguuucucucccuccaaccccgaagguggagaaggaccugggucugugugggaggcgcaagccuuugaucacuuccucacacucaguuugacaguuucccugcucuucagaccccacgcucagugagucaguguguuuucaagucucuucacauguguuuucugucaguucugucacacugaggcuccacugaguugaaacaagcauccucugccaugugcuccugacugggaacuugggucuuucagggggaacaggaugguguuuccuuuggaguuuaggguggggcggcaguguguccccuucuguccgcagccacugcgcaggccgccucgaugcugcuccagguugcauaagcacauccuacuuugcuuugcugcuaagcaacuucucucccacgaaggaugccaugaggggagagguuuucaagugcaacucagaggugcagaggcggcugagggaaggagugcagagggagcgggggcgguggugggggugcuaccaggggcugccaaggacccagggcuugcauaauccucccgccaccucuccugaaagagagcaggguuuagacgccugccagcagcgaggggcugggcucacagccuugagucugggguucuuaagugggggaaaugcuggcagcuuugagaggguccugucuguucaggcugugugcacuccccucucauggagcccucucucuacccuggcacacuugauuaggggcuguggccgggcagguuauuucucacacuugccugcugcuguuuggaacuuguccccaccuacccaguaggcaguaagaugguccugaagccccuccccaggaagccuucccagguggaauuagaggagggggucagcuucaacaucccccuuuacucugcagaaaccagaagaaagguccccaguucuagcccucacuuuugguggcucccuggagguaacuauucucugggaguucuccaaacucuuuuggagcuuagaaguuuuuccagcuuguccgggcaugguggcucacgccugcaaucccagcacuuugagaggccgaggcgggcagaucacuugaggucaggaguuugagacuagccugggcaacaugcugaaaccccaucucugcuaaaaauacaaaaauuagccaggcaugguggugcacaccuguagucccagcuacucaggaggcugaggcaggagaaucacuugaacccaggagguggagguugcagugaggcaagauggugccacugcacuccagccugggcgacagagugagacucugucucaaaaaaaaaagaaaaaaaguuuuuccagccugugcuggcuaauucuucuagagcugcugucuugcaaggaaaaggaggacuucugaaauucagucugucugcuuuccuccuugcuccaaggggauagaccuuuuuugccuuaagauuucagaacuggaggaacaugccugcacccagcaucguuuaugagagguguaggguucacucgaucuuguuccauucuccugucugaccauggcugggcucaggcgaucuuccugccucugccuccugaguagcugagauugcaggugggugccaccacaccuagcuuguuuuaucaaacguguuuuggccccagcagcaccucaggccaggucaucagggagcaccuggggugacuucauguucucgcaccacacugucacugagagcccgcugccugaucccuguuuuguagguagagaccagcugaccacgucacuuuguccuugcccauccugacccagcugccucucgcuugccuucuugcuuguacauacggcuuuggcauuucaaacaagucacaugcuaucugcagucagggaggugucaccaugucaguccucccccagcucauuugcgguggaggauucacagaaaugcaaaagaacugccuuuucucaaguccugugcuguguguugggguagugggggcaggugccuguguggacacagcgguggacccuucgcugcgcccuugggaacucagguuucuacugaggguaugaagaagcacuuggagcacagaacguggcugugcuggaaagcacucagcgguauuagugacagugauuucaagggugggcucagugccucagaugguauaaagaggauggauaaaaagugugggugugucagguugugggggaccaggccaguggggcggccagcgaaggcaaggcaggagugggcccccacagccucuacugagagaccuuggcuugcucgggcuuuuaucugcucucccucuuguccauguacucaccugucucaccagccggacugcgagcuccagggcggggacuauggcuuguucagcaugugucccuccuaccuucucagggccuuguucuaguagguccucagcaagcauaaguccuggugacaguuauuuaaaauagcuuuuggugacucucaccgccuccuuccucccuauggugcguccccuugaacuuguccaugauguuaaaaagagauggcuggaugcagaggaugguggcugcugugcucugauuaccacucgugugucucggaguccaggacagggcccaugaggcaggugguuguuuuggguagauuccuuccucgcaagaaggggaaugagaggguuuaugauugugcgggucucugucaaugggugauagugagugugugugugugugugugugugugugucaggggagcaaggcuguccuacaggaguguguacaguguuuuuccagccaccgagaacagaucagaucagaaugcaaaccuggagggugcccaugcuuagagggauuugcccaagcucagccucucuuucuuuuccuccuucuuuuuguagcaguccaagguugugcucuuggaagaccuggcuucccaggugggccuacgcacucagguaagcccuggaacguggccugcugugugcaguguggccaggggucuguggcuagcagagaggaccugcccuaaagauagagucuugaugcaccgucuaccuuguccccaaccaagagugaguagugcacagaagucuccuggcacccugggaauccugcauuuuuaauggacgaacaggcaggaaagaaaaaaaaaacccaaaccccaucacucugccagccccugugaccaaagcagcccaaaucaguuaccuugacaacucucaugcacagacugcaccagccuguguugcaaacaucacugccccgcuucuaacaggaagagauacucuuuugggggucuugcagggcccaggaccagagccccuucuacccagggcccuuccaaaggcaaagcacagagucacauuugggcguggcaugagagggaaauaaagagauuuggcuguagugggagggagguuucagugcuuuuucuggggacauuggugccuaucucuauucugagaguuguucuccucauaggacaccauaaaucgcauccaggaccugcuggcugaggggacuauaacaggugagaugaugagagccaaucacugcaguccuggccuuggagagugucuagccacaggggcugcagggaugugcugcagaggcaggaugaccacccaagauggggggaggggugugcaaggaggggcacugaguagcuggaugcaguuacaaggaggacaugccagggccuggagguggcagcagugggagaggacaggcagggcagccugauucgacucuccuagcaggacuggaugcagccaggaaaguccaggcaggcaggaggccggaagggcccugagccagcugugaaggaguaggugggcauucucaggccagauggggaacgcccaggaggccucagccccacaaccugcauguccccacaggugugauugacgaccggggcaaguucaucuacauaaccccagaggaacuggccgccguggccaacuucauccgacagcggggccggguguccaucgccgagcuugcccaagccagcaacucccucaucgccuggggccgggaguccccugcccaagccccagccugaccccaguccuucccucuuggacucagaguugguguggccuaccuggcuauacaucuucaucccuccccaccauccuggggaagugaugguguggccaggcaguuauagauuaaaggccugugaguacugcugagcuugguguggcuugguguggcagaaggccuggccuaggauccuagauaagcaggugaaauuuaggcuucagaauauauccgagagguggggagggucccuuggaagcuggugaaguccuguucuuauuaugaauccauucauucaagaaaaua

SEQ ID NO: 191241 - RNA, 144886 nt, Homo sapiens
acagccccgccccgcacggccaggcgaagcggagccggccgugcgguguguguguauguguucgcggggcgccgucucagccccgggaagaugguggcugcagcggcggcaacugaggcaaggcugaggaggaggacggcggcgacggcagcgcucgcgggcaggagcggcgggccgcacugggacugggacgugaccagggcugggaggccggggcugggggccgggcugcgccucccgcggcugcugucuccaccgcugcggccacggcugcugcugcugcuguuguugcucucgccgccgcugcugcugcugcugcugcccugugaggccgaggccgcggcggcggcggcggcggugucgggcucagccgcagccgaggccaaggaaugugaccggcccugugucaacggcggucgcugcaacccuggcaccggccagugcgucugccccgccggcugggugggcgagcaaugccagcacugcgggggccgcuucaggugaguggcggguggugucggagggucggguccaaccagaggcuggggcugaggggcguucgagacggcuccaggucagagggagaugcuggacagaaaguggagaggguagggccgcccuaugggguuugagggccauuugcuuccggggagaucaucgucucuggccuggggucuuucucuguuggaaggugaaaagguguggggcaagggugggggcaccccgacgguauuugggugcuuagguuaguuagaugggaagaaugcugagggacccaaagagcaucaaagccgaucgcucuaaaacucggcguguuucagcuaaacgagguauccaaggaaagguggucgagccagguuugcuugaacacuuccuuuuaacauccacaugugcccuaggacccgaugaguuccccgaugcacuggagauguggggugcucugaagaaacagggcccuggaaaugcuuuguuggcuggagauaaaagggaaaggguagcauuguaagauauuagggauagaaggaccagugguccuucuaaaggaaagugaggaaacuagccuuuuggcaaaagcucccuggagguggcaaauuggaauagggucuguggugaagagggaauggaaggagauuccuauuugccuugguuucuggacaauaugaaguucugaauuggcuuaguuuggggcaguuccucuuggagaaaucaauaaauuaauuagcaguuaucguuauuugcuucaguugugcaaugauuuuccagauaauacagacagauuagccagacuuuggccuuguccacagggaguuuggaauauagcaagagaaagauaaugugcgcacauaacccuagucauaaggguuacagagucauucacgccuuugacagguauuuagcuuacugaacacaugucugaugugggggaguggggaaaugugaacaagacagacagggccucugcucucauugaccuuaacauucuagugggagcaacaggcacuuaacaaguaaauaaaugagagaaauaaacaugguaauuucagguaaugguaaaugcuaucaagaaaauaaaaacagcguggucugauagagaauuauaaccgguggugacucuuggagaggguucucauuugaaaugacauuugaucugagaccugaaugaggcaacagggaacuugugggaauucagggauggagagguuguggcuagcuggagggaugcaaggaggacuuugaggaggcgguaacauuggauuugagcauguaagguuaaguaggauuuggaaauguggagcuggaaaaaaauuacagauggaaagaagggugcaaacaaaguuguggaggcuggaaaguaaaguuuugcugcugccuauguggaagagaguugugagagaggaguuuggaauagcaaaauuguagacuuagguaauauuaggucuucugaggaacucagagaacguugagcagaugagcucuuuaguuuuauggauggagaaaccaaguuacuucaggaccacugaugcagugaagcugcuuuuguaacuuaggguguucugauuuaugaauuccauuaaccuacauguauuuguugagggcuccuauguuuuagguugugagauacagugguauacaagacaggcacaguccugcucuuacggagcucacauuucagcuugggaguaaaaaaauccaacaaaaauuuuauuguaauuuuguuuaaggcuguggagguaaagagcaggagacaaacagaggacuugacuuagucuagggguaagguaagucacugaggaagcgaugugaagucugaggggugagaugguacuaccugcgugagggguggggugcugaggggccagcagguacagaggcuugggguugaagcggauggaaggccagguggcaggagcagagagagcaaaggggagcuuggcaagacuggagagaaaggcgggaagccaggccaaguggagaucuguggguuggauugagaauuuugaccuuuagcccaagagcugugaaauggcguaguucacgccuauuuucaugacauuauaggcuuuuagauuggagccagaauacaaauggccuugaaggugaggccagggcauuuuccauuugagaagcuuccaaggucaggugaauggaugguugagucagacgaggauccuucaaguucugaaaaccugggacacugugguaggcaguggggaccagcggugugggaaggggacuucauagcaagaucaaucuguaauguucagaguagguacacucacuuugggcaugagagauagggggcagcuaggugggaucuguuggcaugggucagagcagugguaaugagagcuuguagaggugaaauggacaagucuuccguguaaacugguuugcucuuggaaaggugggggauggugagggaaagaaaacuagauccugucuugggugguugagaggacagugauaccauuaacagacacagggacacaggagcagguguuagacauuuaauugcaugcaugcugaguuuggggugcucucagaguacacaccuggcagauguuaaguuuggagucaucgaccuaugagggagauugccagggagcucucucugagaguccacauggaaagcccagaggauuggauaagagcuacuuguugcagggaacaggcaguccugacacugguugucucaaauagugucacaggugagugaagggacuccccugcuuauuguggacauucccuuugagcugauucuaggugaugucagugcuguuuccuggguagacaauuaugacuuugguccugaugauaccauuauauuuugugggcuuugggauuuugcauuuuuaaaaaugaaaguaggaggaacuuaugacucuggucuuuuaaaaaaaacucaguaggccaggcgugguggcuaacaccuguaaucccagcacuuugggaggccgaggcgguguaucacgaggucaggagaucgagaccauccuggcuaacuuggugaaaccccgucuccacuaaaaauacaaaaaauuagccgggcgugguggcgggcaccuguagucccagcuacucgggaggcugaggcaggagaauggcgugaacccgggaggcagagcuugcagugagccgagaucgcaccacugcacuccagccugggugacagagcgagaguccaucucaaaacaacaacaacaacaacaaaaacucaauaaaauuuuagucgaggccaagcgcggugacucacgccuguaaucccagcacuuugggaggcugaggcgggcagaucaagagguuaggaguugagaccagccuggccaacauagugaauccccgucucuacuaaaaauacaaaaaauuaccugggcaugguggcaggcgccugugaucccagcuacucgggaggcugaggcaggagaauugcuugaacccgggaagcggagguugcagagagccgagauugcgccauugcacuccagaccaggcgagggugugagacuccaucucaaaaaaaaaaaaaaaaaaaaaaauuuaguccaaguauucuuuugggggcaagagugaaauguugguuuugauugcaguggcuuguaucuugauugaacuuacaaaccucuuuguuauuaaaagacauuaaaugaauaccuuucugauuuagaauggcaucaaguuggaguguuuuuugagcuuuuuaguccuguaaauccuguguuauaauugccguuauaggguuuuuucauuaauugaagggaacguaggcuaacgaggaguggauuucccuaagguuaucacugagugcagacuaugugccacagagcauuuucauguacauuguauuauuuaauccucaggacaacucugaggguguuauauaaaauuuagauuauugaauuauuguaguuaguaacauuuuuucuaaauaaaagaugacauagaaaugacugauuuuaaaggauaaguuaaaggaugucaguuuaauaaaaauaccuauagaaucuuuggugugugauuucuaaggcaguaccacuuucguucauucuuaugugaaucuucauaauucagugaucauuuuuuucuacuuguaaggucaccaguguaauuuuucuucgaaggauaaauaugcccauaggauaaauuaagcucauuuuugaauuuaauauucauucaauucuuuuaaguuccugcuguagaaaauguuugggagaauugaauagaauaaucuggugaauuggauugagccugauaauguuaagauguaccuucuguagaaaaaaaaagaaaggaacuaagcacuuaucagacaucuguuuugugcccagcacauacaguaauaauaguggguggguguaguagcucacaccuguaaucccaacacuuugggaggcagaggcagaagaaucacuugagcccaggaguuugagaccaaccugggcaacaaagugagagcuccucacuaccaaaaaaaagaaaguuagcuggguguguuggcaugugccuguggucccagcuacaugggaggcugaugcaggaggauggcuugagcccaggagguugaggcugcagugagccauaaucaugccacugcauuccauccugggcaacaaagcgagacccuugucacaaaaaaacaaagcaaaacaaaaaauauguauauagugccaacugccuauuagaaauaacucccuuuuaguccuuagagugaaguuauucccauuucacagaugaguaaacuuggauguacugaauaacuuguccaaggucacagaaguugugcaaaauugagauuugaacucaggguugucuaaugcccaaaccuguguucuuuuuauuauaccauuuggcgucucauuuuuuucugaguccagucacucuuuauggacguucuuugaaggacugaccuaauuccaacaaacauuuugagaaauaaaggaaggaaaauagauuuuuacaauaggaaagcuaacauuuuaaaaaucuuaaauucacuucagucucucuggcugacgaucugaggacauaaauaccuuuuuaacuaaugaaaugaaaauucuugccugggcgcaguggcucacgccuguaaucccagcacuuugggaggcugaggcgggcggaucgccugaggucaggaguucgagacuagccugaccaacauggugaaaccccgucuccacuaaaaauucaaaaaauuagccaggcaugguggcgagcgccuguaaucccagcuacucaggaggcugaggcaggagaaucgcucaaauccaggaggcagagguugcagugagccgagauugugccauugcacuccagccuggacaacaaaagcaaaacucugucucgaaagaaagaaagaaaauucuugaaaacaaaaugugaagaagugaaaaguuaaaacuuuuuucuuauaguaauuacuaagugaugucaaccucaagcccuaaauuuauguucacaaguccaguuuaggcugaucugcuuuccccagugcaauguaaguuccaugagggcaggggccuggagcauaguucacaaguccaguuuaggcugaucugcuuuccccagugcaauguaaguuccaugagggcaggggccuggagcauaguucacaaguccaguuuaggcugaucugcuuuccccagugcaauguaaguuccaugagggcaggggcccagagcauaguucacaaguccaguuuaggcugaucuguuuuccccagugcaauguaaguuccaugagggcaggggccuggagcauaguucacaaguccaguuuaggcugaucuguuuuccccagugcaauguaaguuccaugagggcaggggccuggagcauaguucacaaguccaguuuaggcugaucugcuuuccccagugcaauguaaguuccaugagggcaggggccuggagcauaguucacaaguccaguuuaggcugaucuguuuuccccagugcaauguaaguuccaugagggcaggggccuggagcauaguucacaaguccaguuuaggcugaucugcuuuccccagugcaauguaaguuccaugagggcaggggccuggagcauaguucacaaguccaguuuaggcugaucugcuuuccccaguacaauguaaguuccaugagggcaggggccuggagcauaguucacaaguccaguuuaggcugaucugcuuuccccagugcaauguaaguuccaugagggcaggggccuggagcauagugagcaguaaauaucuguugaaugaaggaauaaaauucuguaauuuacuucuuaugacuuuuaaaaaagucgucuuuacccacaugacugccauauaugucuucuguccuuauauugcuccugaacuucucugucauccacuguuuggugggcaucuuuuauugucaccucauacugaaucauguauaacaccaaacuucuauccucauugaaaaaaauagucuuuuucuuuguacuuccuuauuuguuuuagcuaaauccaaauuuagcuaaccaaaggucaaaacuuagcaguaaucuuuggcucuuucuaccuguuuguuuuuuucugcucucacacuguauaaauuuguuucuuuccauuucuucugcugccauucuaauguaccuaacccuucaccucauugcugaccugcuucuguugcacuuuuacuguuuucuuacaccugcagagucugcuucacacuuugucauaucagucuucuaaaaaacaugugucucuaugcacacguauguuuauugcagcacuauucacaauagcaaagacuuggaaccaaccacugaugggcuauccagcccaucagugauagacuggauaaagaaaauguggcacauauacaccguggaauacugugcagccauaaaaaauggugaguucauguucuuugcagggacauggaugaagcuggaaaccaucauucuuagcaaacuaacacaggaacagaaaaccaaacaccgcauguucucacucguaagugggagcagggaggggaacaucacacacuggggcuuucgguggguagggggauaggggagggauagcauuaggagaaauagcuaauguagaguauggguugaugggugcaguaaaccacuguggcacguguaugucuguguaacaaaucugcacguucugcacauauaucccagaacuuaaaguguaauaaaaaacaaaaacaugugucucuuauuuugcuucuuuuauuaccucuaaaaugauccucagcagaaggaucccauuccuuucacaucccuuuuuuuccuaaccaaaucuuucuacuucguaguuuuucuguguuugcuaaauucagcaccucccuccucacugcucccccauucuuucuuuucaucucuacuuaccaaggcccaccuucaguucucuauaaucuauaauucauacccuuuuuuuuuuuuuuuuuuuugagagacaaggucuuauucugucaucuaggcuggagggcagugcuccugggcucaagugauccugccaccucagccucccaaguggcugggaucacaggccagugugcccagccaauuuuuaaauuuuuuguagagaugaggucucacuauguugcccaggccaaucuggaacuccuguccccaagagaucaucucgucuugaccucccaaagugcugggauuacaggcaugagccacugcaccugaccccuauuaucuucuuuugaaaugagucaucugcuaauucacuucauaaauaucugcugaauauuguguguuagguacugugcccuuccuugaggauaugaagguguguaagaaucaggccuugcuuuccccuaagagaaguuauaacuaugaagggaagacagcuacguacacagcaauuagaauuucauaauaaaaauacaggcaauauguggugcuggacuaagaugugauugacuuaacucuuuuggggguucugguggaagacaucacagaagagaggacauuugggcaggucugagagguuuagugugaguagaccaucugggggagaaagacauuccagaaggaaugaagaguugaugugcaaaggcaaagaauuauggauuaucauacuuaguguauuaauuuccaagggcuguuacagugaagugccacaaacucauggcauaaaacaacagaaauuuauucuuucauaguucuggggacuagaagccugcaaucaagguacuggcagggccacgaucucucugaagacucucagggaggaucuguuccaugccuuucucuucgcuucuggaguugccagcaguccuuggcauuuuggcuuguagaugcaucacuucagccucugccuccgucccuucaaucucaugugauacucucccucccuuugugucucugucuuuucucuuaaggguaccagucauaguggaugaacgaguaugacaucaucguaacuuuguugcaucugccaagacccuguuuccaaauaaggucacauucacagggacccaggguuaggacuuugacauaucuuuuuggggaacacaguacaacccacagcaccuggagaacugaauguaggugccuguuguuggaacauaacuugugagggguguaauggaaggaagggggugagguuguaagguuauaauggccucuuuuugucccuucccaacaaucuccagcuucuggguuuaugcuugaccuaggauaagcccucagggcauuccaguuucuggccgugcugauuguuuugaaauggguuuaugauugauuuuaauggacucaaucagagugaaucucaggacuuuugucggagaucccuuuccucugugggcguuuagaaggacauguguugccuucuuuucuguguggcgaggccauaaugccuagaacuguuaagaguuagcguugcugcuguaaggaauucaccucaggucagaacaacucccagaagauggaggauggcagagaaauggagccggagaccugauaacuuucugaaucucuggaucaaaacuugccugaagguguaguuuuugguuugugaaguacugcaguccauguuuuucuuaagccgguuagaguuggauuuccuuccacuuacaguagaacaauuccuaacauacagagggagggagguagagccagcugacuaggguuagucaguuagggcuucuguaacaaauuaccauagacuuuaccucgaugaaagguucccaagaugggcagaugcuuuuuauuuaccgcaguauagaggacagguauguacgcaggagaaaaaggagaguguguguuuaugaucagaacaguuuugaucauauaaaugugauuaagugauuuaauacauuuguagguuauuuuuaucuuaagaaauacagaagugaguaccuaguguuaugauugaacagaaaucuuacacugguuuuucuuguuaauacaaucauauuuccaaaacugaaaugaaacuauaguuguacuuuuugaaauacuugugucuggaaauuggccauuaacuuacuaugauacuuguuucccacuuaaauaguacucuccuauuuucugugaauucccaaaugcauuuuggcaagugacuuccaucuauauacuauauacuguucucaucuuucauuuuuacuuuguuccuuccauuuucccuuuucuuucuauacuucaaacugcucuguuauuauuaacgugacuuccuucuuaugagggcuuucuuauauuugucuugcuuuuuucccacuuuucauuuucuuuaugucauaucucuuuaacugcuuuucuuuuaucacugagaccaugguucgauauccuuucaauuaaaacauugaaaaaguuuuuuuucuuuuucugcuaguggauugaucuucgaguguuugagacaggggcuuacccugucacccgugcugaagugcgguggugcaaucacugcucacugcagccuugaccaccuugagccucugggcucaagugccucccaccucagcguccugaguagcuagaacugcaggugcgcaccaccaugccuggcuaauuuuuuaauuuuguggagaugaggucucacuaugucgcccaggcugaucucgaacuccuggguucaagcaauccucucaucugcgccugccaaagugcugggauuacagaugagagccaccaugcuuggacccuuuaaauuuuuaauuaaguuuucaguuuuuuucaguuugcguuuuggguggacuucaguucuagcuguuuauuuacaugcuuaccuauugagaauuuucuguuuuucacuuagagaaguuaauuuuaguaaugggugaauuuccuuuuuuuuuuuuuuuuuuuuuuagaauuugacauuaaaaguauacaauuauuaaaugaaugaauuuuccaauuaauuucucuugguccuuuuuguauuuuaagaauuuuuugauugguuuacuaauaagccaguaaacauuaggggcuggaauucugucaguugcuguuaagagucacauaaguaaccucccuugaccuguguuuucuaaauuuuuaaauucacagauccuuucacaaaaauguauaaucuuauggacucccguaggaauuaaaaaauaauaaucuuuuaaaaaauguauccuguuuuuaagauaauuuuaaauaaaguaaaaguaguuuguuaauaaagauuauaaugucuauuuuaaauauaauuuauaaugauauucaaaggaaaauuugaccuuacucuauuuaaaacguggugcauauauuguuucauguacuuuaauuauguaaggaaaagcaugaguuguagacaaaaaaaaaagacauuacauuuugggauaaaauguauauuaacauagagauugaauuuaacuguguuuugugcuauuaaaaauaguuuuccuguccuaauguuugauauucauaaauaugugcuuucacaauuauuuuuuagaauuuuuuugcguguuuugauucugaaugauaaaaugauagcgauuuucagcuauuuguaagcauuucucugcaaauaacacauuuccuguuuggauaguuuuucucuaaauugaaugaaaaggccaaccuggcuauaauugucacucaguuuucccuuuugaacacuguuuuugaaguacuggagauaucaaggauuuugaucagaagguuuggcaaagaugaucuugagacagaucugcagaauuagauucauuuuaugccuucucagaacuuauauauaaauaucauugugucuuaugcuucucuuuugauagaugacaugacugucuuuuaaugggagcaguauuuggacaacucuuugagaaacacugaccaauacugacaaaauguauaacucauuuuuuuaaagugaugauauguuuagugcugguucagucucugaacuaacuauaacuuccuauuaauaugaaauauuugaagccuauggaagagaugcgaggaauaucucuuuguacuugcaaccugguuuuucugaauuuucuucauauuaauguuauucuaaaaaguaaaauguuacagauacugaccaagguccccauguuaccaccccuucuuaauccucuucaccguacccuuuccccagagguaacuaguauggugaaguugauguuuauuauuucucuugcauguuucuacucuuauuacagagaguacagagagauauuucugcaaacaauaucuuauucccaaaaacauguagcauuuuuuaaucuugagaugagauaugcuggagauuuaucuguugauaaauguaguucuaguggauucauaguuaauauuaauuacagaaggauuccaguuuacuuacccauuuuccugcugaugggcauuuagaguuuuccaacuuuugcuguuacaaauaguacuacaauuacauucuuuuuuuuugugacagggucucacucuaugaaccaggcuagagugcagugauguaaucaccgcucacugcagcccugaccuucagggcuuaggugauccucccaccucagccucuggaauagcugagacuacaggcaugugccaccacacccagcuaauuuuuuguguuuuuaguagagaccaggcuucacuauguugcccgggcugaucuugaacuccuggccuaagcaauuugccugccuggggcucucagagugcugggauugcaggugugagccaccaugcccggcccaauuagcauucuuuaccuaucucuuuuugcauacaugugugauuuuucucuaggguagugaucuucagucuuuugaaacaccuccaaaauaacugaaauucuuuuuacuuccuugcuuucagguugacaugcaguugacacauauuauuuuucaaaaaaaaacagauuuauagaguugaagagauacaauuucuguauauuauaaauagagcugcugaaaaaauuccccauuauacaguauuacuuuaaaaauauuuauugaguagaauccaaauuccauagcaguuuaauaaccuuucucauuuuaaaaaauacaugaggccgggcaugaugacucacaccauaaucccagcacuuugggaggcugaggugagaggauugcuuaagcccaggaguuugagaccagucugggcaacauagggagaccccaucucuauaaaaaaauuuaaaaauuugcagggcaugauagcacauaacuguagucuuagcuacuugggaaguugaggugggagggucacuugagcccagcaguuugaggcugcagugagcuaagaucacacuacugcauucuauccuggaugacagagagggaccuugucuuuaaaaaaaaaaaaacaacaaagaaaccaaaacccacauguaguaaauguuauuauucuuuuccuuuauggcuuguccuuuuuguguuauauuauaaaauuccuuuccuguacugaccuuguaaauauacucuucuauauuuuacuuccucaaaauuuaaaauuuuugcuuuauuccauucugaucuuuuauccaccuguaacuuguuucugugaaugauuuguuauauugaccuaauuuaauuaucuuuauaugguaagcgguuguugcaguuccauuuauagaacaguuuugccccugcuccccguuuguauugaauugugcuauaaucauuuaaaacuucagacuugucuugauuguucuuaacucuuggcuccccuaauuucaacaaaaaucccuguugauauuuuguuggaauuucaccugauguugagauaagccuggggaaaucugucaucuuuauuauagagggucuuuccauccuucgcauccuucuggaaagaugcuuuauauuuccaguuuaggucucauaucuuucaguaaauucuuauagcuuuuuucaaaugaucugacacacuuuuauuagauuuacuacucgauagagaauuuuguuauuacuagaaacuaauugauuacuauaguaccuaggaauggauuuuaaaauuauuauuauuauuauuauuauuauuauuauuauuauugcacugaguaauauuuagcucaugaguaucuguauuuaucugggcaccucucugaagucugguaaacuuauucaccugucuggaucuaggcaggagguugacugggcucagcugguggggaugggggugucacagcugucacaucucuuuguaccagaggcuggcugagccucaccaucauggugauggcagaagugcaaaggcagaauuuauuuccucguauuuugaauuuuuauaucuaugaauccuuccuaagcucuuguaguacugguagcuuguguguggauucuccuguuccccauguugauagucaugcugccaauaaguugugacaguuuacuucuaaacuguauacaccuucuuucuuuuucuuguguaauuaaugagcuaguucauguuguugaauauuaucaauguaggacauuguugaauggucuugauccugacuuuaaaaagaauccuauggaauaguucccugcacauagaagguggccugugauuauauugauuuuugucuuuucaucuguuaaugugguaaauuacacuuacauacuuuuuaauuguuagaccaucuuuguauuccugaguugaacccauuuuggccaugauauguuuuuuaauacagauuuuuagauuugguuugccaauacauuuuuuugagguuuuuuuuuuuuuuuuuuuuuuuuuuuuugaguuggagucuugcccugucguccaggcuggagugcaauggugcgaucuuggcucacugcaaccucugccuccuggguucaagcaauucuccugccucagccucccaaguagcugggauuacaggugccugccaccaugccuggcuuauuuuuguauuuuuaguagagacgggguuucaccaugucggucaggcuggucucaaacuccugaccucauaauccuccugccucagccucccaaagugcugggauuacaggcauaagccaccccgcccagccugaauuuuugaacugugcuugugagcuuuucuuuuggcaagcaugucagauuuugucuguuguuuuauuuugucuucacccuugaaugcucauauagcugggucuggaauuuaagauugaucauuauuuucuuugagcaauuugaauguuuuuuuccaaugucuucugauuuuuauuacugauguuucaaagucagcugucagucuaauucauucauagguaauuuuuuuucuuucucucuuuuuuagcuucuuacucuggaaaauuucaaauaaacaaaaauggaagguauaacaagugugacgugucugucaccagcuucaacauuugcaacucauagccagucuuuuucacuuuuaccacugccccauucccaugccuuccccuccucccaccagccagcauagauuauuuugaaguaaaucucaggugccauuuuguuuccuucugguuguuuuucuuuuccuuuuucuuuuuuuccuuuuuauuuuuauuuuuauuuuuuugagacagagucuugcucuuucacucaugcuggauugcaguggugugaucuugacucacugcaaccucuguuucccgaguucaagcgauucuggugcuucaccuuccugaguaguugaaauuacaguugugugccacuuuuuuauuuuuaguagauaugggguuucacuguugucucgaauuccuggccucaaguaaucuguccgccuuggccucccaaagugcugggauuacaggugugagccaccacaccaaaccauucugguuuuuuauaagugcucuugcuuuuacucauagucuaucucuguuauuuuuuucuuucccuuucucuuuugguugauuguauuaacguaguauuacuaugaugugcccaaauguggauuuauuuuuauuuugcucaguguaugugcauucuuuaucugaggauucaagucuguuaucauuucugggaaauucucagguauuaucuuuugaaagcuuccuuuacauuuuauuuguuauuaucucuuaguacgacuuuuagacagacacauguugccuauucuuuuuauucuguuuacuuucuacuucucauaauuuuuaucuauuucccucuguugcauucaggauaauuuccucagaucuguucucuaguucacaaauucucacuuuaacuguaucuaauuugugguguaacuuguuaaauuuucauuuucagugacuguauuuuuaauuucuagagguuuuaucuuuuauuaauaaaacuggcugcuuauuuucauaguguuauuuuuugauacuuuugauccuauugugccuuuaagcaauuuuaauuaauuaauuaauuuuuugagaccgagucuucuuguugcccaggcuggagugcaguggcaugaucucggcucacugcaaccuccgccucccagguuuaagcaguucucuaccuuagccucgcgaguagcugggauuacagaugcgugccaccacacccagcuaauuuuuguauuuuuaguagagacaggguuucaccaucuuggccaggcuggucuugaacuccugaucuugugauccacccgcguuggccucccaaaguuaaauuuauuuuauguucuuuauuggauuguucuaguaacugaacuuuauagggucuaaugcuguuguuaguuugcugauuuuuguucaugguacauugcuucaauuuugucaaaaauuugaguuccucuucagugagacuuuaucaauggacauaugucucuagagagaguuugugauuacuucuucuagauaucuuuggggguauucugaccuggggcuacuuucuauguuaauuuuauuuucuuauggguaccuagaacccaagugagggugguauguauuagaacucaaaugggugugggacucguuaugaagucauugggagggauuuuccccugccuugguccaugcugaaacugcuuucuuguugcuuuucugugccuaagagcuggguuugguuuuuaaaagcucuuuaaggguuccacccuucuugaagggcucucgguuccaauucccugccuuacauggaccuaggccucagugucuuccuuuugagcauuuagauccagauuauuuuauagaagaugauaugcucuuggaucauggggauugacagccucucacaggacacuauggaguuggcuaacauguucccugcucugauuuucaggucucuauuuuuggccuuuacugauuucucuuacuuuuuuucagguucagcuggcaguuaaaaugauguuauauugcagauugcauuuacuucuugauuuuaacguagugaaauguauugauuuuuuucccuuuuugugucuuguugaaaucuuucccuauuccaagaucguggagauauucuucuguauugucuucuggacauuucauuguuuugucuuucacacuuaaaucuacaguccaccuagagaaagaguguguguguguggugcgagguuagagacacauuuauuugcuuuaugcauauucagauucacauuuauuagagccacauuuauuugcuuuaugcauauccaaucccauuuuuugagaagaccuuucuuuucccagugcucuguagugcugcgucuguuaucaaucagguguuuauguauauaugaucuguuucuggacuuucuguucuauuccuuugguccguuugucuauccuuaugccaguaauacugcacuaucuuaauuaguauggauuuauguuaagucaccuuaccuuauucuuguucuuuuucagguuuauuuuggcucuucuugguccauggcauuuccauauagauuuuagaaucaccuuguucauuuuugacaagaagaauaucuugagaauaugauuagguugguaaugaaccuauaacucaguuuggagugaauugacagcuuuuauaauguugagucuuccgaaccacaaacaugguauauaccuuuauuuauuuaaaucuuuucuaauuugucuuaaugcuuuauaauuuucuaugcagaggucuuguagaucucuuuccaagauauuugauguuuguuuguuuguuuguuuguuuguuuuuugagacggagucucacucuguugcccaggcuggagugcaguggcgugaucuuggcucacugcaaccuccgccuccuggguucaagcaauucuccugccucagccucccaaguagcugggauuacgguugugcgccaccaugccagacuaauuuuuguauuuuuauuagagaugggguuucaccauguuggccagguuggucuugaacuccugaccucaagugaucugcuugccucggccucccaaugugcuggcauuacaggugugagccacagauauuugauguuuuuuauacuuuuguaaauuguaucuuuaaauuuuuuuuugaacaaggucugguuuuauuuucuggcagaaucuuuuaaaauauaaaacagauaaaacacaucucagcccugcaaucugccagcaugccuuguuucuacaggaugcaugcuagaccaugagacuacguagcaaagggucuuuaagagaauuugguugggagaaauagaaaaaacagaucucagggaagccugggcuagcccaaaagcugagcuacaucccugagcacuagagcaguccuugucuuuucagauccucauaugucuucuuauucacaacauucccacuugagucuucauauucuuccuccagugucaggcugccaucauucugaagccuucugcaauuugaauuuggcccacaaggagacagcaucuucaaucugcgucacauuagcaaagugagcaguguuugggaugcccaaacaccucaugccaugagcaugaugcuauucagcaaagugucacuggaaggcuuugcgcccuugguagguguaguuuccacaaaucucacaguuauaguugauauuuaggccaugaagcuuauauagccaguagggaaugcguuugccaucccagccaaguggcagguuuuugggguuguaaaugaucucguucuuuucaucuucacucucacucuuacugaucugcucuucuugcucuucuccuguccuugcuugcuugcacugugcauuuucaugagugagauguugcuguucccugagagucagaguauucauagaucugggcuucuagaaaagcaaugucuuuguucucucaaugucucgcuuggugcccuuugauuugggauuuuuggcaaacaaagaguuaucaagugacuccagggacuuuccuuugguacugaauagucucugggcuugcucuucuacgguccgccacauuucaagccuaaagcuaagagagcagauuucaaucuguccaaacccagagaggccaacuccucccaggaggagaaggcggagaggucaagaugggcuccagcaugggucagagcgcugcuugucucuuucgcccauccaggaaggucacauucucccauuucuucucaaacucagccugaaucuucccaaaaaguucauucugaucuuggagaggcuuuacucuaucuguguaauccugaaguuacucaagcagcaucucuagguaucucuuauacucugcauucuuccuuucuuuaggaaugucaaauaauuggucagagauggacagguaugugauauaauccagcuucucagaugccuucacguuaauguacuugagguaacagucacggagaucgagguaacgaccauaucccucuucaucugugaacuccaccaaguuuugugccucuucacuuggauucucugagccuucaggagcuccucaaauuucacugacauuggcacacagaucucauuugggugcuucugguggaauuccuuuauuuacucgagucuauuauagaauucagcaaacucacuggguccugaaauggcauugaguuccuccuuucauaauccaucuuuaucaucauacagaucccucagguucccacugaccuccauauaccuaucuugcauggccugagugcggugaucagaauugagcguggacuucuuagugagcaucucuuuggccaugacguccaugagccuuuccuucuccucaugauagcgccgcugcugcuccaguauugucuccaucuuccuuuagccgcagccucucuuaaaaauuuuaugauuaguuguuugcugcugguuaaaggaaaugcaguggacuuuuugcaccuuuccuaaaguauuuuauugauucuaauaauuaucugcagauuauuagcucucugggggaaaaaaaucaaaaaaaacccuucuuugaucccccgugucuucuccaaauguggccucauuucuguguuucauuuuacaacaaaacuccugcaaaugaaauuguucucuuguuaacaucuccuacuuccucacuuccaauuuucucauuaacuuauggcugcuagagaucauaggggcagcaguguccacagcuugucaaauccagugguuaauucucuggccuugucuuacuaaacuucauaacguuucacugcuuccuuuuugaaaacuugcuucuggauuucugggacuccaugcucucucucuuuuuugccaugcuugacugacugcucauuugcagacuuugucuucuucuggcuucuaaaaguuagaguucuucuggguacuugcugugcaucugcacucaaucgucuucuguaucuguaccugaaacucagauguucuucucagucuggggacuuugaauacuguaacauugaacuuuugauuuuuauuccaagccuguuugacccucaguuuucuuagcauuuguaugagaccacucaggcuagaaaccuggguguuuucuuuauucccauuuacucacuugcaaacuauuauuaaaucuugucuguucaacccccaaaacuuaucuaaguaucugcugguauucuuuuuucuucauuuguggguagaagcaagauuguguaggucuuuguagucuuaaauaaccauaaaaaauuucuggaaaguguaagguuguaugcaaauaaaagguaucagauggcuaagaggaguggaguuaaauaucaggauccuuaaacuucuuuucuuuaucuugcccauugccuuuucuuuucuuucauugcuauauauuuacguggacucuuucaaagagauuauaguuacagagaccugauagccaacagguugaauguaagccuuauuugugcuuauuuuugccuaauauucagggcccugugagagauucugguuguugaauauacaagaaggguugagagcauauucuagauaggggaguguguguguguguguguguguguguguguguguguauccguucucugggcagggaggggaauaugguaggagcaaaagcacaagagagguaggagugggcacugagugucugggggaccaugagaauuggcuucgcaggugagaggagaaggauugacauucuuaauaguuagaaugucaggaacaggaggaguucagacuucauuccacagucugugcagaguuauucuaaauauugacaaggguagugacauggugacauuggugcuuuaggaauguuguucugcuguagggugcuuaguaggcuuuguggucucagaagcugcugaagguagccagagguguuagcaauaagacuaccaugaauuguuuuugagcuugggguagagugggaauggagaugaaggaauacaccuaaggaagucuuugauggcaguuauaucauaaauuguucauacaugugaugaaugggauaucaaguacaggaagaaacuaacaaaacucauaccaacguuuugcgcaugggagaagcuauuuuaucauuucggguggacuguaguugaaugggaagagauaauucugccauaagaucaggguugaauuuuguugguucuggaacucaguuuuugcugcuguacuguccagagagagagagaaauagaaagggagagagagagagagagaggcgcgcgcgcgcgugcgcacgcacacacacacacacacacacauaacuaauauauauaaauacauauauauguggguauauauuauuuauuuauguauauauaauauaauauacuauauagauaauauauaauuaucuauaauuauguaaaauauaauuguauauuaucuauaauuauauaaaauauauaauuauauauguauuauagauuauauauuauauauaauuuaauauauauaauauauauacauauguagguacguuuguuuguguguguguguguguguguguguguauaauuaaaaaaaauuuuuuuagagacagguucucacucugccaccaggcuggagugcaguggcaugaucuauagcucacugcagccuugacuuccugaacucagauaauccuuccaccucagccuccugaguagcuaggacugcaggugugugccauaccacaccuggcuaaauuuuuuuuuuuuuuuugguagagauggggucucacgaugaugccuaggcuaguuuugaacuacuagccucaagcgauccaucugcaucggccucccauaguguuugggauuacaggugugagucacugugcccaaccuauuuuuauuuuuuuguagagauagggucucacaguguugccuaggcuggucucaagcuccuggccucaagcgauccucccagcucagccucccaaagugcugggauuacaggcaugagccagucuggcuagccugaguuuuuauuuagaaaaacaugaacaaccuguauauggcugcuguaaaccaauggacuuucuuuguucuugaaccaagcuaggcauccacacggcaccuauucaucugaggggauagagucaguguucagaugucuuugaaagaaagguccaccugcaguucuuuagcuucugaaauguuuuuuucuuuucccauacugucauggauacacacgagauuguucuggacuuccuuuauaguaaacuuugcucuuaauaagagcuugaaaauuuuuguuguugcaaaacuguguuagaguugauacuguuauuuauuaggcaacaaauguuacaugaauaucuaugauguuuuaggcacuggcgaaaaagaggugaaugagauauguucuugagaaagucuugguaguguagugggcagagauuauucucuauaacaguaauaaucaaaccacaugauaaguuuaccacggagaaggcauuaauuagcucagcacugaaaacuuggggcacagguucccagagcuccaagggacauuugaagugagaucugaaagguugguuaggaaaaaauaaguuauucuagacagagaagucaggcugugcugagccacgaagacuuaaugcaggugaguugaggaagaaauacauagucaauauugccacaauauggucugcucagucuggggagcaguggcuagugauggagcaguagggguaaguugggguuggauugucacagaccuugcauguugugcuaaggcaugcagagguuuccaggcaaguuuugacaugaucagauugcccuugguaacauuauaaagaagaugacagguggcucugcaaagaacuguccagacgggggagcuggacugagccacaguuaagagacuguugcaguagacuagacuaggaggaggagaauuugaauuagagcauuggccuuagcaaggggaucaaagagggaaaaagaugagauugguuuguaggcugaaugaauggaggugaagguaaagaaagagucaauaauuuuuggaagauaggguagaugacaaaguuguuuaaagaaagcauaaaagaaggggauuuaaugacuuaaauuuuugauauagggaauauaagucugaaacaugggucuagccuugagcuggaaauacagcuugggcaguuagcaacauagagaugguagaugaagccacggaugcagauguaauuaccuguaggaguaucauggagaccuugaucuagccaggacaauuucagggacagcccaggauuugagcaaaggacuuguccauugcuuuuauugagucuuucaagguugaugauuuauuauuguuuaaaaauaugagggagccauauuaugguuguuuuaauuauccuuguggauggguauaguagaauguccuaaauauuaaaacauauagaauucauuuauaauguuauaucauuuauaaugguuguagcuuuauuauuauuuuuaauaauuaggacaaaugcuuaauauuuuacauuuuagaucauaguaugagucaauauucaugaugaaucuuuuucuuuguauuucuuucgaauuuaagaaauuagaucaaaauuuucugauagagacgaaacuuuggaaugcagaaauauuuuuaguauuggugccaaaaauuuaagucacuuacuuuaacacuuagaaauuacaagaucauauauggaaaguuuguuauugguuugguguauuagaaucauuuguggagcuuuuaaggacaccaaugcagugcuggauuccacucaagagggguuuguguuagggccacaucaucuguauuuuuuaaagcuuuguggauauuuugauguuaaucugagaacccuguaucagggguuuggguaggggcuuuguuagcauauuuugugucuugcuuauuuaguuaaccuuuuuguuuaaagcuguuaaagcaaaggccagaauaccagcagguuagcgauuuggucaucacagugaaaccauuugaauuuucaugugaauuuaaacuauaaaacaaaauucaauagcaguucagucugggcuuguaucauuagagggcugguuaaauaaaauaugacuuguucacagagcagaguacuauguagcuauaaaagggaaggaggaauagcuauguacuacugugggggagaauauauuguuaaaugaaaaaaaaaacaaaacccacuguagcagaacagugguauuguacacugucauuuuuuaaagaaaggggaucuauaaaucuauaaauauauauuuuugugcauauauauaaacacaccaauggaaugauaaaccaaaaacuaauaaaaaugauuaaggagagagagagaaugggguggauaaaacagggauggaggcuagacuucugaauguacuuuauuuuguggauuacauuuagaaccaugccaaugcuuuaccauauuauaaaauaaaaauaaauuaaaaugagagaaaaaggcaaucucuaaaaaucaagugcauccuuucaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugugucccagagauucugguauguugugucuuuguucucguugguuucaaagaacaucuuuauuucugccuucauuucguuauguacccaguagucauucaggagcagguuguucaguuuccauguaguugagcaguuuugagugagagucuuaauccuggaguucuaguuugauugcacuguggucugagagauaguuuguuauaauuucuguucuuuuacauuugcugaggagagcuuuacuuccaaguauguggucaauuuuggaauaggugugguguggugcuggaaaaaaauguauauucuguugauuugggguagagaguucuguagaugucuauuagguccgcuuggugcagagcugaguucaauuccuguguauccuuguugacuuucugucucguugaucuaauguuggucuaauguugacagugggguguuaaagucucccauuauuaaugugugggagucuaagucucuuuguaggucgcucaggacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuauuguuuuccauuugcuugguagaucuuccaccauccuuuuauuuugagccuaugugugucucugcacgugagauggguuuccugaauacagcacacugaugggucuugacucuuuauccaauuugccagucugugucuuuuaauuggagcauuuaguccauuuacauuuaaaguuaauauuguuaugugugaauuugauccugucauuaugauguuagcugguuauuuugcucguuaguugaugcaguuucuuccuagucucgauggucuuuacauuuuggcaugauuuugcagcggcugguaccgguuguuccuuuccauguuuagcacuuccuucaggagcucuuuuagggcaggccugguggugacagaaucucucagcauuugcuugucugugaaggauuuuauuucuccuucacuuaugaagcuuaguuuggcuggauaugaaauucuggauugaaaauucuuuucuuuaagauuguugaauauuggcccccacucucuucuggcuuguagaguuucugcugagagaucagcuguuagucugaugggcuucccuuuguggguaacccgaccuuucucucuggcugcccuuaacauuuuuuccuucauuucaacuuuggugaaucugacaauuaugugucuuggaguugcucuuuucgaggaguaucuuuguggcguucucuguauuuccugaaucugaauguuggccugccuugcuagauuggggaaguucuccuggauaauauccugcagaguguuuuccaauuugguuccauucuccccgucacuuucagguacaccaaucagacguagacuuggucuuuucacauagucccauauuucuuggaggcuuugcucguuucuuuuuauucuuuuuucucuaaacuucccuucucgcuucauuucauucauuucaucaacaaaauugauaaacugcuagcaagacuaauaaagaaaaaaagaagaaucaaauagacgcaauaaaaaaucauaaaggggauaucaccaccgaucccacagaaauacaaacuaccaucagagaauacuacaaacaccucuacgcaaauaaacuagaaaaucuagaacaaauggauaaauuccucgacacauacacccucccaagacuaaaccaggaagaaguugaaucucugaauagaccaauaacaggaucugaaauuguggcaauaaucaauagcuuaccaaccaaaaagaguccaggaccagaugaauucacagcugaauucuaccagagguacaaggaggaacugguaccauuccuucugaaacuauuccagucaauagaaaaagagggaauccucucuaacucauuuuaugaggccagcaucauccugauaccaaagccaggcagagacacaaccaaaaaagagaauuuuagaccaauauccuugauaaacauugaugcagaaauccucaauaaaauacuggcaaagcgaauccagcagcacaucaaaaagcuuauccaccaugaucaagugggcuucaucccugggaugcaaggcugguucaauauacgcaaaucaauaaauguaauccagcauauaaacagaaccaaagacaaaaaccacaugauuaucucaauagaugcagaaaaggccuuugacaaaauucaacagcucuucaugcuaaaaacucucaguaaauuagguauugaugggacguauuucaaaauaauaagagcuaucuaugacaaacccacagcuaauaucauacugaauaggcaaaaacuggaagcauucccuuugaaaacuggcacaagucagggaugcccucucucaccacuccuauucaacauaguguuggaaguucuggccagggcaauuaggcaggagaaggaaauaaaggguauucaauuaggaaaagaggaagucaaauugucccuguuugcagaugacaugauuguauaucuagaaaaccccaucgucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaagugaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuacagauucagugccauccccaucaagcuaccaaugacuuucuucacagaauuggaaaaaacuacuuuaaaguucauauggaaccaaaaaagagcccgcaucgccaagucaauccuaagccaaaagaacaaagcuguaggcaucacacuaccugacuucaaacuauacuacaaggcuacaguaaccaaaacagcaugguacugguaccaaaacagagauauagaucaauggaacagaacagagcccucagaaauaacaccucauaucuacaacuaucugaucuuugacaaaccugagaaaaacaagcauuggggaaaggauucccuauuuaauaaauggugcugggaaaacuggcuagccauauguagaaagcugaaacuggaucccuuccuuacaccuuauacaaaaaucaauucaagauggauuaaagacuuaaacguuagaccuaaaaccauaaaaacccuagaagaaaaccuaggcauuaccauucaggacguaggcaugggcaaggacuucaucucuaaaacaccaaaagcaauggcaacaaaagccagaauugacaaaugggaucuaauuaaacuaaagagcuucugcacagcaaaagaaacuaccaucagagugaacaggcaaccuacaaaaugggagaaaauuuuugcaaccuacucaucugacaaagggcuaauauccagaaucuacaaugaacucaaacaaauuuacaaggaaaaacaaacaaccccaucaaaaagugggcgaaggacaugaacagacacuucucaaaagaagacauuuaugcagccaaaaaacacaugaaaaaaugcucaccaucccuggccaucagagaaaugcaaaucaaaaccacaaugagauaccaucucacaccaguuagaauggcaaucauucaaaagucaggaaacaacaggugcuggagaggauguggagaaauaggaacgcuuuuacacuguugaugggacuguaaacuaguucaaccauuguggaagucaguauggugauuccucagggaucuagaacuagaaauaccauuugacccagccaucccauuacuggguauauacccaaaggacuauauaaaucaugcugcuauaaagacacaugcacacguauguuuauaguggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacacugcauauucucacucauaggugggaauugaacagugagaacucauguacacaggaaggggaacaucacacucuggggacuguugugggguggggggaggggggagggauagcauugggagacauaccuaaugcuagaugacgaguuagugggugcagcgcaccagcauggcacauguauacauauguaacuaacuugcacauugugcacauguacccuaaaacuuaaaguauaaugauaauaaauuuuuaaaaaaauuuaaaaaaauaaaaauaaaaaucaagugcauauggaauaagugaauguauauuaaguuauauauaacuaaacguauauuuacauuuaguuauauauaacuaaauguauauuaaguuugaggcugaagcacaugaucuuucaaaugacuuugaaacauaguaauuugauuauacauuucuagagggacauauccucaaggacaaagaacugcaaaaauauuguaaacuguuuuuaguaaucguauaacugguauuauugguauuguucuggaagcaugcauuguuaaguaaaacaaauggauaauuauauuggauuggugcucuggauuuugguguggaaaagaggagauacaaagguagaaacagagaaguuguugauuaaggauauugggaccauaaauuugaguuggagauguccguaugaacucaugguauuuuuucuuuauugaaaauguauuuucuguuuuucucugcuggaaaaucccagaaagcaaccuagguagcauugagcacuucuaaugccagacucuguucuguaaauacuaauucccacuacaaggaacuuaggguaccuuagaaaaauggcuuauuucauguuggggucaagaaugcuauaagaugauccugggacaucuuuuuauaucacaaaacaggcuacuagggagauuuucauuucuaucagugguagaauagcuuuuucuaagccagugcuccaacugagaacaacuaguagagaagcugggaaauauuguuuuaaaaaucugcuugaaggcuuuggaaagugagcaaggcaaagaaagggacuagagagaccaaaauuuuggagagaagguaaacucaggggcgagggccaacuuuugguacagcuuuucccuuggggggacuggccgauuugagaugugcggcuaagagauugagcacaaaguaauggcagagagacugagauucuaagcagaguuuuggugguuaugcagcaucgggggacacaguuggauuucaggggcugcaaagaaagaaggggcgcuggaaaauaccucaggcuuuuaguugggaacccugaaggaugggcuacacccugugcuuaagggugaacucaaaauagaucagcucuuacaaaggcugaagcccagcuuucacauuaccucaaucccugauuggauuaaagagucugcuccuagcuuuauuguuugcuagaagcaaauguaaaucuguggaggaagacagcaucaagcauugccucaaguuauuauuauaauuacuauguauaauauuuuacaacauguaauaaauauuuacauaguuauacaacuuagucuggaauucaauuaaaaaaagaccugaaaauuuaaaaauuggcugaaaaugaagagagaaaacagauaauugaaacagacucauagggaggcuuuuauuacaaauaagaugguauagacucaguuuuccugcucuucccugcuaaguacaacucuaaaucuuggaauugguacaaaagacacccaaaggagaauucuugaaguuuauaagaagaaagugaacugacuugggaucacagcauuggaagaacaacauagucguagagcaucuugcauccucccauccaccuagacccgguguuuccugacccucccaccuagcaacagagugcaggcuagguagguuggcucauuccuccccugaaucaaauggaaguccccccgaaaacaucugccaaggccgacagcauugacaaaggggaucaguugggaacucuagcccuaaucuuaacccuauaaguggugagaggaagcacauuccuuccuugccuguccugagaugucccuuuuccacugaggcagguuggcagaacugguaagagagacccaacuauagcuagcaguccaguuugagaagacucuucuucccuguggaugugagauuuuccucuucagcccagagacaccagggugggcacugcuugcaaaaaggacauagccacagcaaauggccuggucugagagaucuuuggccaugugggccugagccuuuucucuccuacccagagauaugggcagguagguggaacuggcaagagcaaguggcccauuacagaagaccucuuugucucuguggguucaaagcuugccuuuuucacuccagugauacuggggaagcuaggaguaaccuaggacuaccacacccucuuccaccaagagacaacuggcagccuggcucagggaacuucuuuacccucucaggcagugccagcagagaccaaugggagcucaaaggcacuagauaaacaaagcaggcuaaauaacacugcaaaggcucuguaaauuagucugcuauuggaacgauagccuagaaaaguagaccaagauacucgugcuaaaacuaaacaggguggcuaacuguuaaaagauuuaauagaagccuauguuagagacuucuaacauaauagacaaaauguucaugauauaauagcaaaucacuugucauaccaucaacaaaggaaaccacaaauugaaucagaaaagacaaucaacagucaccaauacaagaugaaucagauguuggaauuuucugacaaggauuuuaaagcauccaucauaaaaaugcuucaaaaucaauuaaaauuauccugaaacaaaagauauaaaaaucucagcaaagagccauauaaaauuaauuaaaacuaaauaaaugaaauaaaaaagcaccaaaauggaaauuuuagaacugaaaaacaacaggaaaaaaaaugcuuacuggaccggcucaauagaguggcagugacagaaucaguaaacuugaggaaggaacuauagaauucacuuaauauauuggaagaaagcaaacugcaaaaaaaaugacuuguggggcaauaacaaaagacuuaauauucacguaauuggauuuccagaggaagggagaguaaguaggucuaaaagaguguuugaaagaaauaauaguggaaaucuuaccaccuuuggcaaaagaaacaaaccuaaggacccaagaagcuaugcgaacuugguacaggauaaacccagugaaacaccaagauacauuauaauuaaacucuugaaaccuaaaggcgaagagaaagucuugaaagcagccagagagaaaugaugcauuaccuauagggaacaccaauucaaauggcaguagauuucucaucugaaaacauggaggccaucugaaauguuacauuaccuauagggaacaccaguucaaaugacaguagauuuucuguaugaaaacacgaagaaggacaagacaugauauuuuucaagugcggaaauaaaaggacugucaaucgugaauuucuguaucuggugaaauugugccucaggaacuagaggaaaauagaaacauucucagauaauggauaccuaaagaauuuguugcuagcagaacaacccuuaaaauuggcuaaaggaaguucuuuaagccgaaaggaaaugauaguagaaggaaucuuggagcauuaggaaggaagaaggaacaauggaaaaauagaaauauggguacauaaaauaauagacugucgcaggccgggugcagugccaacgccuguaaucccaacacuuuaggaggccgagguggguggaucaccugaggucaggaguucaacaccagccugaccaacauggugaaaccucgucucuacuaaaaaaaaaaaaaaaaaaaaaauuagcuaggugugguggcagaugccuguaaccccagccacuugggagacugcggcaggagaaucgcuugaagcugggagggggagguugcagugagcugagauugugccauugcacuccagccugggcaauaagagugaaacucugucuuaagauaauaauaauaauaauaauaauaauaauaauaauaauaauaauaauaauagacugccccuuuccucccaaguuucaucaguccuauuugaugauagaauaaaaaauauaaaaccaucuaacacugaagaugaugauauuuaaaucaagacaaaggacuuaaauggaagugagguuuccacacuuuguucaaagugguaaaauguuguuacuaauaagcagauuauuauaagccguauguuuauauugcaguaauugaaguaaucacuuaaaacuauacaaaaagauaaacucaaaaacaauauaaacaaaucaagcuggaauccgugaugauuaauuuuacauaucaacuugacuggguuaaggaggaccuagauagcagguaaaguauucuuucuguguguaucugugaggguguuuccagaagagguuggcaccugaaucagugaacugaguaaagauuaccccugccuaauauggguggccaccauccaauuguuugagggcguagauagaacaaaaaggcaaaucucauuucucuucuggagcugugacaccugucuucuccucuccuuggaaaucggaacuccaggcucucuggcccucagacuucaggacuagcacgagcagucucccagguucuuggaccuuuggccucagacugaguuacaccaccagcucccuugguucucaggcuuugggcuuguccugcacugugccauuggcuucccuggcucugcagcuugcagauagccugucgugggacuucucagcuccuguaauugugugagccaauuuccuuaauaaauccucucccauauacccaauuuguucuguuuuucuggagaacccuaauauaggacucuaaaaaauguucaagugaccuauaagaaggcaagaagagaagaacaaaagaccgaggacuuaagccuuaauguauugauaauuaacuugaacguaaauggacuaaauauaccaaucaaaagacagagacuggcagaguggaugaagaaacaugacccaacuauauauugcuuauagaaaagucacuucaaauugaauaauguagguagauagaaaaggauacuaaauuauaccaugcaaacauugauuuaauaaaaaagcagaaauggcuguauuaauauuugauaaauuagacuucagagcaaagacaacuaccagagacaaagaagggcauaaugauaaaaugcuacauuaagcguugccagggcacagggauaggagguaugcugauuguaaaagggcaauauggggaauccuuauaguguugaaacuauucaguaucuugacuguggagguagauccuugaaucuauacaggugacagaauuguauagacuugacacacugacacauacacauacacauacacauacacacacacacaaaugagugcaaguaaaacaguagaaaccugaaugcaguugacuuaucaaugucaauauucugguugugauacuguacuguaguuuuuuaaaauguugccauuuagggaaacuggucaaaguguacaaggaaucucucuguauugcuccuuauaacugcaugugagucugcuauuaucucaauuaaaauuucaguuauuuaagaaacagacucaaggagacuaagaagacauuaaaaguaaaugcacuggccuggcaugguggcucaugcugguaaucucagcacuuugggaggccgaggcagguggaucaccugaggucaggaguucgagaccagccuggccaacauggugaaacccugucucuacuaaaaauacaaaaauuagcugggcgugguggcaggugccuguaaugccagcuaauuaggaggcugagacaggagaacaauuugaaccgaggaggcggaggcugcagugaguugagaucauugccacugcacuccagccugggugaccaagugagacuacaucucaaaaaaaaaaaaaaaaguaaaaaugcacugugggguucuggauuggauuuuggaacagaccagaaaaggccauuaguggacacacacacacacacauacacaagucaguuuuuagaaugaucagaaauacacuuuaaaauaaaugauuaguaucuuuauuagaaugaucagaaauagacuuuaaaauaaaugauuaguaucuuuaagaauuuauauaacaagaucaauaauuucaguagagaaauagaaaguauaaaaagaagcauuggaaacuagaaauacaauaauugauuuugaagagccuuagaagagaauuaguuaacuauaagauauguugggaaaaaauaccuguauagaagcacagagacaaaggaaugaaaaauacuagguuggugcaaaaguaaaugcgguuuuugccgggagguuuuguuuuuuuuuuuuuaauggcaaaaaccacaauuacuuuugcaccaaccuaauauuuaauaauuggaguuaaaggccgggcacauuggcucaugccuguaaucccagcauuuugggaggccgagguggguggaucaugaggucaggaguucaagaucagccuggccaagauagugaaacccugucucuacuaaaaaauacaaaaaaaauuuagccgggcaugguggugggugccuguaaucccagcuacuugggaggcugaggcagagaauuguuuaaacccgggaggcggaggaugcggugaaccgagaucgcgccacugcacuccagccugcgacagagcgaaacuccgucucaaaaaaaaaaaaaaaauuggagucaaaaaauggcaaaaacugcaauuacuuuugcacauaccgaaaagaguuugaaugaugugggacacaguuguaauuagaacuccaaaaggagaaaaaaagaguggagcagaagcaauacuuaaugagauaauguccuagaauguucacaaagugauaagaugcuuaaagcugccaauucaggaaaugcaacaaacaccaaacaggaugaggaaggaaaagcauacucagcauuuuugcuaacaaccaaagacaaaguuaaaaauauuuuuuuuuuuuuuuuuuuuuuugagacagagucuugcucuguugccaggcuggaucucggcucacugcaaccuccaccucccagguucaagcaauucuccugccucagcuuccugaauagcugggacuacaggcgcgccaccacgcucagcuaauuuuuguauuuuuagugaaauacgaaaauuaguuuuagcgaaacgggguuucaccauguuggccaggauggucucgaucucuugaccucgugauccacccgucucggccucccaaagugcuaggauuacagacaugagccaccgcgccuggugaaaguuaaaaaucuuaaagcaaccaguggauugagacacauuaucuuuacacaagcaagaaaaaggcugggcgugauggcucauaccuguaaucccaguacuuugggaggcugaggcgggaugauuccuugagcccaggaguuuugagaccagccugguaacauagugagaccuugucucaguuuuaaaaauuuauuuucuuauuaaaaaaaaaaaagcaaggacaagacugaaaacuaccuucuuauuauaaacaauggaaacccaaacaauggaaugacaguuuuaaagugcagaaaagaaaauaaaugccagcauagaauuguauaccaagaguugacaaacuuucuuuuuaaagggccagguaguauauaucuuagacuccugggccauguaagaucucugccacagcuauucugcauuguugcaugaaagcagucauaaacaaucauaagcgaaugggcauggcuguguuccaauaaaaccuuacuuacagaaacaggcuacuaguccacgggcuguaguucccuacccuucuauauccaguagaaaauauacuucaaaaaugaagaacuaaagauauuuucagaugaacaaauacagaggggauuaaucaccggcagccuuacaguaaagggaguuccguaagcagaggagaaugacugcagaaggaaauacagagauucuaagaggaaugaggagcaguggaaagaauaaaguguggguaaacuuaacugaauguuaauuguaugcaauaauaauguccucugggauuuagaauauagaauugaaauauacaccaacaaagcacaagcagcugguauagguggauggaagaagugaagcuuaagguccuugaauugcccaggaaaugguauaaguacuaauuuauauuaggccuugauaaaucagggaugcaaguuauaauuucuaggguaaucacuaauaguaguaaaaguaaagguaauagcaaaauaaaaguaaauaguaaaaggaugcauaacauaauaguuuauaaagaaaaaaauggaauaauaagaauauuuaauccaaaaaaagguaaaacaagauaggaaaaggaacauagaguaaguaggcagauagaaaacaaauagcgagacaguagauuuaaugccaguuaugucagcacuggaaugaaaacugacucaagauaccaguucaaugacagauuugucuaaguggguuuaggaaaaccaaugaacuaugauacaaaacuguacuuaacuguaaugagucaaauauugaaagcaaaaggauagagaaaaagguauaucacacucuuaacccacagacagcugguuuaugucuauaucugacaaaauagacuuaagaaggauugcuagaggcaaaauaguaacguuucauaaugaugaaagcacagucuaccagaaaaaaugauucuaaauguguguguaccuaauaauguaaccuuauguuauauaaagugaaagaugucagagguacauguuaacaauuuuuuuuuuuuuuuuggagacaggagucuugcucugucgcccaggcuggagugcaguggugugaucucggcucacugcaaccuccagccccuagguucaagugauucgucugccucagccucagccucccgaguagcugggaccacaggugugcaccaccaugcccggcuaauuuuuguauuuuuaguagaggugggguuuugccacguuggccaggcuggucuugaccuccugaccucaagcuauccaccugccuuggccucccaaagugcugagauuacaggugugagccaccacgcccagccacaaauuuuuuauuuguaaauaauuuuaagcucacagaaaagugcaagaauaaaaacagugcaaagcacaacuuuguauucuacccaaauucauuguuaacaucucacuacauuugcuuuaucauuccucaccccucccuccacauaagcacacauacacagauauguguguguauacauaauuuuucccucugaaccuuucaaggguaaacuauauauaucguggcucuugacccaaaauacuuuaguauguauuuucugagaauagugauagucuuaagagucuuaagguacaguuuuuaccuucaauauauuugacauuguacaaugcuuuaaucuacuguuuguguuucauucugucaguugaccugcaauguccuuuguguaauuuucaacgugcaguacaggauccagucuaggguuagguauugcauuugauugccacacuuuaaucuagaacagaggucaacaaacauuuucuuuacagggccugauaguaaauauuguuggcuuugucugugucauagaucucugucacaucuaaucaccucugcuguuguagagagaagcagccauugacuauaaguaugugaaaggauacagcuguguuucaggaaaacuuuaucuguauaagcagacagcaggccugauuuggccuggcagcuguaguuugccggucccugauuuagaauauuuguacugccuuucuuuuucuuuauuuuuuguuuuuuaaugauauugacauucuuugauuaauacauucccccucuuuuaauccaguuccuuauuuugcguuuguuuuguuuucccaucauuagauucaaguuacgaauccuugaccaaaauacugcauaggugaagggguguucuucuuagaucuggaggcauacguugcccaucugucugauuuuuuuaauguugauuuuauucuccuguuugaggugcugucuuauuuuuccacuauauaauuacuauuuuuuuccuauuugcaaucaauaagcagucuguggggagaugcuuuaagaccaugcacauaugcugcugcucaucagaauuuccuucuacuuuuuagcauccacugcuaaugggaaaaguaauuuuaauacucucucaguaguucguagaacaaaaagauuugaaaacacuuggccuaauugacauauacagaacauugcacuauauaguuucuguauacuucuaaauauucaugaaucaaagaagaaaucaccuuggaaauuugaaaauguuuugaguggaauggcgaugaaaguauuaucugucaaaccuuugagauacagcuaauggcauucugagaauuaaaauuguagcuuuaaaugcauacauuaaaaaagaaaggugaauaucuaaguuuucaacuccaaguagaaaaagcacuguacaauauguuccuaaagggaagaaaacaauaaagauaaauuaguugaauauaaaacagguacagaagcgaggauuaacaaagacaaacauuagaaaagacuaauaaaacugaucaacugcuggagagauugauaaaggcaaaaagaaaacaaaugacugguaucaguaauaggaaaggggagaucacgguagaucuuaacagacacugacaaaaucaggaggauuuuuuuuaguagguuuuuuuuuuaauauaagcuacauuuucaguuuguuuuguuguauaauuuuuaaacuauauggcacaacacaguaaauacucauaggaggucgagaaacuauacaagaaacaauuggaauaaaucugguagauuguuucuauuuagacauuaacucuguuuaucauuugaggaauucuccauaguuguaccagaggugauugauuauuaaaucuauuaauuagauacaaaauacuaauauguucuguucaaaagaagucagcaaggcguaguuaucacacagaucaacaacgaagaaagacauguuuuaggacauuugaaaaaaucacacguagcuuauuuucuugacaaucuuaaucaugacaaaaccuggguuucacugacuagauaugaaauguguggggcauuuguuuacuacauguuuaagcaugguuagaacuacaaucugaaaaauguuuuaauuguacagccuuauaauuauuucaaucuaaauaucagaggaguuaauaacaucaauuaauuucaaaauuaugcuucuguuuuugugaggccaaguauaaacuguuuuuggcaaaaagaaaagcuaguuuuaccugacuuuuuuuuuuuuuggaaggccugcacuggguuauguguucuuuuuucuuuuauauauauauauauauauauauuuuuuuuuuuuauuauacuuuaaguucuaggguacaugugcacaacaugcagguuuguuacauacguauacaugugccauguuggugugcugcacccauuaacuugucauuuaacauuagguauaucuccuaaugcuaucccuccccccuccccccacgccacaacaggccccagggugugauguuccccuuccuguguccagguguucucauuguucaauucccaccuaugagugagaacaugcuguguuugguuuuuuguccuugcgauaguuugcugagaaugaugguuuccagcuucauccaugucccuacaaaggacaugaacucaucauuuuuuauggcugcauaguauuccacaguguauaugugccacauuuucuuaauccagucuaucauuguuggacauuuggguugguuccaagucuuugcuauugugaguagugccucaauaaacauacgugugcaugugucuuuguagcagcaugauuuauauuccuuuggguauauacccaguaaugggauggcugggucaaaugguauuucuaguucuagaucccugaggaaucgccacacugacuuccacaaugguugagcuaguuuacagucccaccaacaguauaaaaguguuccuauuucuccacauccucuccagcacccguuguuuccugacuuuuuaaugaucgccauucuaacuggugugagaugauaucucauggugguuuugauuugcauuucucugauggccagugaugaugagcauuuuuucacgugucuguuggcugcauaaaugucuucuuuugagaagugucuguucauauccuuugcccacuuuuugaugggguuguuuguuuuuuucuuguaaauuuguuugaguucuuuguagauucuggauauuagcccuuugucagaugaguagguugcaaaaauuuucucccauucuguagguuuccuguucacucugaugguaguuucuuuugcugugcagaagcucuuuaguuuaauuagaucccauuugucaauuuuagcuuuuguuaccauugcuuucgguguuuuagucaugaaguccuugcccaugccuguguccugaaugguauugccuagguucucuucuaggguuuuuaugguuuuaggucuaacauuuaagucuuuaauccaucuugaauuaauuuuuguauaaaguguaaggaagggauccaguuucagcuuucuacauauggcuagccaguuuucccagcaccauuuguuaaauaggaaauccuuuccccauuucuuguuuuugucagguuugucaaagaucagauaguuguagaugugugguauuauuucugaaggcucuguucuguuccguuggucuaaaucucuguuuugguaccaguaccaugcuguuuugguuacuguagccuuguaguauagucugaagucagguagugugaugccuccagcuuuguucuuuuggcuuaggauugacuuggcgaugugggcucuuuuuugguuccauaugaacuuuaaaguaguuuuuuccaauucugugaagaaagucauuggcagcuugauggggaugguauugaaucuauaaauuaccuuuuucaccauauugauucuucuauccaugagcauggaauguucuuccauuuguuugugcccucuuuuauuucguugagcagugguuuguaguucuccuugaagagguccuucacgucccuuguaaguuggauuccuagguauuuuauucucuuugaagcaauugugaaugggaguucacucaugauuuggcucucuguuugucuguuauugguguauaagaaugcuugugauuuuugcacauugauuuuguauccugagaguuugcugaaguugcuuaucagcuuaaggagauuuugggcugagacgaugggguuuucuagauauacaaucaugucaucugacaagccccagugagaugaaccugguaccucaguuggaaaugcagaaaucacccaucuucugugucgcucaugcugggagcuguagacuggagcuguuccuauucagccaucuuggaaccacccucaggaggauauuauuaaugacuauuccaauacauugaaaauuuuagaugacauggcaaauuucuagaaaaaccaacuuauaaaaagaaaacuccauguccagaaagcuucaccagucaauucuucccaacuauuauagguauuucaccaauguuacagacucuuccagagcauaggaaaauaggugaaauucuauucuuguuuucauacagccagcaucauuuuguuauaaaaaccugaaagaaaaggaaaacagcaagucagucugucuuaugaacauagauggaaaaaauguaaacagaauauuugcagacuguguuuagugaaauacugagauaaucaugaccaaguggguuuauuugagaaauuuaagguugauuuaauauuugaaaaucaguaucauucgcaacauuuacaguauaaaugauuauuuuaguagauagauaauuuuaaaaaauagaauucaauacguuaaugauaaaaaccuuuaacaaacuaggaauggaaaauacuuccuuggcugggugaggugacucaugccuguaauccuaacacuuugggaggcugaggugggaagauugcuugaggccaggaguuugagaccaccgugggcaacauagugagacugucucuacaaaaaugacaaaauuauccaggcaugguggugugugccucuagucccagcuguuggggaggcugaagugggaggaucgcuugagcccgguugguugaggccgcagugagccaugaucccaccacugcauuccagccuuggugacaaagcaagacacugucucaaaaaaauaaaagaaaaaaagauacuuccuuaauauauuaggagcuuguacaaagaauuuaggauaacuaucacacuguguggggaaauacugaaagcuuuucccugagauugggaauaagacaggauacuuccaucacaaguucuuuucauuuucaguauuguaaugaacgucuaaaacagcugcaguaaggcaagaaaaguaauaaagugauaaauguuagaaaggaaaaauagaauuuuuuaaacagauguuaugcuugcauuauuccuaguuuuuacuuggaauaaucaggagaaugguguuaccauucuagagaugaaaauuuggugguuaaaaauguauauaggugguauguaaagcuuugagacagugugagaucaccuaccuagugaauuaggcagagaaacaggcuuuagguagagaagcgaggcuacuuuuuagagauugggaaggcagguagauuuacuaaagugaacugagaagaagcugccagggaauccagaguggaggguuuuggggaccaagugaaaaggguuuuaagaagagaguuacuagcuuuuugaaugcugugagauuuaccuuauguaccuuaauaaagggauuucagaggaggguaaggguuaaaguccaguuggaguugguuaagaaauuuggugagagcauugagucaaaguagacaacuuucaacaagauuuuuuauauaaaagugagaagagaaguagacaguagccugaagaauaugagcagaaggggguuuguuuuuuuagaagagaaugcaacagcucuucuguaagcugauccagcagaagguaaaaguauugggugaaaguuagaauuagguuuggucuggugaugcccuugauuggguggaguuugagaauucuggacccagguagacgaugcaacucugaaugggcuuaaaccauuuauccuuuguaacuagaggagaggcauaguacgugcauuuagucaugggaaaaaaauauauaguucucuccucauuaguuauucuuucuacaacuauucacugagugccauuagaaugccaggcauacuuuuaggcacuggaaauagucaacagaacaggcaaaaauccaugcuguugugaaguuuacauugcacuggaagaaaguagauaugaaacaaguaagauaucagcuaauuaucagcuaaaauugaagagagggaagaagguuuagcaaauugagagaaaauaagguguaaaaagugaauugaccagggaaaugaauuauugauugacccacagugcggagagucuguaugagauguguguuuauaagugugaaaagagaccaaauagcauaauauuuugucucuagccuuaucuagcugcuuguugguauauaagaguaagcagagaguugggcuucuccagguuuagaguugccauacguauaacugcagcuuaccaaggugccauugaguguaaaaugcacucuuauuuugugaacugagaaaaaacacugucauuuaaacuguggcaugccauagauuuuauaauauauccugauuucugagcuauuaguuuuaaaauuguucauuuuagaauuaguaaaauaaguaguugggauacuuuugauuggaaacaacagaaaacccaaacucagaugcacuuuaauaauaaggaggagccaagggggauaugaagaaaauggcagccugaaugaggccugcuuccuugacucccucagcuaccuacuagcucucugguucucuugagccagccugcugcggggcccuacagaaaacuguaggaucugguuuucuguucuuguguuaguuugcugagaaugaugguuuccagcuucacccaugucccugcaaaggacaugaacucauccuuuuuuauggcuguguagcauuccaugguguauaugugccacauuuucuuuauccagucuaucauugaugggcauuuggguugguuccaagucuuugcuauugugaacagugccauaauaaacauacaugugcaugugccuuuacaguagaaugaauuauaauccuuuggguauauacccaguaaugggauuguugggucaaaugguauuucugguucuagaucuuugaggaaucgccacacugucuuccacaacgguugaacuaauuuacacucccaacaguguaaaagcguuccuauuucuccauguccuccccagcaucuguuguuuccuguaaucugucuaccuuuuaaguuuaaauuccccaugaaaaaagaguuuuaaaaguuaugccauagaaaaagauuaauagcacgagaaaaggcuaauuauuagguuuaaaaaauagguuacauauaauauguacaauauuaucuccacuuuaaaaaaaaucuauuuauccaugcauaggaaaaaacuacuaagccauacaccaaagugcauaugugguuaucauuaggaaucauaaguuuaaauaauuugagaauucuuuuuacuuuuucuccauuuuccaaauuuucugcacugaccaugcagaaaccauugcaaugaccauugcuuuuacaaugagaaccagaaaagccuuuuaaaaauuaaacaaaauuuuugggaggccaaggaggguggaucaccugaggucacaaguucgagaccagccuggccaacauggugaaaccccgucucuacuauaaguauaaaaauuagccagguguaguggugggcaccuguaaucccagcuacuugggaggcugaggcaagagaauugcuugaacccaggagacggagguugcagucagccaacacggugccacugcacuccagccugggugaugaagugagacuccgucucaaacauaaaaaaaaaaauuaaacaaauuuuuaacaacucagcaggcuuagucugcuuucuuucacagucugcauuuuuugggcccuggagccccaggagucuucguagcuucccacucagguuaagauacagcacauauuuccagcuucuacagguggccucuuugcacauagaaucgugaccuuuauuuucaacaucugaagcauugcuacuuaucuauauugauuaacuuagcugaguucuccucuaccaucuaauuagauuugguuucuucacaguggagcacaggcuaucuucaguguguucuguacauacaagcaacuuuauaaccaucuuuguauccauacuuuguuagacugguuuuuguguugugggaaugacugauucacuaagauguccaggauguuggcaauccaguugagggacgugguauaacgggacccagcacugcauucgaauuucauccuuggacaagacaaguaacuucucugaccccaaauuucuaccgguugcuccccugccugcaggcuccgugcuugguaucucagaaaaccuucccgaggaaaaagcccauaagggacaagucccggcccaacuuaaaaucacauuaugcuaugugaaaaaagccaaacacgaaaagacacaugguuguaugauuccauuuauauaaaaugucuggaauaagcaaauccauagagauagaagguagacuaaugcuugcuggcagggagugacugcuaacgucccaaauuagauagugcagauguuuguucaacucugugaaacauacuaaaagucacuuguacacuucaaaagaguaagucuuacggaaugugaauuaaagcucaauaaaacucuuauuaaaaaguagauaaaaggguuaauaaucucucuacugaacaauuaucccccauaaugaauccuguuucaucuguacuccuacccaccuucucccccauauuauuuuaaagcagcauauuauuucauuuauaaauauuucaguaguuuggguacuuaaaaaauacauaaccacaauaguauuaucaugccuaaaaaauuuaacauguaauaaaauauucagucagugcucaacuuucuaaucauguuuuuagacugcuuagcauuuuguuguggagauggaucauaauauauuuaaccaguuccuguugaugaagcuugagguuauuucuaacuuuccaacugauaaauagugcuucaauaaacauccuuauauauaaaaaaaaaaaaaagaaagaaaacuguaggaucugguucuguagugauccuuccaagcagagagaacugguguauagcuggccauuguagcaagaggcaaggaccaugaagcugcagauccuggaagaugggacauagcacccauuuauguaguguguauguaggccuucuugaucucuacaaggccaguguauugcugaaugguugggcagagucuuaaccugugcuugaggcugaagcaguacugggagaucugagaacggagaagauuccuauagguuaacacacaguguacucagagccugucugcuugaauacauccaugugagacuggcuuuccaaauuuuaaauuaaaaaucuagaacauuuaaagagaguuaaauguacuuuuucaaacaaauaacuuucuggagcugaaaucuaugauuuccucauuaaacaauucaguacaugaauuaaaagaggggcagugcaagaaauuuuuggagagcaaauguauaaagauagaaaucaugaaagcaaagaaacuuggaggagaaauuugagauguccaaaauuugaauaauaugacuuccagaaggagagaaagaaacagauggaagaaaagacuacguauuguguacaguguacacugcuugaaugaugaugggugcacuaaaaucucagaggucaccgcuaaagaacccaucuguguaaccagaaacuaucuguaucuccacaacuauugaaaugaaaagaaaagaaaagaaaaaggaaacggauggauguggcaguaagccacaggagaaaaaaagacagguaucacauuucaaauuugaacacuguagcuaaaaagcaguggauuagcaucuagagcuacugagagaaaaaugacugcaauccaagaauaccauauccagccaagguauuuaucuguacagguaaaagaaagauguuuaaggaucuauauaaauucagaguauaccacucaaguauccuauuugaggcaaauaaaugaagcagaacagagacuauaaaauugaagaagagagugaagagcggugaacagugaacuuguuuuuauguuuaaaauuauaucguaauggaugagguugggcugggaauauauaagugcuacauuagaccucuuuaauagaauggacauaaggaaaaguuuugaaugaguauugagcugucucugcaaaauauaggaauuaggaugcucugcagaaaaaaaugugccaaaggugucauagaguagagagggaagggaaaggaagaaaggguagauguaucuuaggagucucauuuuugggguugggaauaggaaaggaguggguaaguguggaguauuuuuguaggggaaauguuugacaucuuguuuauaaauuauaguaaagacauaugcuuucaacagugaaaggcaggaaagggaagauaaccauugauaagauggaaaaguucaguaguauuuccagguaaagggggaaaugaaaugaaugacaacuuuuuucuuuuuuucuuuuugagacagaaucuugcucugucacccaggcuggagugcaguggugggaucuuggcucaguguuaccuccgccuccuggguucaaaugauucuugugccucagacucaagaguacuugggauuauaggagugugccaccaugcccagauaauuuuuugguaguuuuaguagagauggaguuucgccauuuuggccaggcuggucucgaacuccuggccucaagugaucugccugccucagccucccaaagugcugcgauuacaggcaugagccagcguaccuggccugcacgccaacuuuaucacacuaguaaaauaaggaaaaagaaaagagagcaauguaaauaagcaacaaacaaaauauagauggaaagaacaaaauuaauauuuaggucaucuacuaaaugugaauaaauuauguagucucaugaaaagaaaacuggaguggcuauauuaagaucgaagucgacuucaugugaauuaacacaggaacagaaaaugaaacaccgcauguucuuguaagugggagcuaaacaaugaauacauguggacacaaagaugggaacaauagacaggggguacuacuugagaggggagguugggaggcgggguuggguugaaaaacuaccuauuagguacuaugcguacacacaggucaaaggagaaauaagggaaaucagaaaaaaacauuuuggaaugaaugaagguguaugcaaaguauuagguacuuugcauacaaaggauucuuuguacaucaaaccucggcaacacgcaauuuacgcaugcaacaaaccugcacacauaccccugaaucuaaaauaaaagucaagagaaaaaaaaaacccaaaaacaaaguagauuucacacaaacaaggaauauuaacagagauagaaauauuucauaaagacaaacauguaaauucuucaagaagacagaacaguccugcauuuguagguguuuagcaacagaguucuaaaauacaugaaguacaaauggucagaacuaaaaugggaaaugugcaaauccacaauuauaguugcagauuucaacauuugccuuucaauaucaauaaaacaaguauacagaaaaauaagaagguuauagaagacuugaauaacacugucaauuaacuugacauaauugguacuuagagaacaugauacauaucaacugcagauuacacauugaagugcccuuggaacauucaguaaaauagacuauaugcuggauaauagaacaagucucaauacauuuaaaagauuugaaaccauaugucauguguucuguuuugaagacagggucucgcuugcucugucacccaggcugaaguguugggauuguagcucacugcagccucuaucucugggcucaaaugauucucucaccucagccuccugaguagcugggacuacagguacacucuaccacauucagcuaauuuuuuuuuuuuuuaauuuuuaguagagaugaggucucacuauguugccuaggcuggucuuaaauuccuggccucaagugauucauccacuuuggccucccaaaaugcuaggguuauagacgugagccagaguuucuguggaauugcaauagaaaucauuaacaaaaagauaacuagaaaaauucccccaaacauuuggaaauuaagcaacaucuaaauuacacauaggucaaaggagaaauaagggaaauuagaaaaacauuuuggaaugaaugaaaguguaaacacagucuguuacauuuguggaaugcagcuaaagcaguauauagagaggaauuuguaccugcaaaaguuuuuauuagaaaagagaaaagauguaaauguucuaaauuuccauagccagacuaccucucuagauuccuucucucugggcagggcaucucugaaagaaaggcagcauccccagucaggggcuuauagauaaaacucccaucuuccugggacagagcaccugggggaaugggcaucugugggcacagcuucagcugacuuaaacauuccugccugccggcucugaagagagcagcagaucucccagcacaccacucgagcucugcuaagggacagacugccuccucaagugggucccugacccccgugccuccugacuaggagacaccucccaucaggggucgacagacagcucauacaggagagcuccagcugacaucugguggauaccccucugggaugaagcuuccagaggaaggaacaggugguaaucuuugcugaucugcagccuccaguggugauacccaggcaaauagggucuggaguggaccuccagcaaacuccagcagaccugcagcagaggggccuguuagaacaaaaacuaacaaacagaaaggaauaggaucaccaucaacaaaaaggacguccauacagaaaccccauccaaaggucaccaacaucaaagaccaaagguagauaaauccacgaagauaaagaaaaaccagcgcaaaaaggcugaaaauuccaaaaacaagaacgccucuucuucuccagaggaucacaacuccucgccagcaagggaacaaaacuggauggagaaugaguuugaugaauuaacagaaguaggcuucagaagguggguaauaacaaacuccuccaagcuaaagaagcauguucuaacccaaugcaaggaagcuaagaaccuugaaaaaagguuagggcaauugcuaacuagaauaaccaguuuagagaagaaugugaaagagcugauggagcugaaaaacaaagcacaagaacuuugugaagcauacacaaguaucaauagccaaaucgaucaagcagaagaaagcauaucagagauugaagaucaacuuaaugaaauaaagcaugaagacaagauuagagaaaaaagaaugaaaaaggaacaaacaaagccuccaagaaauaugggacuaugugaaaagaccaaaccugcguuugauugguguaccugaaagugauggggagaauggaaccaaguuggaaaacacucuucaggauauuuuccaggagaacuuccccaaccuagcaagacaggccaacauucaaauucaggaaauacagagaacaccacaaagauacuccuugagaagagcaaccccaagacauauaaucgucagauucaccaagguugaaaugaaggaaaaaguguuaagggcagccagagagaaagacugaguuacccucaaaggguagccuaucagacuaacagcagaucucucagcagaaacccuacaagccagaagagagugggggccaauauucaacauucuuaaagaaaagaauuuucaacccagaauuucauauccagccaaacuaagcuucauaagugaaggagaaauaaaauuauuuacagacaagcaauugcugagauauuuugucaucaccaggccugccuuacaagagcuccugaaggaagcucuaaauauggaaaggaaaaccaguaccagccacuguaaaaacauaccaaauuguaaagaccauugacacuaugaagaaacugcaucaacuaaugggcaaaauaaccagcuagcaucauaaugacaagaucagauucacacauaacaauauuagccuuaaguguaaaugccccaauuaaaagacacagacugacaaauuggauaaagagucaagacccaucggugugcuguauuuaggagacccaacucaugugcaaagacacacauaggcucaaaacaaagggauggaggaguauuuaccaagcaaauggaagccaaaaaaaaaaaaaaagcagggguugcaauccuaguaucugauaaaacagacuucaaaccaacaaagaucaaaaaagacaaagaaggacauuacauaauguuaaagagaucaaugcaacaagaagagcuagcuaugcuaaauauauaugcacccaauacaggagcacccagauucguaaagcaagucuuuagagaccuacaaagacacuuacacucccacgcaauaauagugggagacuuuaacaccccacugucaauaucagacagaucaaugagacagaaaauuaacaaggauauucaggacuugaacucagcucuggaccaacaggaccuaauagacaucuaccgaacucuccacccccaagcaacagaauauacauucuucucagcaccacauggcacuuguccuaaaauugaccacauaauuggaaguaaaacacuccucagcaaaugcaaaagaauagaaaucauaacgucccucagaccacagugcaaucaaauuagaacucaggauuaagaaacucagaacugcacaacuacauggaaacugaacaaccuucuccugaaugacuacuggguaaauaacgaaauuaaggcagaaauaaauaaguucuuugaaaccagugagaacaaagacacgacauaccagaaucucugggacgcagccaaagcaguguuuagagggaaauuuauagcacuaaaugcccacaggagaaagcaggaaagaucuaaaaucgacacccuaacaucacaguuaaaagaacuagagaagcaagagcaaacaaauucaaaagcuagcagacaagaaauaauuaagaucagagcagaacuaaaggagauagagacaugaaaaacccuucaaaaaaucagugaauccaggagcuguuuuuugaaaagauuaagaaaauagacugcuagcuugacuaacaaagaagaaaagagagaagaaucaaauagacacaauaaaaaaugauaaaggggauaucaccacugaucccaaagaaauagaaacugccaucagagaauacuauaaacaacucuacgcaaauaaacuagaaaaucuagaagaaauggauacauuccugaacacauacacccucccaagacuaaacgagggaaaaguugaaucccugaacagacuaauaacgaguucugaaauugaggcaguaauugauagccuaucaaccaaaaaaaagcccaggcccagacagauucacagccgaauucuaccagagguacaaagaggagcugguaccauuccuucugaaacaauuccaaacgacagaaaaagagggacuucccccuaacucauuugaugaggccagcaucauccugacaccaaaaccuggcagagacacaacaaaaaaagaaaauuucaggccaauauccuugauaagcaucgaugcgagaauccucaauaaaauacuggcacaccgaauccagcagcacaucuaaaagcuuauccaccacaaucgaguuggcuucaucccugggaugcaagauggguucaacauaacggaaaucaauaaacguaauccaucacauaaacagaaccaaugacaaaaacacaugauuaucucaauagaugcagaaaaggccuucaauaaaauucaacagcucuucaugcuaaaaacucuaaauaaacuagguauugguggaacuuaucucaagauaauaagagcuauguaugacagacccacagccaauaucauacugaaugggaaaaagcuggaaccauucccuuugaaaacuggcacaagacaaggaugcccucucucaccacuccuauucaaccuaauauggaaguuuuggccagggcaaucagacaagagaaagaaauaaaggguauucaaguaggaagagagaaagucaaauuaucucuguuugcagaugacaugauuguauauuuagaaagccccaucgucucagccccaaaucuccuuaagcugauaagcaacuucagcaaagucucaggauacaaaaucagugugcaaaaaucacaagcauuccuauacaucaauaauagacugugcaaaaauuacaagcacuccuauacauaauaauagacaaacucaugagagccaaauaacgagugaacucccauucacaauugcuacaaagagaauaaaauaccuaggaauccaacuuacaagggaugugaaggaccucuucaagaacuacaaaccacugcucaaggaaauaagagaggacacaaauggaaaacauuccaugcucauggauaggaagagucaauauagugaaaauggccauauugcugaaaguaauuuauagauucaauacuauccccaucaagcuaccauugacuuucuucacagaauuagaaaaaacuacuuuaaauuucauauggagccaaaaaagagcccauauaaccaagacagccccaagcaaaaagaacaaagcuggaggcaucuugcuaccugacuucaaacuauacuacaaggcuacaguaaccaaaacagcaugauaccaaaacagauauauagaccaauggaacagaacagaggccucagaaauaacgccacacaucugcaaccaucugaucuuugagaaaccugacaaaaacaaacaauggggaaaggauucccuauuuaauaaauggugucgggaaaacuggcuagccauaugcagaaaacugaaacuggaccccuuccuuauaccuuauacaaaaauuaauugaagauggauuaaagacuuaaacguaagaccuaaaaccauaaaaacccuagaagaaaaccuaggcaauaccauucaggagauagguaugggcaaagacuucaugacuaaaacaccaaaggcaaaggcaacaaaagccaaaauugacaaaugggaucuaauuaaacuaaagagcuucugcacagcaaaagaaacuaucaucagagugaacaggcaaccuacagaaugggagaaaauuuuugcaaucuauccaucugacaaaggacuaauacccagaaucuacaaagaccaaauuuacaagaaaaaaagcaaacaaccccaucaaaaagugggcaaaggauaugaacagacacuucucaaaagaagacauuuaugcagccaaaaaacaugaaaaaaaguuaaucaucacuggucauuagagaaaugcaagucaaaaccacaaugagauaccaucucccaccaguuagaacggugaucauuaaaaaggcaggaaacaacagaugcuggagaggauguggagaaauaggaacgcuuuuacacuguugguaggaguguaaauaaguucaaucauuguggaagacaguggggugacucaagguucuagaaccagaaauaccauuugacccagcaaucccauuacuggguguauacccaaaggauuauaaaucauucugcuguaaagacacaugcacacauauguuuauugcagcacuacucacaauagcaaagacuuggaaccaacccaaaugcccaucgaugauagacuggauaaagaaaauguggcacauauacaccauggaauacugugcagccauagaaacaaaugaguucauguccuuugcagggacaugaugaggcuggaaaccaccauucucagcaaacuaucacaggaacaaaaccaaacauugcauguuuucacucauaagugggaguugaacaguuagaacacaugaacacagggaggggaacaucgcauacuggggccuguugggaggguggggggcuaggggagggacagcauuaggagaaauaccuaauguagaugacggcuugaugggugcggcaaaccaccauggcacguguguaccuguguaacaaaccuacauguucugcacauguaucccagaacuuaaaguauaaaaacaaacaaaaaaaccagaaggccgggcgugguggcucacaccuguaaucccagcauuuugggaugcugagguggguagaucacgagaucaggaguucaaaccagccuggccaagauggugaaaccccgucucuacuaaaaauagaaaaauuagccgggcaugguggugggcgccuguaaucccagcuacucaggaggcugaggcagagaauugcuggaacccaggaggcggagguugcaguugaccgagauugcgccauugcacuccagccugggcaacagggcgaaacuccgucucaaaaaaaaaaaaugugguacauauacuccguggaauacuaccaccuguaaaaaugaaugcaguuguguccuuugagcagcauggaugcagggaggccauuauucuaagugaauuaaugcaguaacagaaaaccaaauaccacauacucucacuuacaaguaggaacuaaucauugaguacacauggacacaagggagcaacagacaccgggaccugcuugaggguggagagugggaggagaguaaggauugaaaaacugccuuucagguauuacgcugauuacuugggugauggaauuaucuguacaucaaaccccugugaaaccugcacauggaccccuugaaccuaaaauaaaaguuagaaaaaagggcaaaaauaauaacaagcacauuacaaaauaauaugugcagaugaucaguaaacaccagaaaggguacucagaaucuuuuuuaucuuauuuuuuugagacaguuucucccucugucauccaagcugcaguacaguggcaccaucuuggcucauggcaaccucugcuuccugggcucaagcaauccuucuaccuuaaccucccaaguagcugggacuacaggcgcauaccaccacacuuggcuaaguuuuuuguguuuuuguagagacuagguuucacuauguugcuuaggcuggucuugaacuccugggcuuaaaugauccaccugccuuggccucccaaagugcugagauuauagacauaagccacugugcccagccucugaaaaucuuuaaauaucagaaaaauacaaauuuauaccauaaugagauagaauagugcauaccuacuggaauaagcaauaaaaagucugauuauaccaaaugugggaacugauguggaauaaguagaacucucauaucuugaaaaugugauuguaagguggaaacaguuuggcaguuucuuaaaaauuuaagugcauaucuauacuuuaauccagugauuucauuuuguauauuuauucaagagaaauguagauaccuguccacagaaagauuuauacgugucuuaacuucauuuauaaaagccuauaauuacguaauccaaguguccaccaauaaacaaguuguguauuuucauacaagagaauacuacucagcagugugaaggagcaaacuauugauacaauacuuagaaaaguuauguugauaaaaagaagcaagacacaaaagugucuuugauuccauuaagucaaauucuguaaaacugaucuauagugggaaagauaagaucaauguuugagguggagguugggagagauuaccuggagagggauauaagagagcuuuugggggugaggaaacuguuuuauauccuguuugaggagauuacacuuuguguauacauuugucaaagcuuaucaaauuguacacaucaguggcugcauuuuauuauauguaaauuacuuuucacuaagauugauuaaagauuugguuggaaggaaucaaauugguauagcagucacuaaacuaaaugcaaacagauuauauauuguggcaguaaaauacugucagguuaguuuaagaaacaaaaccuaaccaaguccuguuucgaagaagcaaacuauugaaaacuugauaaguaaagcugaaaauaaaagaguugaauaaagauguaagauacaggaaaauaaccaaaagaucaauaauuauaauaauauuagacaaggugaaauuuaaauaucaaacuagguaaguggauuguuaacaucauaaaaggcauauuuuaugaaaauccaauagccauaaucuuguauggcuaaaaagcuuaacacauaaagcaaaaauaaucugaguagugugguagagcaggcaugguaugagauuuauauauauauauaauauauauauuaaaaaauuauauauuauauauauauguuuuuuucuuuuggagacagaguuuugcucuuucucccaggcuggagugaaguggugcgaucucagcucacugcagccucugccccacagguucaagcgauucuccucccucagccucccgaguagcugggauuauaggcacuugccaccaugccuggcuaauuuuuuuuucuuuuuuuuuuuuguauuuuuaguagagauggguuuuugccacguuggcuaggcuggucucaaacucccgaccucgugauccacccaccucagccucccaaagugcuggggauuacaggugugagccacuacgccuggccaggauuucaguacauguuuaucagaauuaggucuaguagaugaaaauacgaguauaaggaauugaauagugcauuuaauaaucuuaaucauauguguauagaaauaguguuuuaaauuccuggaauagaucuuuuuuuaauguccaaggaacuguggucaaaguuuaauguccaagguacuugaccauaaagaaaaucuuaacagaugagaaaaguugagauuuuauaggcugcguugucugguaauaauacugguaaaguagaaagaaauaacuaugagacgaguccuuugaaaccugccuccuguuccccuauucucccuauauuuguuuccacugcagaauuaccucaguauucuugaacuaagaaauuggugguggcaaggucuuuauucuucauauuuuagccuuacauuauugaaaugccuuucaguuugaugccuuugugugacugccagugaacuagguuuuccuaguguacagguguugcccaugcccacaccuagauuaucaaugauacuguaaaacuugaccugaaauuuuagguugauauuccuggccuuucucuuucaaauuccuuuaaacuuuuaguaaccacuuguuggccauuuauuagaacacagggaauuuugaauuaaaaacucacauaauuuaaaagaaacaggaacaccuagugcugagaggauguggggaauagcauauucucauacauugcuggugcaaaugugaauuguuacagccuuuuggaaaauaauuugacagcuugguuaacaauuaaaauucauauuccuuuuggccuaguauaccuccuccuaagauuucuacucuuagacauaaaagcccaaguaaggccauauguauagggauauuuauugcagugaugugcauauugucagucaacugaaaacaaaaugaacauuaguagggaaaggcaggaaaaagugauaccuccauaggugggauacuaugcuacauaaagaaaaaauaaauuagacuaauaccagauuaguuugagaaauuuccguaagguuuuguugagugagcaaagaaagaugcagaaaaguauauaauaauuuguguaaccaaaaaauaauuuaagagaaccaugccuauaucauaggcucaugaguaugaagaaaaguauuuaagaauuccugguaggugguuaaauguuuaccuuggucaagggugggucagaguaacuggggaaguggguuaaaacaacaacaacaacaacaacaacaagauucgucugugaucauaucuaugcauuaucuguaaaauuauauaaauauguauguuuaaagauacuaaguaaacauuuaaaauaaaacugaccuguuucccagccuggacaacauagcaagacucaucucuaaaaaacaaaauuaauuaaaauaaauuagcuaggcauaguggugugugccuguagucucagcuacuccagaggcuuugguaggaggaucaccuaagcccaggaguuugaggcuggagugagccauugagcuugccacugcacuccagccugggugucagugugagauucugucucaaaaacaaaaaacaaaaaacacaaauauuuguuuuauaaaacugaugcugauuugcaaaccuaaguguucacgugaaguccacugaaacucuuaggagcagaagcagcauaguggagagccauaaaaccuuuuauauuaggccccaagacaaagaaucaaggaaguguguacacacacacggaauaaaacaauaaccagugggaaauuuaccuaagaaacuagaagccuagaguaaggugguuuuugugggugguugauacuguuuuucagggacuuugcauuccuuugauuugucauucuugguguuggcuuuguguucaggcauagcacaggcguuguguucaggcuguaguacuuccagcuguaaaauccagcuauagcaaaguccagauagagaagaauggucucuucuuggauguuuaucauagguuguuuuuuaaaaagcauuugcuaaggcugaguuuggguuacaacuugauuauaguauuguagaggaagguguuauuggaaggaaaagcauaauuaggcaaaggaagaaguugagcuccaaugcaggccugacaaaggggaacugugggggcaggauugcuuauuugaguugucccauguuggauugaaaugcuugggccuuuauacucuuuuuuuuuuugagacagagucucacucugucgcccaggcuggagugcaguggcgcgaucuuggcucacugcaagcucugccuccuggguucacgcuauucuccugccucaaccucccgaguagcugggacuacaggcgcccaccaccacgcccagcuaauuuuuuguaauuuuaguagagacgggguuucacuguguuagccaggauggucucgaucuccugaccucgugauccacccgccuuggccucccaaagugcugggauuacaggcgugagccaccacgcccagccuaugguaugggccucuucauggugugggcugccaugggaagggcaugaccuguagcaaggcagccccugaaggaauugauguucugcugaccacauucccugcugcugcuggcagcaaguccuuccuugaagaggagaucuagguggcaugucucccuguccacacacuuuccuaagaauaagaaaauauuuccuggaaaucauccaucagaugugcccucacaucuaaguauuagauuacauucugugucagagauucaugguuacacaucauagccuuuuucuacuucucuaguaaaaagaauucugauuuuuugauggguacaugaucaucugggauaacggcugcauuuuucagccuuccucuacuuguagacaugucaguaacuucuggcuaaucgaauguaaguugaauuuucaugugugacuuaacagagggagagaggguguacccccccguuuucuuuuccuccuuccugcuggguagaauuuggguauaauagcuggagcuugagccgcuaucuuggauuaugagguagaagccacauguuggggaugacagagcaauaguauagaacagcauuaggucccugaugaucauggaaaugcauugcaugcucuggauugcuuaucuuuggguuuuuuuuaucuuggugguuaguccauuacuauuuagguuuuucugacaguugcauuaaagccuaaucuuuuuucuacaucuauaucuauauaugauguauaucuauaucuauauagauacauauucuuuuuuaaaaauagauaugaggguguugcuguguuggccagccugaucuugaacucauggccucaagcaguccuccugccucagccuccaaacugcugugauuucaggcaagagccaccaugccugguccacaccuaauuuuaauugauacagauuucuaaucagucaguggcaaggggcaugggaaaacaugauuggcuucgacuaacauuuugggguggaauggauuuuggggaguagggcauggauacaucucuaucaggcaaguacagcagaggaagagaaaggcaagaacaucagggaguuugcaggauaugauucucgugauggauuauggagucuuaacuagguaugugagaaaaugaaauguguggaugguagguggugaacagugaagaaaugauaguucaauggauugguggucuccauggggccaaagucucauuggaaagggggaauaaacuggagagaugagauaguagucagaggucagggugcuuuuuuugugguaauguuguuacugguaauagcaagggccagagaaggggauggcuaaagagggguggaggaaaagauaguuaauggugagguuaagaaauggagagacuggauuuuggauggaacaucuuagauguugaugcagaugaguggaagagagugaacgauuuguuaauaucuuuagugcauuaggaguagcugggagaugacucagaagguaagggaggcagauccagaagcgagcauguguucagaguggcugauguuaaugaaagagggaagaaaaauaucuggaaacagccaugaugaaggaaauagcguccuucuuaaauauuaaacauuuuuauauaguaacagauacuugcugguggcagugcucaugccuguaaacccagcauuuugggaggccaagauaggaggauugcuugaggccagaaguucaagcgugggcaacaucgugagacucuguuucuacaaaaaauaaauuuaagaaauuuaucgcugggugugagggcucaagccuguaauucuggugcuuugggaagccgagaugggaggaucuuuugaggccaggaauuugagaccagcgugggcaacauagcgagaccugucuuuaccaaaaggaaaaaggaugacauaaaauuaagauaagauuuagguauguuuuguucauuccuguugguuuuaauauuuuucugucuucuuuuuuaauguaugcaauaaguauuuguuucaucuaaauuuaugcaaucugaauauaacuagucauuuucuacugguuauaguguuuguuaauguacccauuauguuuaauuuguauuauauuaagaauuaagaaauauuaauauaugaaaauauauaaaauauauaaaaauauaugaaauuaauauagcagacuuaaguuuucuuucuugauuuaaauuacagacuaacuggaucuucuggguuugugacagauggaccuggaaauuauaaauacaaaacgaagugcacguggcucauugaaggacaguaaguagaaauggcugacuuaauuuuuguuuuuuuagcauagaagucagugugacauuaguuuucccacaaguaaaauuaacaaucuguagcauaaaguucuuaaaacauuacuugauaaccuuucauuugacaagugaauuuuaucuuagccuucauuaauuuaaaaguuucauguugauuuaaugcugcaaaugaauuguacacaccacaaauuuguguauuuccaacuguaauaguucagaaacgguuacacacacacacacacacacacacacacacacacacacauauauauuuauuuauuuuuaugggacagaguuuugcucuugucacccaggcuggagugcaguggcgugaucuccgcucacugcaaccuccgccucccagguucaagcgauucuccugacucagcuccugagcagcuaggauuacaggugcaugccaccacgccaggcuaauuuuguauuuuuaguagagaagggguuucaccauguuaaccaggauggucucgaacuccugaccucaagugauccgcucgccucagccuuccaaagugcugggauuacaggugugagccacugcgcccagccacgguuccauauuuuuaaugguuugcuuaaagcauuagaaaauugcaauauuguguuauuuuucuaaguaucuauuuuuguuguggauaagaaaauuguaauaacuguuauugccuaaaugaucccuucucuggacccacugugucccucuggcuguuggccuuuuuucuccuugucuucaugggagacuuuuaaagcaguacuucucagacuuuuuuggucucaggaccucuuuacacuuuuaaacuuugaggauuccaaauaaguuuauuuauuauuuauuuauuuauuuauuuugagaugucaucucgcucuguggcccaggcuggagugcaguggugugaucuuggcucacugcaacgucugccuccuggguucaagcgauucuccugccucagccuuccaaguagcugggauuacaggcaugugccaccaugcccagcuaaguuuuuguaucuuguaguagagacaggguuucaccauguuggccaggcuggucucgaacuccugaccucaagugauccgccugccuuggccacacaaagugcugggauuacaggagugagccacugcacccggccccaaauaaguuuauguuuuucuauuuguguucaccauauuagaacuuacaaccaagaaauauuauuuauucauuuaaaagcaacaauuauaagccauguuaguacaaaugauauuuuaaugaaaaaaacccuauauuuaaaaaauuguagugaaaaaauggcauuguuuuacauuuuugcaaaucucuuuaauguguagcuuaauaaaagacagcuggauugucauaucuucugcauucacuuuguugcaguauguuauugugguugaagcgugucaagaagaugaggccucacuugaauaugaaguaggaaaaaagagauuuuaauaguacaguauuuuaaaauuauuguauauagucuucuuugauaccauaucaaaacuuaacaaguaguaauuucuuaaaaguaaauugcaguauggaaucugaaacuauguuaaggaacuuuugguacuuguuaaauuaaaauccauugguuuucuugcacugaauggaucuuuugcccauccauauuuugguaacaugauauauaggucauuuggaaaacaacaggucauugaauuaugcagaucuuccauauguugauauauuuauuccauuacauaauauuuuaaaaaucacauugguuaguauccccaucaaucuccucaaaaaguucuaaguauggcaguuaacaaauuuuccaaaauucuaauuacuacuugaaagcuuguauuuuaucuuuggcagcaaauacugucaguuguuuucuuugaaguggcaggcuugcuuuccucauuuuuaagaaaaugucugccagauauccaacucugaauaaccguaguuuauugauuguucuuucaaguaaacaugguaaaugguguucuaagaaaaaaguagcuaguucagcuagcaacuuaaacaguugcaaaagugguuuucauugagaaaaccacugugcuucuauuaagcaaaagaaguguuuuauauauuuuuuucuuguuuuuuuuuuuacauuuuuuuauuuuauuuuuuuauuauacuucaaguucuaggguacaugugcacaacgugcagguuuguuacauauguauacaugugccauguuggugugcugcacccauuaacucaucauuuacauuagguauauccccuaaugcuaucccuccccacuccccccaccccacgacaaaccccggugugugauguuccccuuccuauguccaaguguucucauuguccuauucccaccuauaagugagaacaugugguguuugguuuucugucccugcaauaguuugcugagaaugaugguuuccagcuucauccaugucccuacaaaggacaugaacucauccuuuuuuauggcugcauaguauuccaugguguauaugugccucauuuucuuuauuuuauuuuauuuuauuuuauuuuuuuauuauuauuuuuuucauuucuuuuuuuuauuuuuuaauuuuuuuauuauacuuuaaguuuuaggguacaugugcacauugugcagguuaguuacauauguauacaugugccaugcuggugcacugcacccacuaacucgucaucuagcauuagguauaucucccaaugcuaucccuccccccuccccccaccuauuuacucuccaucuugucagaauauuaaagagaugucuacuaacuggugaggauuuaauaacauuagaaguuuuuaacugcuuaaucaagauauccuuaaaugaaacuggcagcuuuucuuuuuucuaugagugguucguggugaagaauagcagugaucacuaguaccauuugcugcugcugucuugauuuguucuaagaugcccacaguuucacccaccauuucuccuugaaccauuaguaaaugccagcaugguuauaaaauauaugcuaucuuaguuuuacugugaauauaguuuugaccuccugggaccucccauaagggucucagggccuguagcauuuuguggacuucauuuugagaacugcugcucuaaggagcucugcuguguccuaucaguucauugccaccugacacccuccuccacuguuuuucugaaugugcucucaaugguuguuccuccucaguguaagugaaaaacuaagcaacaaacucucauucccccuuuuccuuauucccuacauuuagccugucaguaaguucugucaguuuucccuuuggaaugucuccccaauccaucaccagacugcuuuucaccuccaucucuacagcugggagacccaccaucgucucucuccugggccacuuaauagccuugaaauuggccuccugaguucugcuuuugccccuugcccaccucccacuucucaucucuuaagguuuucucuguuugcuguguuucagauaugcugauuuucuucauguugcuuggacacaucagccucuuucucccuuaagacugugcuguucccuccgucugaaacguuuuucccagcacuuuucacauggcuugucucuugucauucucacaucuccaaagcuuacuggccuaucucccuacgacuuuuugcacugccacaucaccuucuuuuaauuucuucacaguacucaucaccaucugaguuuacuuguuuauguauuuauuuaguugucaaccuagagauguuagaaaagugugggguauaggaaaguucuaaacuggagaaauagaauuaggcaucagcaggauauaaugauguugauauucccagagcuuucugaguggaguguugggcugaagccaggcuagagagugaaggggugagugagauagagucacuggaggaagcaaagucuucugcgaaguuuuaccuuuuuaggaggagaaaggguagggcagguauuugguagagggagaguugggauuugaggcuuuuuguuuuuauuuuuguaaaauaugugauacuuaagcagauuugaauguggaugcaaaaguuccagaugagagggagaugucaaauacuugagaaacagaaagagaaacagaaagagaauuuuggaaaaugggaauuuuaggguuuuuuuaucugguugcugagcauaagcagggaggugggacugggugguuugaaauagucguugagaguagcaguuguggagagggagagagaauugguaggacugcuggcagaaucuaagugccauuugcaguuggagagcagagaccauugcuggaaccagucuacccaguggugugguauagaaguuuggcuuucuucaauacagcuuaguuuuguuuuuuuuuucccuccaccgcccccucccacuuuuuuuuuccugguucaaucuuagagcagauaacugguuuccuguacaacagagcuuuugccagccaguguccugaaaaaucagaggggcuggcaaauuuagaggauuggcaggcauguuuaugaaaugacguaguguggaaucugaaguugaaugaggaagugcagaaauggaagggcuaauggguugguucagaagcuguuaaagaguggccacugaauggacuguaaggcccagaaucauggaccacaucaguuuuguuucccauugcauguuuaguagucucuuguacuuggagaauacuaaauaaaucuuugacaaaugaaggaauacugguggggcaguuguuagacuguguuacauauuauuaauuuaaaaaucugaauuuuuauauucucaaaugucugauaguugugauaacuuuauuauaaauuacuuuuuuuauucuuuucaggccaaauagaauaaugagacuucguuucaaucauuuugcuacagaguguaguugggaccauuuauauguuuaugauggggacucaauuuaugcaccgcuaguugcugcauuuagguaagcucagucuuacaagccuucuuucaucguuugauuucuaaauuuaaacauaucuucuggauugcauucuuacuggguucaccuuuauuaucacuuaacacauuuauuuaauggaaagaauacuaguucuucagucccaucacuuguguguuagugcuaacuugguuucuguagcccuggguaaguuucuaggcauaguacuugacuucucuuuucagugcccugaucuguaaaauugugauaguucuauuaaguucaccugcuccuuguggugguggugaaguuuaucauuacaaaauguuuugagagugauauauugaaugauacuauuucugugaaaaauuuaaaucaggaauaauauccaucauguuccuuguguauugcccacugcauaggccuucaggaguuauuuguugaauucaaauauaauugugugcguguguguguguguaugugcaucaugagugagggaaacuuuuuggaacaguacauauaaaaugaacaguggcuaccuguggagaaaugaggaacauacuuauuauauauauuuuuuuucaauaaguacauuuacauuaguaguuaaacagaagcaguuuaacaccaaauauauggacuguucugaauuguuuggguguuuuacuuuugauuagcagcaaguagcuguguuguuuauuauguuuuuggccacauuggaauucaaaacuaucucuaguuuucuuccuuuuacaugauagaggauuuuuuuuuuuuuuuuuuugagacggagucucgcucugucgcccaggcuggaaugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccuagaggauuuuaagauacagucaugugucacuuagcagcaggaauagguuuugagaaauguguuauuagaugauuucaucauuauguaaacauuauaggguauauucauacaaauagaugguauagccuacuguacacccugcuuauaugguacagccuauuguaccuaggccacaaaucuguacagcaucuuacuguacugaauacuguagguaauuguaacccaaugguaaguauuuguauaucuaaacauaucuauacauggaaagguacagaaaaaauacaguauuacaaucucaugcaaccucugucauauaugugguccauuguugaccauaugucauuaugugguguaugacuguauauuuuccuaaaaugcauuuccccuuaggaaaccauaguuuucaguuuuucaccugcaacuggcuuucuaaauuucuuugucucaaacauuuuauuuccuuuacuuuaaaaagaaaucaguucaacaaauauuuuuuguguuucucacauggggcucaucuggcugaugucccauguggaugagggagguaacagagagcaaacaguacacaaggacaggagaucaggcgacuguugugcccucguguuuuucuacccgcuuuggcuuagaaaucucucugacauaucuuugaacugagaaccaaggccauuuucuguguuuagagguucacuuacaaggccaaagagcaggguggauggcugugcugagcauuuaaaauggcauuggccaaguguuggaguguauauguuuaugccagcauuugaaacauaacuuguagcaaaaagcaccccagaccuuaauacaagccccaaaacuaagugugauguuaucauaauaguacuuguuggggauucacuuguuacuguguuuguuaaucagaauucacagagcucuuguuguaugccaggcacuuugaaucagcuuaucaggagccuuguaggaacaugagccaagcagguauacaucacucugugguucaccuggacuguguauuugauaaacagugguagcggugguagagcagagagagugguugagaaaauucuucaaaagaacauuauuccuuuuagaguuuuuuuuuuuuuuuaggaaaguuauaugcugguggggcaguuguuagacugugugaucuagaggaacccuuccccuucccccuuccaccuccccuuccccuuucuccuuccccuucucccuuccccuucccccuucccccuuccccuuuuccuucccuuccccuuccccuucccuuuuccuuuucuuucucccccaggcuggagugcagaggcaggaacguagcucacugcagccucaaccuccugggcucaagagaugcucccaccucagccuccccaguagcugggaccacaaaaaugcaacacuaugcccagcuaauuuuuguauuuuuuuuuuuuuuuuuuguagagacggggucucaccauguugcccgggcuggucuugaacuccugggcucaagcaguccucccaccuuggccucccaaaguguugggauuacaggugugagccacugcacccggccgaagauugcuuuugacauaccuguuuccagguggcccugaucuugucaguacuuauuccuucugcauuucaagggauucugguguauauaaccagugaaagccugaugaugguuaacccuucauuuacaucuccaaucaaaugucaccucuucuaagaggccuuccuuucacccuuucuaaaguagcaccuucuguucuuucccucugcucucuuucccuucauagcauuugucucuaccuggcauuacguauacacacaccuguguggggaguaucugggcuuaucuguuguuuuucuaaugugaacuacaugaaggcagggacauagucuuauucacuguuguauuccugguaccuagaacagugacucacauguaguaagugcuuaguaaauauuuguuaguugaauacauaguagaaaaugcaucacuguuuuguaacuccuggagcaccagaguuucagaguuccuagaguucugucuucauauuaaaaauugaagggcgaggcgugguggcucacaccuguaaucccagcacuuugggaggccgaggugggcggauugccugagguuaggaguucaagaccagucuggccaacauggugaaaccccgucucuacuaaaaauacaaaaaaaaucaucugggcaugguggggugcgccuguaauccuagcuacugaggaggcugaggcaggggaauugcuuaaaccagggagguggagguugcggugagccgagauugugccacugcacuccagccuaggugacagaacaagacucggucucaagaaaaaaaaaaaaaaugaaugaagggccaggcacaguggcucaggccuguaaccccaacacuuugugaggccgaggcaggagaauuacuugaucccaggaguucaagaccagccugggcaacagggugagaccucaucuguacaaaaagucuuaaaaauuaaccagccaugguggugugugccuguagucccagucacucaggaggcugaggugggaagauuucuugagcccaggaggucaagacugcagugagcugugaucaugccacugcacucuagcuugggcuagaccuugggucuagcuagaccuugggugagaccuugucucaaaacaaagcaaaacaaaaggaacgaaaaucccuuccccuccucauuuucauuccuugcuuauggauucuuccagccauuuuuguaugcauuuauauagguauguguaaguguacacauguacgguccauuguuuugcagcuugcuucucccccaugcccuuaucagaaugccuguugagcuucuuguuagucccgcagaccuagguaauaugcagugacucaugcagucagauuucugggcaugagcauuuagauggguuucaaccuguugccaucugaacagugcugugguucgcauucuuguauauuggucaucguguacaugagcaaguauuucuucuacaaagaaauagaauugcuaggucagagugaaugagcaugagguugugugucugggacagauugcguagggccuggcaaggauauaggcuuuuaccaaaugugguggugguggugguggugguggugaaucaauaauggggcaaaaaucauggacauaugaagaaaugcaacagcagguagacauaagaaaaacaauuaaccucaggaguaaaaagaacucagaaccacaauuuaaaaauugcuuuuuacuuauuaaauuaacaaaauuaaaauagaacuaguaguccuugcuguuggcagagugaagugggauggacccuucauucuguauugauacgauuucaaaucacauaucucuucuggaaagcaaguugguauuauggcucuagagucuuaaaggcaucauuuagacccuuuuacucaguaagguuuuuuuuuuuuuuuuuaccagucacacaacaaacauuuagaauccgucaugugcuggguugugagugaggucuuaagaagaaccuagggagcuuuuaaugauauagaaaaugcguuaaguuuuauuuguaaaauggaauauacaauguaaauaacaucaauuaggcuaagaaaaugcaucagaauacuaacaguguuggaguuauggguguuuguuuagcuucuucguauucuuauauaaauauuuuauauaaaauaucuugggcacaauggcucacgccuguagucccuacauuuugggaggccgagguggguggaucaccugaggucaggaguucaagaccagccuggccuacaugaugaaaugcugucucuacuaaaacuauaaaaaauuagcugggcaugguggugggcaccuguaaucccagcuacucaggaggcugaugcaggagaaucgcuugaaccccgggacgcagagauuguacugagauugcaccacugcacuccagccugggcaacaagagcgaaacucugucucaaaaaaaaaaaaaaaaacaacaaaaaccucaugucuuucagcaauauaugugugguauucaucacucauaaaauuuguuacuuuaugugauuguggagguuuauuuuuucaaagaagcaguauaaaaaguuuuauaagaaaaagaauagggccauugauuucaaaucucauuagaaauacaacucagaauaaaggaagccuagcaaaagauucagaucuguuccucaaggauccagaacugauaggguagcacuguguguuuaucacaggaauuugccugucuuccuggaugugguuuuuaaauuuuaaggacggauuuguuuuuaauuucugucugcuacaauuugacaugucugugcuugugcuucccucuauaagaaguguguuuucauuucaguggccucauuguuccugagagagauggcaaugagacugucccugagguuguugccacaucagguuaugccuugcugcauuuuuuuagugaugcugcuuauaauuugacuggauuuaauauuacuuacagguaagauacuuaagucuaguauuugugauuucauucaggagacuaucuacuauguuuuaacaacaauaauggcuaacauagauugagagccaggcauagcgucaggcaguuuacauggauuuucucauuuaaaauucuuccauaaauucagugaggucugggcucuguuuuucugcuuauuuauaauugaggaaacuggcaggaaaagguuaguagauugucaaaguaacuggugggaccacaauuuaaacccagguguugaugcuguugaacuucuagaagagagggacuuuucugcuaauggacaaaaacguuggaauuuuacaaaguacagcuccacaaauauuaguaguugucauguacucgauaguagaagaaaucuauacucauuaaaguaccuugauaguccauuuauccccccuuuuaaauucugaauuacauuguuucaaagcacugucaguacaauuauauuauuaugagaugcguuauaguucaacuguuuuuuuuuuuuuuuuuuuugagacggagucucacucugucaccugggcuggagugcaguggcaugaucucggaucacugcaaccuccaccuccuggguucaagcaauucuccugccucagccucuugaguaacugggauuacaggcacccaccacuucgcccagcuaauuuuuugcauauuuaguagagacgggguuucaccauguuggccaggcuggucuugaacuccugaccucgugauucgccaaccucggccucccaaaguguugagauuacagccgugagccacugcgccuggccauaguucaauucuuacauuaaguuaaacuagccugccuucuuccaucugaaaugaguagauaaaauuacuaaggaauuuuaaauauaccaaucugggcaguaaccuuaaauucuauuaaauacaaauuuucagagaguguacagaggaauauguaccaugaggaugguaguuuauuguuggcaguuuguuuuauucuuuuccuucccagacuuccaagcaugaauucagcaacucuguaaagcucaucauuaggaggcuaccaagaagaauaggauaguccucccacccaugaggagcuaacaguucugcacaaaucuccuaccuccuuuaauuucuuugacuuuaugaguuauuuauucuuauccucuuauuaugagaauccagcaggguugauuugauuucauuacuuguaccucgggcucuagcuaugcaguguugagcaaacccauuuggacugaauccuuaaguacugcaguuacacuugugaaugaacugagacagugagauucuuaaacuugugugggaggaaguuaugcuaaguuaauggaagcguugcguuguguuaauguaauuuucccugcuauuuuuacaguuuugauauguguccaaauaacugcucaggccgaggagaguguaagaucaguaauagcagcgauacuguugaaugugaauguucugaaaacuggaaaggugaagcaugugacauuccucacuguacagacaacugugguuuuccucaucgaggcaucugcaauucaagugaugucagaggaugcuccugcuucucagacuggcaggguaggagcuucuuucauuuuuauuuuuucuuccauuuauagaacauucccacuaaauaaauuauagauugacuuuauucuuagcaccuauauaauuuauauuaaucaaauacgagguagcauuuaagcuugaaacaucccucuaucuagcugcuuaugaauuucgguuucauacauguguggucauggucuuuagaauuauggaggguuggccauuuuuugcauccugugugugaaaguuggagaacuuggacucagucauaaaaggauguagcagagagccaagcugggagaugggacaagagcugacaauaaugauauuuccucagaaacacacucuaaguucagagaaaauuggugucaguuauacauuagaaucuuaaaggaguuagcuaauaguuaucuacagaaauaauuaaagaagcuuuagggaauuauuuaaggggugagugauaauaacuguuauuaauuuggugauuuuucuuguaaacuuaccccuuccucagaaccuuuuuacuuugaaaggaaauaugcugguuuaaauaccuuaguuuguuggguuuggcugacauuuuagaguuaauaauugaagaauuucaguaucuaccauugugcaaauauugcagcagaagccaaaccucccaagaauggagucuguuucuucaauuuguuuaaguuuuuugauuuaccagaagauggauaguuuguaugauugcucccgggucuaguuaucaaacuuauuccuccauauccacaaguucugcaucuacaaauucaaacaaccauguguagaaaauauucaggaaaaaaacacaauaaaagauaauacaggcugggugugguggcucaugccuguaaucccagcacuuugggaggccaaggcaggcggcucacugaggucaggaguucgagaccagcuuggccaacauggugaaacccugucucuacuaaaaaauacaaaaauuaggugggcaugguggcaggcaccuguaaucccagcuacuugggaggcugaggcaggagaaugucuugaacccuggagguggagguugcagugagccgagaucauaccacugcacuccaacauggauaacagagccagacuccaucucaaaaaaaaaaaaaaaaaaaagauaauacaaauaaaagauacgcauaugaaaacaaccauuuacauagcauuuacauuguguuaaguauuauaaguaaucuagaggugaguuagaguauauggcaggauguguguagguuauaugcaaguguuacaucacuaguuuauauuagggaccuugagcaucuguggauuuugguaccaagggcauccuggaaccaguccccuguggauauugagggauaacuguauauuuuauccuuaagauuuuucaugugaguuaauuauuuauuuaucugugcuuucuccugagaguugcuuaagcagguauuucauuaccaaaaaaacccuaaccuggauauagucaagucaucauuagaaaguaugugauuuacccuuggucaauacccugaauaaauuaaaauaacaaauuaaaggauuugucugauauuuaaaugcuaaaggaaagacuauuauuuaaauauuuguuacauuuagauaauuaaaacuugaaaugcaguaagcuuuaaagcugucuuuugugaagcuaauucauuauguuuuuauuagguccuggauguucaguuccuguaccagcuaaccagucauuuuggacucgagaggaauauucuaacuuaaagcuccccagagcaucucauaaagcuguggucaauggaaacauuauguggguuguuggaggauauauguucaaccacucagauuauaacaugguucuagcguaagucguuuuaaacauuuuugcaagaagcuuaguuuuuuauuuugaaaauuuauaaagcacagauaagcaaaaauaaaucaccagucauucuacuaccuaaagaaaaucccuguuaauauuuugguaguagucuuucaaaguguuuugacauauguugaguuuuuaaaauugaaugcuacaaaaaauucauugucaugauaagcauucaccucuuuucaaauacugucucugauguuuugcuuuaaguauauguaguaaguucuauauaaguaggggauuauuuuaucuuuuaauuuaauuaauaguuccaaggucaaaugguuugaauuuauaguuugcuaguggaaauuauaccauugucuacuaugucccaggcuucaaggucuauuugcuaaucucgugcugcucauuuugaagggagaauauguguugucauaguggaauuagcuauggagguggacuuguagaaaaaaauuuauaaacauuuaaucuugcugauuuuauuaccuggaacuuuuuucuaggcauuuucuauuaaugaagauugucaaaaaacccagcaucuguucauuaagggauucuggaaauauggcagugguggccuaguuucugcauccccccaaacauagucauuaaaacacaucacacaacuagucuagcaaaaucagagaaacaugagcaacaucuauaauaaaacuuggucaggcuaggcgcaguggcucacgccuauaaccccagcacuuucagaggcugaggcuggcggaucacuugagaucaggaguuugagaccagccuggccaacaggauaaaaccccaucucuacuaaaaauacaaaaauuagccaggugcgguggccggcaccuguagucucagcugcucaggaggcugagaugggagaauugcuugaaccugggagacagagguugaagaucagaugguuguaggugugaagccuuauuucugggcucuccauucuguuccauuggucuauguaucuguuuuuguacuagugccaugcuguuacuguuacuguuacuguagcccaggaguauaguuugaagucggguaaccuguugccuccagcuucguucuuuuuguguaggauugaacuggcccaaucucuauucccauugcugcugccuuuguucgagcccuuuaauuucugaugagacuccugcaguggucaggucagguuaguagauuuccuccagguucuuuucuuuccccauacauagauucaaacuauuuucuuugccuggaaaacaaaugcuuuccugaauaugaauuuaaagucacaucuuauuacaguuuuuagguacacagauuuuaggcauuuucauguuuuucaucagaagagcuguuugccagcccuaggaguggcacagguggcacccagagaucucguaggagauuggaucucuacagagcuuuucuuacacaucccccuucccucuggggggaaagagaccugucagggucuauucuuucuuggcuggacaacccagaggaagccccagaguuguucaggggcucaugcucuuuccagacucuaccucagcaagucauuugugugggcaccucuuagacugugucauuaucaauaacugcagccccuccauaaucucauuucuaaacguuccacauuccacccugcuucuucugugguggacacuguuggugccuugcccagaucuguuuaucuuuaccuggcuggugcagugcacccagucaccugaugcugugcaauuuggcuguugucaguucauagcugacccuuucucugaagaauucucucagcagauuggagcugucuuacccaggaacaccuagaauacuaugcucuauccccaggauguccccuaguguagugaccaaccaguuugccuggaacucucccaguuuuagcacugagucuuguaucccaagaaaccccucaguacuggacgaaaugggauggucacccuggcccccagcugcugacuggcuggauggagguacaugagucugacccugcuucuacaugggaaaauucauguuccagggcuccccuugggaucaggccaaagcuauacuucaacugagaccaccuuuuuacuuauccucuccuuccuacuaccuugcuugucucacuuccugauguuugucaaaagaguauucccucaguaaaucacuuguacaggaaucucuaucuccagcucugcuugcagggaaucuuaccugagacacuuuucaaucuuuucagauauuucucucuaauacccuaacaguguuugaucuccacauggguccauaauucauugauucuuucucucucccucuccuguucuccuucuuaacucuaauaucuucuuuucauuuuucagauuccuaccaccuuuccuucuguuuucauucucaguuaauggccuugcuuccugcuucucuuuugaaagauaaaggucagaaaaugauuuccacaaacuccuaccaccacauuuccccuucaccuauaucugugccccuuuauggucaucuuuucuguagaucagugcugucucauagaaguuucaggcaucauucaaauguucuguauuuacccuguuguaucacuggccacaugugguuauuucauaccugaaauauggcuagugugacuuaggagcugaauuuuuuauuuuccauucuuaguucuuaucuuacuugaucuggcaccaacauuugauacaguuauccuucccuccucuuuuaaacacuuucuuuaguuggcuucuaggacaccacauccccuugauauuuuuuuuaauuccauauuccuucucagccucuuuagcugguuucucuucagcugacugacuucugaaugaugucagaccagggcuuaacccuugguccauugcugccuguuuauucacucuuuuggugaccucauauaguaucuuggccuuuauacuuggugacucucaaauuuguauuugcagccuagacuuuuuaccugauccccuaucuccagcucuuuaauugacaucucaaccuucuggcuguguacuaggcaucuuaugcucagcaugucccacacucaucuuuuucucaaggcugcucuucccccagaugucccccccaguuaauggccacuccauccuucuauuuacuuaaggcagaaaucuugggucaucugugacuucuuguuucuucacaccccguauugguauauuuaugaguuaucucaugcuacauaacaaauuaccacaaacuuagcaccuuaaaacaguuugcauuuauuaucaccauuucaguuggucaggaguccucuguaaucaaggugucagcuggccugcauucucaucuagaggccugagugaggaagaauucauuuccaagcucacuuagguugcuggcagaaucaauuuccuuguaguuauagaaccgagggucccagcuuucugcuggcuauugacuugaggcuguccuuaauuuacggaggcugccuucagcuccuagagcuuaccucaguuccuagaggccacccaguuucuugucagcugagcuucaccaguauagcugcuuacuucaucaggccacaagaagagucucuagacugagucugcuagcaggauggaugucacagaaaugauauccuaucaucuucgccauauucuguuuguuaaaagcaagucauagauccugcuuaccuccuaggggaggggauuguacaugguuaugaauaccaggagguggacaucaugaggacuaccccagugucugucugacacgauaggucauaucuuguuagcucuaccuuuagaaucugucccaaaucugaucaccucuagugcugccaccaugagaagagaagguaaaauuaaaggcaugaaagugauugugccuucugcuguuauacuagauguuaugaaagacacauauuuaccauuaugugauuuuacccuaacauccucccugucucuugaagcaagaaaucugggaaucuuuagauauuuccauauguucuucucuucguaccauaauuucauauuaagcccucucaacucugucaccaaauacaugucauauuuauucuuuuuauguacagccugcuguuaucucuuacuuagucuucagcaguagguuucuaucaaaucuguucauuuccauuuauuccuauuaaucaaauugcuaaacaugaacuggggugccauugaacaauauaaauaauaucauuuacuaccuucuuaaaacccaucagugucuugccuuuggacuuaauggcccugcaugaugugaccacuguuuaccuucccagacucagucuuuuccucuccugccaucauucacagcacuccugccccaccaaccugcuuucuuacucaaaacguacgguguacaucauuaccuuuagagccuguguguuugcccuucccuuggucuagacuguuccugcuauugugccucagggcuggugucuucucacccuuuagaucucagugugguuuucccagagagaucuucucugaccauccaguucagacauuucucccuguucuuuuuuauaguccucauuuucuuuauggcaguguuagugauuuuuuguuaugucagugcacacuguuguacuugcucuuugucugccuuugccaaguucuucaagguuagggaccuuguuuacucacugcacucagagcuuagcucauagaagguacucagauagguauuuaucagauaaacgggggaguaaaugauuuauuuccuucacaaacaucuguuccuggaaauauuaauaucaccuauuacuuuuuuuugacugacauacuucaugagccacauuguuuuuuagaucauaacuuuuuuuuucuacugaucaaaacaugauuuucuacagcuuuauuuguuucacguaaauauuagcauaguuccaaauaaugaacuuucaugaaaaguuaauuuagugauucauuuuagaaguaguguuucuggaacuuagauuacagauuuuuauuuauuuauuuauuuauuuauuuauuuauuuauuuauuuauuuugaaauggagucucgcucugucgcccaggcuggagugcaguggcacagucucggcucacugcaggcuccgccucccagguucacaccauucuccugccucagccucccgaguagcugggacuacaggggccugccaccacgcccaguuaauuuuuuguauuuuuaguagagauggguuucaccauguuagccaggauggucucgaucuccugaccucgugaucugcccgccucggccucccaaagugcugggauuacagucgugagccacuaugcccagccagauuacagauuuuauagucauuuauacucuuacaugaaaguauuuuaggaauugcucuuccugucauuuuccucacaguccuguuaacgcaaaacuuuuuaguugcauuaaaaagcaauucccauuuuguuacccaaugguccucuugugaaauaaguggucuugguccccuggauuaagauugccaguugaaacuucauuaccaaauuuccuucucuugagcagaaaagcuuuuuuuaaguuuaaaaaaaaauaguaagaaaucagucagcagucaaccaaauaagcaaaguagcaucaccgaauccaauaaauguuaaagcaggcucauggaacaccaagugugaccugaccucuuuuuuuuuuuuuuuuuuuuuuuuuuuuuugagacggagucucgcugucgcccaggcuggagugcaguggcgugaucucggcucacugcaggcuccgcccccugggguucacgccauucuccugccucagccucccgaguagcugggacuacaggcgcccgccaccucgcccggcuaauuuuuuguauuuuuuuaguagagacgggguuucaccguguuagccaggauggucucgaucuccugaccucgugauccacccgccucggccucccaaagugcugggauuacaggcgugagccaccgcgcccggccgaccugaccucuuacauaccccacagaaaccacacucggggagauucugauaauucucggugauagcccaaaaucuggaaggaagcaaacugagugagcauuacuguuuuugacuguaacugaagaguaggagacauaguugcuggggaggaucaggugaaagggggagaaauugaccaaguggcugauucccuacccagaacucagagcuucuauuuaaauuagaauaugaucugagcacugugguagaccacaaaacaaaaucucagaggagaggagagucuggguauuuuauucuaacagacugcacucucaucugagccccaacauuuccuuagacuucagaagaguagauagaacauaaaauaccagcccucacacuaaagcuauggaaaggauagaaauucgauaaacuugucuuagauacagugggaacagaauugagaaaucacccacacuuugcaaauaaaaugucuggagagcuauguguaaccucaaacaagaugaaagaaguggcaucguagcuagugcaaauauucuaugaugaaaaaauaaagaggaagaaagacugcagccuguaaaaucuaacaagaacccaucauggaggaaaagcagcuucaaggagcagaaggagauuccuuccaacugcuucgugcugcagaucaacuuaaugagaauuugaguucagaaaaacaagcuagaagacaagaugauaauaacagaagaauugggagguuguaggccuaaagaaauacgaauaaauuagauacagcaaaaauuagaaugaaaauuuaauuacugacagguugagauaauuguaguaauacauugggaaaaaaaccagaaaagcaaaaacacacaaaggacagaaggugaucaaauagaacuauaauugcagucacugaagaaaagaaccuaacacauguaacagacagauugaaacagcacaagguguuucagaaaaauuuuauaguuucuucaugacaaaaccugauuugaucaaguuauugagcuuuuugugcuuggaguguauccaagaaaaauaaagucauugaacuuuugggauaaaggacaaauuauuauuugggaggccucagguaguucugugcuaucugcugucuggggucaugucuagucuccacagagccuuugccuuggucuuuagguggcccgauuggguuaccaggccauuauggaguuugaaaccuguacccugugguacaugauggucauuggcuugccagccauccuagaggggucgagggaggugcugucacucuauggaagacaucuuuuucugaauuucuggaaucuaucuuugcuuauuugcuugcuuaggucuuagaauuaguuguucacuauucuguuaucuuggauucagcucccagaaggugcauuuaucuuguacuuuuuuguacgagauacuuuuuuauguuuuaaaacauaaaauuuauguuuuauugcaucaguaucguucuugucuuauguuuuuuuuucucuguguugagagaugauuaacagcauguuguuuaagugucuucugaugguucaccuuagccagauuauggggaccugccagcaccuaugugucucugacaagcucuuggucugacuuguugacagaagaggagcaaaauacauuaagagacagauugggcacucuccgugcccuuuaacagaaauguggagaccuguuucuguccuuccucuguuucuuuccuuucuuuuaaacauacagaaacaagccucuggcuugaacauaaagucuauauguguaguuggaagcuauaugaguccuucucaggaaacaccuuucauagccagaauuccaaaaaagcuuugcagugguaugcaguccauuuuauaaaaacauauuccuggauggauuuauuucuauuugaaguaaaauacaauaucaugucauaaaaaaaauagagguugcggguaggcagagaagaagagagaaugagaaugauucagaauucuucaggcuuccaggcagaaaagcaaaccaugaaaaaagagggaaauaagcuggccacagacuucuccguagcaacauuuucaguaccagcaguguucaagggagcaacaucugcgaaguucuggaggaaaaaaaggaugguccaagaauaguguacccagccaaggugucauucugcuguaaagcuggcaggcagauauucucaaacaagagugaauucagggaaagaguacuaugagcucuacuuaaacaaaacaaaacaaaaacccucuugacagugaaauccagaggagaauugaagagcucaagaaagagaaguugugguaaaaggacugugaggagauugagucagcuaaaauucaggacuaaauaacuauggaauuacuguuauugaauguagugcaaauguuaaggaccuggacauuguaaaaauuuuauaacaaaaauuggaagaagaaaugagaggcaaugugagugcuaagauuuuucaacuuucaaagcaagaaguuagugaauucuguacaaaaauaaauugcauauaacuuuaaauucaaccucuaaauaauuuuucauguauuuuuaagagugcaauauuccaaaaauauguaaaauaauaguuaugugcaauuaauauuuaauaguugucaccauuuguuguauuugcuucagaucuuguauaaaauauuuaagauaaaaggaaaggcuuagagaaaauuaacaccaauggauucaccaccggcuuagaaauuaaaacacugcuaacacaguugaagucccuugcaugucccuccaaagucccagagauaaccuguauccugauuuuggugucaguuguucauacuuucauauauauguuauacuuuacauauauguuauacauuacagauauaugaaaguauaguagaauuaauaaauuuucuguuuuuagucuuuauagaaacaauauucugcagugugcuauuuuagcuuaacauuguuuugagauuuauguugacauauguugcuggcguauauuuuucauucuguauacuuauucuuuauguuaucuaucuggauauauuaccauuuauuuguugauuuucaauggauggacauuuauuuguauucuuuuuugcuauugugauaaacuuucuuauaccuuuaugcuuauauaugauaauguuuuucaagauuuuuuaaauacuuggaauauccagguaaacuuuuauagaaaagaaacauuuacuuaagauauaacaauaucauuucuuuuuguuuuuuuuucuauuuuaugaaaauaauuaaaaucaacacuuuauuaacaguauccucauaugcauagaaagaugucuggaaugauguuuacuuaaugauauuuauuucuagaucauggaauguggcaucuuuuaaaaaaaacuuuuagcucuuuauucuuuguauugguuacauucuuuauaaugaacauguaugauuuuuauaaaaacaguagaguuuuucucaaaagcaaaaacucaaaagugaguacuuuaagauacugaaugugauuauugaauaaugcauuaauaaguauaaauugcauggcaggauuauaaauuauuuucuuuuuggcauuuuuguauuuuaaggucuuuauauucguaguacaagugaaaugcuauaaugguauucuggcuuuugaaaauguauuuuuagucaauuauauaaagaaaaggaaagauuaguaauuuucuuuuacuuaauuaucaucccuuuuuugguaccuaucuucaguuucucaugauuaaauaaaagaaaaguuauuguaauaaaauuuugagucccuugaguacaaugcaaccuuuaaaugauuuagacuguguauagaagagguuuucaggaaguguuagaaccuuccaguagcuuuguauuccuuucuuuucccaggauuuuguaguccagcuccucuuccugaguuaucacuuguccagugggcccaggugucagguuuauuugugaaggugacaagugccccccuacauccaugguggauuuagugagcaucuccaaacuggauuaugucacaaauaaaauaguaugagauguucugucuuauuaguugggugaaaauaugaucuguuuguuuuguagguaugaccuugcuucuagggaguggcuuccacuaaaccguucugugaacaaugugguuguuagauauggucauucuuuggcauuauacaagguaaagcaucuccacucugugcuaagcaagaaacuaaguuuuccucaguuacuucauguauuacauaguugaaaagcuaccucaguguugguuuuuaauuggggaaaacuuuuuauugggggcauuauauaauuggcuaaguuauaaguagaaauuaaaauggaaacuuuuuuaacucaagagauuuuaauggcuucaaacuguaaugggguauuauaauaauggcacuaaaugguuaaagauguagauuaaaaaguguagauuagcuuuuauucucauaagcaaguuuagccaagaauagccacauuguaauguggcugaacaaacauuuucauuuccucauuuuuauagauagaugguaggaugaggcaacuuuauuuuuccaaguccuuuuauacuauaaaagauucaugugaggaaguccaagaaaacuggugaaguauuagagauguaaaauaugauuaguuuuauuucccuuuucccuuuuuuuauccuuuuccuaguaacucacugaaaggcgccuuuugcuaacccuuaaaauuuuuuuuaauuuauuuuuuacugagguaaaauauacguauauaaugguaccaucuuuaccauuuuuaaguguacaguuuggugguaauaaauauauuuacauucuuuuuuuccuucuucauucucccccaccagccugccagccucugguaaccaccagucuacucucuaucuucaugagauccacuuuuuuaguucccacauaugauugauaaugugauauuugucucugugcuuggcuuauuuuacuuaacauaaugaccuccaguucaguccauguugcuacaaaaugacuggaugucauucuuuuuaacggcugaauaaugcuccauuguguauauauacaccacauuuucuuuaucuaauuauccauugauagacacguugauuccauguuuuggcuauugucaauugugcugcaauuaacaugggagugcagauaucucuuugauauguucauuuccauucuuuuggauauauacccaguaucgaaauuguuggaucauaggguaguucuauuuuuaguuucuugacuaaccuuuuuuaagcugagaauaauauugagcuuuuguucuucucuguucucagauuuaaucuuuucaauguuuuuaaaaauuuuguuugcauuuuuuuccuaggauaaaauuuacauguauggaggaaaaauugauucaacugggaaugugaccaaugaguugagaguuuuucacauucauaaugagucauggguguuguugaccccuaaggcaaaggagcaguaugcagugguugggcacucugcacacauuguuacacugaagaauggccgaguggucaugcuggucaucuuuggucacugcccucucuauggauauauaagcaaugugcaggaauaugauuuggguagguauauuuuuuccaguagaugccuuuugaacaucagauuuaaaaccucuaagcuuauuauuuugacuguuuagaaaaguucaaccuaaucuugauucgguacuuuaucuugaaacauaguaaacacugggcccaggcgugguggcccacuccuguaaucccagcacuuugggaggcugaggcgggcggaucaccuaaggucaggaguucaagaccagccuggcaccaacauggugaaacccugucucuacuaaaaauacaaaaauuagccuguccugguggcgggcaccuauaaucccagcaacucaggaggcugaggcaggagaaucgcuugaacccgggagguggagguugcagugagccaagauugcaccacugcacuccagccugggggacagagugagacuccgucucaaaacaaacaaacaaacaaacaaacaaaagcaacauaguuaacauugauguauuaccagugaaaugcagauuaucgaugcuccuauguaguauguauuuguuacugucaauuugguaaggagccaaagaugacgcaaagugcuuuggguauuuaaaauaaauaaauaaaaaugguucaaaacaauaaauauugaagaaaaaaaauauuugcccagcccuuuagagauugguuuaguggaguaugauuuacccuuaauaugaaauauuucccuugguuaaauuucauuguaucuguuguugugcaguaggaauaccagguauaauuaacauuuugugaaaguaggccuauaaaauauaucuguauauuggucaccaaagguuguagggaauuaaauguucauuugagugaacauuuuauuuauugagacaggcucuuguucucucacacaggcuggagugcaguggcacaaucauagcucacugcagccuugaugcccuguccucaagugauccucccaccuuagccucccuaguagcugggacuacaggugcgugccaccacuccuggcuaauuuuuuaauuuuaguagagaugggaucuugcuauguugcccaggcuggccaacauagcaggccucaagugauccucccaccuuagccucccaaagugcugggauuacacauguaagccacuucgccuggcccugaguguuuuaaauuuaguuaauucuuuuccuacauggcauauuagaacaucagaacauagaacagacuggaauugggccacauggcuuuguuauaaguuuuagguggcuuucuuuaaaauauaaagauaaaaaaguauauguaucaggucuccugaaauccauucucaugcccuaagcucuuuggacauuuucaguaguagagaggaggagccugccaugcuugccuuuaacugucuuuccuuuccagauaagaacacauggaguauauuacacacccagggugcccuugugcaaggggguuacggccauagcaguguuuacgaccauaggaccagggcccuauacguucaugguggcuacaaggcuuucagugccaauaaguaccggcuugcagaugaucucuaccgauaugauguggauacccagaugugguggguacuuuuucuugagcuuucacuuuaagguguaaauucuguagaggcaauuguggagaaaauauugugcuaucuuuuuguuuucaugccuggcagauaauucuguucggcauuauauauagagaaauugggaaauaaacagaggguaauaaaguagcuaguauuuauuuuguuacguuauucuguaauucuguagcagguugguuagaaaauacuuagaguuuuuuaacaaauguaaagcaaauuugaguuacgaaauaauguaauuauaaagcgaugguuucuccucuuuuuccucacauguuugauaccuugcuauggguacuguuuuauauucugucauaaaaauaaucauuuuuaguagcugugcaauacuccauuuuguggguaugcugagacuaugcaggugaaaguuuugguuucuuucuaguuuuuaugucauuaagaaaccauuaugcauuaagcuucugucaauauuucacaugauuucugcccagaaacuggaauuauauagcuacgggguaugaagaguuuaagguucuuaauauauuuugccaaaacucuuacaggucuuuaaaauuaucuguauuuauuguugaaaaacuuacuuuuauguagggaaaacucuggaaggauuuguacauuugggucugagguuaauaaagugguugugcuugcauuagcagauacauaaauauucuuuaaaaacuaaccuuguauuuauuauuucuaaauaaacucaaaaggaccauucuuaaggacagccgauuuuuccguuacuugcacacagcugugauagugaguggaaccaugcugguguuuggaggaaacacacacaaugacacaucuaugagccauggcgccaaaugcuucucuucagauuucauggccuaugacauugguaaguuucccaaaaccauuuucucuucaggcaucuuuuugccuauacuauaagcagcauuuaaaaggagacugaaaauauugccaguucaaaaugaucaggccauuugaaagagguccaaaugguauuuuuuauauucauuugacuaauguuacacaucugguaaaaauuauuucuacauuaaauucuuuuugaaaucacuccuguuaauugcuugaaugcuaauuuuuaaggcugaguugaggugucuagucucuccuuugucauguuaugccuaccugguaguguuacauaguugcaaccaccagcauuguguuaaaauugguucacguauuagcuuuaucucauucccuagaaaacugguuucucacauggucuugguguggcaauauaccagaccagaagagggcaguauuuguucaugcaaagcaaaugcauaccggaugaucucuuucauaaaaauugucagauguucauuuuaaacaaauuauuauuuuuuugauugugguaaaauacacauaaaauuuaccauccuaacuauauuuaaaugucuaguuuagugauacuaaacacauucauaauguuauaaauccaucaccgccauccaucuucagaacugucuucaucuuguaagacugaagcuguauacccauuaaacaauaaugucccauuucuuccuccccacaaugccuggcaaccacuauucuacagucugucucugugauuuugacuauuccaagucagacauucguuuuuaacagacauuugugugccagccacucaguuuguacauugaggagaucagaugaauaacuuaaagcccuuagccucaaaguagaagagguagagaaaugagcagacaauagaauugcacuucaggguguuucuggcugaaaagaauguaugagagcaccucugaguacccuuuaagucauggaggguagagugauaaacagggaacacuuucuuaaggaggggccauccucucuggguccuuggggacacuaggugucagguaggugaaguuaggcagcacucuccaggcagaggaaacccaguuugcagagacacagagguggaaaagaccggcacauauuuaagggcucaaagagugagacacugagugugagguuggcaugguauagcagcaccaguugguauuagauccagaagagaaguugcuaguaugggucacaacaagggaaaauuaaucaaucuaugggaucuaggaaaggacuuuguaaaaauuaggugacauuuaaauuucuugaaauuucauuuuccaccuuuauuuuuccauuuuagcuacuaaauuugagcaaaucaauauagaaaagaguggaaaauaauuaugaaacccauguuuugcugacauaagcuuuguagaauguaaaauuugcuugcuuuaaaaaacauucuuggcugggcguggugguucaugccuguaaucccagcacuuugggaggcccaggugggcagaucacgaggucaggagauugagacuauccuggcuaacacggugaaaccccaucucuacuaaaaauaaaaaaaauuagccaggcaugguggcaggcgccuauaggcccagcuacuugggaggaugaggcaggagaauggcgugaaccugggaggaggagcuugcagugagcugagaucacaccacugcacuccagccugggugacagagcgagacucugucucaauucuagugcaucaaacugauaggcaguugggugagugauccagaugucauggauuucgggugcguuugcuaguuagaauugugguaugaucccgccuuucuuccaugcccuguugcucugcugcugcuucauuuuaacccagaaaugauguuguaacugagaaaauugagaggcauguuuuaugagguucucuuuguuguaguauuuuucccaaagaaaaugucagguccuguugauuagaaaugguaguccguuuaaaaauauauuuuucuuucuccuagccugugaccgcuggucagugcuucccagaccugaucuccaccaugaugucaacagauuuggccauucagcagucuuacacaacagguaauuggagaagugauugcuccuuuucuuuuguguuuaaaaugaaaauaaagggccgggcacgguggcucacgccuguaauucuggcacuuugggaggccgaggcggguggaauacgaggucaggagaucaagaccauccuggccaacaugguaaagacccaucucuacuaaaaguacaaaaauuagcugggcuugguagugcgugccuguaauccccccuaguugggaggcugaggcaggagaaucgcuugaacgagggaugcugaggcaggagaaucacuugaaccagggaguuggagguugccgugagacgagaucgcgccacagcacuccagccuggcaacagagcaagacucugucucaaaaaaaaaaaaaaaaaaaaaaaagagaaaaguaaaguggaauuggacucaacauauuauucacaagauucccucaucccaguaguuuuuuuacaggauuauguggguauaaauuuucugauuuauguuuaaaauauuugauguggaggugaauuacuuugaaugccauguuuauugaucugguuuuguuagcacgcaagagcaugcuuuuugguguggucugagugccuggggcaacaaaaguuacgugcaugucauugucuuauguccuuuguuauuguuagugguauuuagguugucaaguuccuaguaguuguaucugaauaguaagaaguuuggaaaagaggagagagggcacuucagauggggggauaagguaggagaacagagguggagagauugugaaguuuaauauagcucaagucuguaggcucuggauaaucagaagucugcaguucauugcauuuuaucgcucaaaaaugccuggcccaaacuaccagagcucuucaaaaaaucggcccuuggagaagucucagucaaauaagggagauucagaguggccacucuacuuguuccuuacagugugcuuuaaagauuuuuaagaaguuaaacagccuaaucacauuauuaauuuuucucauucaguuucugcuauuacuacugcugucuacuuucccuuuuuuaaaauucuaagccauauaaauccuaaggauguuuaagcguuauaaugccugcaucauguuagaauuccuuuggcuuuugaaauuucuguuguaacgauggaagacagaugagguaauuucacuuagauuaggaaagaugagaggccgggcacgguggcucacgccuguaaucccagcacuuugggaggccgaggagggccgaucacuugagcccaggaguuccagaccacccuggucaacauggcaaaacccccgucucuuccuaaaauacaaaacaauuagccagguguggugguaggcaccuguagucccagcuacuugggaggcugaggcaggagaaucacuugaacccaggaggcggaaauugcagugagccaagauuaugccacugcauuccagccugggcgacagcgagacuccaucucaaaaaaaaaaaaaaaaaaaaggaaaagugagaaggugacauauuuuggagauguugugaaggaagaguugagacaauuuaggaacuagcuacuaggaaaaggugcuaucuuauauaagguaauuauuucguuuuuuagcaauguguaugguuuuacuaugagaacauuugacagcuagagacuaaaauggaaggauuucuggccaccuugcuaauuugaaguguuauuauaaaucauaaucuugaacuuccucaguacagaagacccuuaaagcuuucuagcaagugccucuugagauuuucaucugaaacgcagugggaccauuuugucauuaucaugccugugggagccuggccucaacugucuucguuuguguuccuaguucuccuagcacaggauuuggcacauaauagacauuugcuaaauggcagguauuaguacagucauaacuagcaaacaaaugaauuuuuuauaaaacauucuuagguuuuauucaaacucagagaaguugagacuuuaccauaaaauauaauuuaaucaugagucaaaauugggaaugccuugccugaguuguaauguuuucauuuuaugugauuccagugguauguuugaacccugauauguaaguaucugugugugugagacaggauuggguagguggcaggagacccugagggaggccagcuacuaaaaggccauaguuuugguuuaauuuuaugaaauaauuuacugaaaaagaaacuucgauucacagcauuucuucaugcuuuaaguggaucaacagcauugggugagcugugccuuccuugguuuucauugagguuuugagggaggcaggaaggaggaggagagauggcugugacauaccaaggcggcaggagaugcagcugugccucucaguugccugcuccaugugucucugagagacucucccuaacuuugcagagccccugugcaaccagauggauucacaauugcugagaacaccaacuguacugggaagaggagguugcuuauuugguuuaagcaacaaauuaacuaguugaaucuagccugcuuaaugugguacugaguaagccuauagcaagguaaaaaaugaaaccuggccgggcguaguggcucacgcuuguaaucccagcacuuugggaggccgaggcggguggaucacgaggucaggagaucaagacuauccuggcuaacacugugaaacuccaucucuacuaaaaguacaaaaaaauuagcugggcgugguggcgggcgcauguagucccagcuucucgggaggcugaggcaggagaaugaugugaaccccaggagguggagcuugcagugagcugagaucgcgccacugcacuccagccugggcaacagagcgagacugugucaaaaaaaaaaaaaagagaaagaaaccuuauauuaauuuuuuaguuuuugaaaucuaccaguaaauauuucagauuaggccaggcaugguggcucaugccuguuaucccagcacuuugggaggcuaaggcaggaggaucacuugagcccaggaguuugaggcugcagugagcuaugaugacgccacugcacuccagccugggugacagagugagacccuaacucaaaaaaaauauauuucagauaacaauuuguuuucauuuuucacaacucuauaaaguaacuauaaacacugaauucuugaauauugaauuauugcuccuaggggaaauacaggguuauguuucuauaaaccucugaugacauuuucaucaaccagucagcauacauaacuuucuuuuauguguguuucuauuuaaaaacaucuuguugaauauauauucuugauuuauuaacauugagcucacagccaacagcacuuuaacucaugccugaacaaagcuuauguaacacacguauuuucucaguaaggcucgucacagccuucuuacacuuaggaacacuagacagcacuucagcacugcauagggggccauuuucagcagugaaagcacuaacauaaggcacaaaaaugcauaaaacauggcacuagauacaucauggaagggacacuuguuuguaguaugauaguugaaacaagaagggagagcaucuccuuguuugaccuuagccgguaauaugcaugugugucaacucaaauuuuuugccauucuuugcacacacaugcugguaaaugaccaugaaacuacugcaaguauugauuuuggaauuagaaauagauuuuauaaguacgugaauuugcaaauauggaaucuacaaucugcagauauggucaugugucacugaaugauagggauacauucugagaagugcauccuuaggcaauuucaucauugugccaacaucacagaguguacuuacauaaacuuaggcuacacaucuaggcuauaugguauggcuuguugcuccuagcuacaagccugugcagcauguuacuauacucaauacuguaggucauuguaaugcaauguaaguauuuguguguccaagcauaucuaaacauagagaagguacaguaaaaaugcaauauaaaagauaaaaaaauguacaccuguacaggccacuuacuaugaagagagggagcauacaggacuggaaauuguucuggggaggucugugagugaguagacuguacacuacuguagacuuugugaacuguacacuuaggcuacacuaaauuuauuuuaaaauuguuuucuucaauaauaaauuaaccuuagauuacuagaugacaaccauuguacaugccauccaucauugauggaaacaucguuaugcaggaccacauacaugacuauaaugaggauuggcugucuuuuaaagaugaagacuuaauuuuuaaaacacaaccccuaugcaguuauuacacuuuuauucuuuaagccaggggugguggcucacgccuguaaucccagcgcuuugggaggccaaggcaggaggauugcuugaguccaggaguucaacaccagccugggcaacacagcaagaccucaucucuacuagaaauacaaaaauuagcuggucaugguggugcgugccuguugucccaacuacucaggagguugaggugggaggauugcuugagcccaggaauuugagguugcacugagcuaugauggugcuguugcacuccagucugaguaauggagcaagacucuaacucaaaaaaaaaaaaaaaguuguucuuuaauaucucucaguguccauucaguguuuacaucuccuaauugucucaauuuuuuuuuuaaguuuaguuuguucaacucagaauccaaauaagauccauauguuacaauugguuaaaaugucucugaaguuucucuugaucuguagggaccccauccaucauuuucccccuuacuuguuaaagagacuggguuguuuguccuguagaguuucccguaguccagauuuugauuauuguauccugggcuuucauauaacauauuggucucucuccuaaacuuccuacaaauuaacuugaucagauucacuucaguauuuuggcaagaucacuucauagguuuauuucuuucccuuuguuuaccaaucuucaaaauaauguagugauuucuuaguauuguccaaagaugacaaauuagguuguuuuuuuuuuucaggggaugggagauguguaucauuaugaacucauggauuuaaaaauauuucauguguuuuaaucuauuguaguuuguguuuuuauuaaauuucaaacauuuuccaucuuuagccagugagggcaucuuuacauuagcuuuugaguuuaucugauacuacccucguuuucuuuucuucccaguauaacaagaucugcuagacucauugugaacauuucuucauccagacaugaaauuagguuuuucucuaaaaaguucuaguuuuuaaggggugacaggagggagaaagaaugguuuuuaaauacgcacaaucuaagcacuaguuguauucauugcuccuggguuggcuguuguuucuagguuuuuuaagaaggcagguuaaagagaaacugugguguucuucuuuuuaaaaaggaaaaugaauuauuugugcacguuuguguguuugaccuucuaguucccucaauagauaaauggcuacauuguuugaauacuuuucucugcguuccauuuuuucccccacauagcaguauauacuggugcucacuccauagaaguauguagaaauuuuccucauuccuuuuacaucugccuaauauuucauuauguggauguauuauaguuugucacauccccaauugauggacauuuggggcuguuugagucuuuugcuauuauuaacccauuuaugccuaguguuccauuauuggaacgcuaagcuugugggaguuauuuauauccugcugcucaaggucauccccaaggucugauuuuucacaaaaaaauuugcccucuggcauaaguggguuaaugcuguagugaauagccucauguacuucuuuuuguauuuuugcuauucuaucuuugugcuagacuucuagaaaugugauuucagguucaaaaaguaaaugcaaaguuuuguuagagcuugccaaaucccucuguaggcugcaucauuuuacaugcccagcaguagugugugagagugccuuuugccccauagucucaccaauccauauauugucaauuuuuugugcuuuuuuuuuuuuuuugcuagucuuauaggugagaaaugcuaccucaguauaguuuuaauuugcauuuuucuuacacugaaauuagagcaucuucucauauguuuaaggucauuugcauuuuuuucucugcaaacuggcugaagccccgcucuauguuagggauaguccuuuuccuauaacauaacuuguaaaucuuuuuuucauagcauaucauuuguuuuuuuacuuugcuuauagcauuauuuccauguaaaacgucuuuuuaauucauaugaccagauuuuucaaucuucuuuuccccuaccuucuggauuuuaagucaguuuuuuuucacucuuagguuauagagaaauucacccauucuucuacugcuuguguguuuuguuuuucucagaagaugcucuaauccauguggaaauuaucccagaauguagagaaauagauucaauuuuauuuuuuuccauauguuuaguuaucuugauaccauuuacuaaaaagaacaucuuuucccacuaauguaagaugccacuuuuacuguguacuaaauguacaugugugcuuuuaucuguuuaugauugggcucauauucauguaccaguaugacacaacuuuaauuacagaggcuuuuaccugugcuuuaaauuuguacauuuuuauuuuuaauauuuaaaaaaugaagauauagaauugcuguuuagcauuaaaagaugugagcauauccugacacuaaaauuuuccagugacucaugguuaaaagucagcaggcuaucaugagaacuuuuuaauacaguagcuaugacgaggaggcagauuauuggaacuauucuggguguguuauaggccaggaugaaaggauggaauuuggaaaggaagggaaucauaauguuuuuuaagaccuugaaaaauaauuucuuagaagacuuaugauauguaagauuuguuugaagauugucuguaaaaaguguaucaugguagcuggaugugguggugugugccuguagucccagcuacucaggaggcugaggcgagaggaucucuugagcccaggaguuugagacuagccugggcaacagaguaagacccugucucuuaaaaaaaaaaaaaaaaguauagcauccaauuguuaucugagucucuaguaaauuucuucucucccuuuuuccucuuagcaccauguauguguucggugguuucaauagucuccuccucagcgacauccugguauucaccucggaacagugugaugcgcaucggagugaagccgcuuguuuagcagcaggaccugguauucgguguguguggaacacagggucgucucaguguaucucgugggcgcuggcaacugaugaacaagaagaaaaguuaaaaucagaauguuuuuccaaaagaaguauguuuuuuuuucucuacuuagauuuuaaugaauuugagaccucauuuuaucugaauugugaaggaacuuagcauauguauacuuuuuauguuuaccuuauccaaaauuauucaguaauaacuuguacaaaguguuuuuggauauuugauaauugguuuguaaacaucucggaugggaacaugccauguggcuccuagaagcugucugcgagugauagagacauaaccguuuuggcauugcauaggcuuugcauacugaccccagauucuggcugcaguugcucugaggcagugccauccaguagaacuuuauuuuugaugauggaaauguugugugucuggacugucccgauaugguagccacuagccacaugggcuaucagauacuugaaauguagcuagugugagugaagaacugaauuuuuaauuuaauuuaauuuuaauuuaaaagacauuugugguuacuggcuaccauauuggaugcagaucuaacauuaaggaugaaguuaggagagucagcccagaaaagccauguugaaguaaauuuuuuugguggagggagggagagcugcuguccuugcaaaguauuuuugucuagcgucucuaguuggauacaacagugauaucaagacagacaguuacugaggaugggcgaugaucccugcuucuagaaccucccccauguuuuucaagcuguuuccguccuucugccugcuuugcuucuuguccuauauugcugugacauagagcacaaugcgguacagugaagcgauauauuaaaaauuuauuuuuuguuuuauuuuauuuuauuuauuuauuuauuuauuuauuuugagacagagucucugucgcucaggcuggaguacagcagcgugaucucagcucacuacaaccuccaccucccagguucaagugauucuuauacagucaccugccaccaugcucggcuaguuuuuguauuuuuaguagagaugggguuuuaccauguuggccaggcuggucuggaacuccugaccucaagugaucugcccgccucagccucgcaaaguguuggaauuacaggcgugagcuacuguacauggccagaaaguucuuuaaaaguaagaauguugucucuacaucaauuaauuuaaaguauguuggcugaauuucuuacuaguaggauugguguugcaguuaacuugagaguuaugauggauagaagcagcuuucauuccugggaugcugcuccaaguuaaacuuuucacgaauauaaauucucaguaagaacacccagggccagccacaggggcucaugccgguaaucccagcacuuugggaggcugagguauggggaucacuugagcccaggagucuaagacuagccugggcaacauagugagacccugucucuaccaaaaacacaaaaauuagccaggcaugggcaugguggugcacgccuauagucccagcuacuaggguggcugaggcaagagggcuugagcccaggacguugaggcugcagugaggcaugagugugccagugcacuccagccugggugacagaaugagauucugucucaaaaacaaaaaaacaggccacccaggcaacccacucagguucauuggugggcuggugggugcuggagaaccaagauuaccagaacuuagcaggguuagcuugucucuugaaagggauaaaaucagugaaauaguuaauuuuuaaaccaaauuuuaaaaguucaaauuaaauaugcauguuuauaggaaauaguguugaauuaccuuagguguucauaucaacccauuugcugucaucucaccugagacuucaguucccuguuucaccccacuuucugggugggcccaguccuugggauaaugaccaggacaggaagagcagccuaaggagccgacugcuggggucuuugugagagcggcaccugccuuuuccuguuugugaauucccccaugugccauguccacgagaugguugaacagaugagacaacaugguugugcagcuucucucuuuuuuuuuuuucagacagagucucacucuguagcccaggcuggagugcaguggcgcaauuucagcucacugcaaccuccgccucccagguccugauucaagcaguucuccugccucagccuccugaguagcugggauuacaggaacgcgccacuaugcccagcuaauuuuucuagguuuaguagagacgggguuucaccauguugaccaggcuggucuugaauuccugaccuugugauccgcccgccucggccucccgaagugcugagauuacaggcaugagccaccgcauccggccaugcagcuucucuuuucuagaguuaacaggagaugcggcaggucuguaguagcccagaaauucucagacuugcacucuugaauuuacacgcauguacaaaaugcagcucagccuaaugccuccuguucaguucuguggugcugccuacuuccugugcccaaauuagccuugcguuuauaacuaggaggaaugacuugguguccuacaauauuuuggcuccugggcuucuuugguguucauucuauuacuaguugauuuuuuuuuucuuggaaagaaaaguauucaaagagccagaauuuacuuucauuauaucuuacaguuguuaaauuaaccuauccuuguuuucacuuucuguguacuucuuucuuugggguacaaaacaguguuucuuuagauugucuauuucuaaauauuauuuuaaccagaacauaccaaauauauuuuccugccaguuucauucuucauuuuacuucuuaaccauuguuacgauuuuuuuuuuaacuucggucucagauuuugcucaauugaaguugucccaguucaugagauuuuguuuucuuugcagcucuugaccaugacagaugugaccagcacacagauuguuacagcugcacagccaacaccaaugacugccacuggugcaaugaccauuguguccccaggaaccacagcugcucagaaggccaggucagaggcuguuucuuaaagauuucagaaaaaucccaauuugucauagguuuagcuuuuauaguguauaugguauaaauaauggcccagaguuacuuuucaaauggguuucuauuuggauuuuauuaucccugagguuuuccuuuaggaagagauguucuguauauuucaaggguccuacuagcccugggaauuuguguauuguguuuuagaagaagguaggacuguugucccugggcauggcugugacuaagcacuggauccuugguuugaggcaucugauagugaccucacuuuaccagugccagguuuugauaaaguuaggguuugagagugagucagguguacagcggcccauauugaacuguggaaaugacagacuuugcaaaaucuccuuguuuuauaucuugguuuggcauaaucucacugcucaucauauauagauuuuuaaauuuaaguuauaagaugacccaggcuuuuauaguuuuugacagcuuacaagacuuuuuuuuuugucagucucauacaguucauaaaauagaaaacuuucagacuuuugaagugagcauuugaaaagcaccaaguucaacauucccauuuuacagaugagcagguugaggcaugguguuuaaaagagugggcugcuuccuugccaguuaaaagcauguccuugagcagaacauuccauugcaguguuccccacugcagagcuacugcaacuuaucuaucuaucugucugucugucugucuaucuaucuaucuaucuaucuaucuaucuaucuaucugucuaucuauuuauuugcaguuugcuuccucaauuagauuuuguugucuauaauauccuguugguccucaccauaaguucucucuguggauacaaaagaaaagcuuuuguccacuguguucuagaucuccauuuuuagguaugagaauugccccaaggauaaccccauguacuacuguaacaagaagaccagcugcaggagcugugcccuggaccagaacugccagugggagccccggaaucaggagugcauugcccugcccgguaggccuugcagggucaucuugguguguguggguccauuacuucagccugcuucccccaacacugugcagccuaaguugaaccuagcagaggggaagagcuaauucuguccauucaucccccacacgaguauuaugggcuuuuuuguuuuuaacuaaaauacaguucuuaaguauuuguuccuacuguccuuugaaauaaagugaaacauccuuugcugcucuguagaauugagugacagcuugguucuguaucacugagccugcuccuugucucuuucccauccaccuuugauaaccugggacuagaccaugaugucucagcagucagucugcugagcacuuuauggagaguacuucuuauuaaccacugggauuuaauuguuggcaccugcuaaugggccuucucugagaaggagaggauagauacuucugucagcagcaccuuuuaggggugaucuccagcccugaaaaccucaauauauccugcuucugagguucaggaugaugaacucagggccugagaccagccagccaugugauauauuuggaccagggugguccagaaaggggaacuuccuugucugugcacaacaucugagcuuguucagggaaguugguuuggaccaggcccuuuuugaaugucccuuggaaguuuuugauucagcuugcagagugggacucuuuucuauaucucagugugucucaaauuuuaagguacaggaaaagaccugggaaucuugcgaaaggcauauucuggugcaagugugggguggggccuagagugugcauuuuaucuagucgacugcuacacugugaggagcaagucuuugucuguucuuaaaugaucucuuucccaugguaccuuucuuuuaucucagugacuguuacuguuaaugaacauuguugaugucuccaaaguacuuugguucuggugaaguugcuuuguucuuucauugucuuccaggaagcauucauagcuucugugcaguaccuuguguggguucaggaugaucacagguagcagauuacaagcuugucuuguaugcuauagccauaucacuuggguuguuucucaagaaggaccuucucaccuugcuuuugggaugcuuuguacacuugauuguaccuuccaccugaugauaugaaaacagugcagcuuuuggagacuauagauuuguuaauuccuugauucauuuccauucuugcaguuuuuaccccagcccuccaauaugcauauucauuugucugcucuucacuuaggauuuuaguuuucuaauuguucuucagaaggaaguguaccagucuaauauuggcaccaaacugguguuuucaucuaagacauaggauaagugaccucagaauaugcuuuuuaggauccgggagauaucaccaguaaacauuuuaaaauucuuguauucugcauuugguccuuaauaaugugucagaggcucccacauccuaaugaaguaccuagaauuuaaauuagaaaggccauuucgguauucaguaauuugaacucauaauacaguaguuuugucugauuucuaaaauucuuuucuuucucuuuuccccuuaaugaaagaaaauaucuguggcauuggcuggcauuugguuggaaacucauguuugaaaauuacuacugccaaggagaauuaugacaaugcuaaauuguucuguaggaaccacaaugcccuuuuggcuucucuuacaacccagaagaagguagaauuuguccuuaagcagcugcgaauaaugcagucaucucagagcauggugaguuaaaauccucaaaacuuaaguuucugguuauccaccuuucuaccaagggcaugacugcagcuugcauguggaaggcuguggauaugugugacgugcuuggcaagaaggggagugcuggugaacgcagccugagggacuguggguuugugcugucagagucucuuccucuuaaaauuuuuaauacuuuguauauauaagaucuaugaauaauuauaugggggaugaauuguaacauguauauguguacauaaucuggugacaucaguagauuauuucauaccuguuuuaccucuggauucugcuaggggagaaagagaggucacugauaauuagcuagguuggauuaagccaccugaguuccuuggaguuaagguauuauaauagugcauaagacuguauaauuaccacuaagaaguguacaucucagcuggaugugguggcucacaccuguaaucccagcacuuugggaggcugagguggguggaucgccugaggucaggaguucaagaccagccugaccaauauaguaaaaccccgucucuacuaaaaauacaaaaauuagccaggcaugguggugugcgccuguaaucccagcuacucaggaggccgaggcaggagaauugcuugaacccaggagguggagguggcagugagcugagauugcgccaccgcacuccagccugggugacagagcgauacuccgucucaaaacaaaaaaagaacagcaaaaaaaagaaauguacaucuccuugggucuuucauagcccagccaucucaaaagaagagagcaccuucuugucaagaguuucuaagcccagaaaggcucaaguucucugcuuguccacccagugcucucagggggcuuauagucaauauuccaugaucacauuuugucauuuuuagucuggagucauaaauugugauccuaccgucaguuaaguagacucauagaacaaagcucuuucagcaguuucagcugugguacagaaacguuuaguggaaauguucuuaccaagcagggaggaguugagggcaacacuuccuuggguacagccuccuucaugugaagguauggaaauguggccugggucucggcugccuguggccucuguguaccaccuauagggccauucugagacugguaggaggugcccuguauuuaguuuucuccaauuagucccuuuuuucagugcaacuuagaugggguauggacacucaaacauuggugacauauucuuaguguguuuaccucaggcuacugugaccacauuugguauuucauaauauuuugauagcuuuuucagauuucagaaucuccauuggugacugucucuguuguuucucuuuccauguccaaaugugggucucuuccagcauuccauccuuggcuggcagcugaccuuucccauaguuauucacucccucagaaaauggauggcacccagcuuugcuuauuacccuggugucucuaacaaugacucucgaguccacagaaguuaaaaggguucaaccagguggccacagauauacuucugguacccuuucucucuuccuuagguuuucuaacucuaaacguuucuggguauucuaaucugcuguggccacguuuaugaaacagaaauucacagucuuaaugauaagacugacagaugagagacaacugaaguguaauguccuuccacagcuauaccucuagauguagcccaguuaguagagcccagauuuuuauggaaaaacaagaaaggacaccuagccuaacccuuaggacagaggcuggcugguagaaagcuggaaggaggugaccccugcaggugagaaggagugaauuaggaugucgaagacggaagggcuuucugugauuuaauuagugcccccaucugugagauguagagggagaugauuaagggaguggcucuuugagugagcugcagguaaguuugcaugguuggcugcaggcuggaugggaggggauuuuuauaguugagccucaggaaggaaccaaggccagacccugcgaggccauggcuacaauaguaauggauuugaauuguaucgugaaggcaaagaaauuauugaagggccuuuaaaaaguauuuuuaauugucuuucuuucuuuuggaucuguuuauuuuuaggucuuuuaguaggcauguguauuuuuuccucucaaaaauggaaauaggcugggugugguggcuccugccuguaaucccagcauuuugggaggccagugagggaggauugcuugagcccaggaguucaagacuagccugggcaacacagggagaccucgucucuacaaaggaaguuuuuuuaaagaauuagccgggcaugaugguggcacauacuuguaguuccggcuacuugggaggcugaggcaagaggguugcuugagcccagggguuugaggcuguagugagccaugaucaugucccugcacuccagcaugggcaacagagcgagacccugucucaaaagaaagcaaagggagggaaauacaguauaucuuuuguuuuauaacuaccaaaauuaggaauacuuaccauuucuuggcuaaacuuuauauuuugauuuuuaaaacuuguuaaaaauugcaaugagaaggaaauuucaggagagcagaagacagacugucccaggugucacuguccuauuauucccuauaaaauccagugccaggauggaugaauggauaaagcaaaugugguauaaguugaauaucccuuaucuaaaaugcuuuggacgaggaguguuucgaauuuuagaauauuugcauuauacuaaccaguuaagcaucccuaaucuggaaauccaaaaugcucuagugaacauuuuccuucagcauccaucauguuggcacucaaaaaguuuuagauuuuggaguguuuuggauuucagauuagggauacucagccuguguuuggggguagccaucucuucauauagacauuucagaacuuaaauauugcuuugcuauaauuucugugaauuuuugauauauuaucuucucugagcuacauuuuuauccuuuauaaaauggccauauugaagugaugaucuauccuaaucuaccauggcugagucaagggauaaagagguuuuccuaugucugugggguauacuuaacuuggugguuuuuaucuagaagcuuguuuuggucaagauguugguuauauucaggccaggcaugguggcucaugccuauaaucucaacauuuugggaggccaaggugggaggaucacuugagcucaggaguuugaaacuagccagggcaacauggcaagacuccaucuccaaaauuuaaauuaaaaaaagauacuaucuguauucauaguugugucucuuuugccuuuaguccaagcucaccuuaaccccaugggucggccuucggaagaucaauguguccuacuggugcugggaagauauguccccauuuacaaauaguuuacuacaguggaugccgucugagcccagugaugcuggauucuguggaauuuuaucagaacccaguacucggggacugaaggcugcaaccugcaucaacccacucaaugguagugucugugaaaggccugguaaguucacaggugaauuaggugguauucagaguuuauugugagagaaaccauaggaggcauaguucauugcugagaugugugaaguagucaugaaaacagaugaaguauugauuucaagcaugcaaagaagaguauaacccagauuucagaagcagaaggaaauauucugggacccugaauaguuuuaauuauaagcaaaacuaaaaauaacuaacacuacucgaagaaacugauauucuaauuaacaaugagauugauagguuuauugaccagaaaaaguauugagaauugcucugaaaagcaaauuuauugguguuggcagagaaaugcuguggaagaagaaacaaaaaaggaaaauaaaaacaaagaaaagauuaguaaagcaagcaagugacugcagggacaguguucagaaagguagugucaacagggagaaaaaugaugagagcaguucuguaagcgaggacagaagcaacccagaacuacgcgagagcugcaggagaguacugagcagacagacacucggaguagcuucccagcuuucagucucucugggcuacauuuuggcuaacuaaaggcaggcccagggguagcugcugcagcaugaagacaacucaaaauaagccuccuccuccugcagagggacucacaagcagucgguggaauuguggauuauuuugggaggcuggacuccauuugcauuguguccaauuuugggaaaguaauuugucugaggaauuacagagguauaggagagaauucauagcauuguagauuucuaaauauugauuucuaaacuucucuaggggagcugcccagcagccuuucagaauucugaauccuuuguugaacuuaaugaaugccguagaccuucuucccuccaaaauugcaaacaugagauuuuacauauucaaguggauuguaaaaccccuaaaguucauccuggguccccaaauucuaaggggcuuacagcccuacuuuuauggaaagauucacuguuuccucaucuuuguccuuaaugcucuuugaaaagaaaauuuauuuuuuccacaaguguguaaauacacuugacuaaacaguacuugaugacuuuuauuguuuucuauuuucucucauuuaauugauuucauggcacauuaaugggucaucacccacauuugaaaagucuuggcugggcacaguggcucacgccuguaaucccagcacuuuaggaggccaagacggguggaucacaaggucaagauaucaagaccauccuggcuaacauagugaaaccccaucucuacuaaaaauacaaaaaauuagccagacgugauggcgcaccccuguagucccagcuacuugggaggcugaggcaggagaaucacuugaaccggggaggcggagguugcagugagccgaaauugugccacugcacucuagccuggagacagagugagacuccgucucaaaaaaaaaaaagaaaagaaagaaagaaaagucuuugaccuuagcggacauggugggagcucuaagugucucucuuggguuucauucccagcaaaccacagugcuaagcagugccggacaccaugugccuugaggacagcauguggagauugcaccagcggcagcucugagugcauguggugcagcaacaugaagcaguguguggacuccaaugccuacguggccuccuucccuuuuggccaguguauggaaugguauacgaugagcaccugcccccguaagugaaaaagggagcccuaggcacuuaugcaugcccucuguauaggcaacaacucagccaugaggcugugcugucagccucugaacauuuuagaaacaagacuggacaugaccucugcucaaaccugaccagagacugccaucgagaccuugcugccuauugagaaccuucauacagaaucaggcacauugacaguaaauaaauguaagauagaucacagaguacagaaauaacuuguccaacuucagugucauauugcucaauccauguaauaucuccauaucugaauuuccuaauuuguaaaguaaaugcuuuccaauagauaaucucuaaggucccuuuugccuucaacauccugggauugagagaggagggaagggucaucucuguuauguauugggcaaaauacugggcucuuuacauucauuaucucuuuuaaauaaucaagacagaauaauauuuuugacucaagccaguugaauagucuguuaaaaaaaaaguaaauacagugaauucagaucuaccugugauagucaauugcaacuuuuuuuuuuuaauagcugaaaauuguucaggcuacuguaccuguagucauugcuuggagcaaccaggcuguggcugguguacugaucccagcaauacuggcaaagggaaaugcauagaggguuccuauaaaggaccagugaagaugccuucgcaagccccuacaggaaauuucuauccacagccccugcucaauuccagcaugugucuagaggacagcagauacaacuggucuuucauucacuguccagguaagaugccuugcauauccaaauucaaguguuucacuacugauuuaugaagaauaaaaccuugaaagcuacguuguguauauguaacucccugcccucagccccuuuccuuccuccuaaugguugguacaagaaggaauagaccagaagcugguccaaggccugaccuggaccugcugagaguggugguggguuccuaagaaaccaauucuaagaaauuggccuuugauucagacuugaagugaccacucagcaaugugucuguggguuucuagaacaguugggagaggcugggcuggugcaaagacuccucagagauuagcagucaagaacuucucuaagagccugccauugacaacagggcuguuugugaggacuuuguaagggaaaguccacuguaaacaaagcuaaaagggcagagacagacugggagaaaauaccugcacugcauguaacaacugaugaucauccagaauauguaaacucccacccuccagggaaaaaauaagaagcuaaaugugaacccaacagaaaaagugguuauuggagauaaagaagccauucucagaaaaggaaauagaacaggaaaauguaaacuaacaccaggaaccaauuuuuugucuacuaaacuggaucaaauuuuccguguucccuuuuuuccauacuaagauaugggggaccugcaauucuauuuuuaaucuacuaggaguuaacuuuuuaacgaaauauuuaaaucucugcuuuuucaugaauaucacgaauauaucugguaaaaugacaacccagagaaugggagaaaauauuugcaaaguauauaucuaauaagaauccaauguccagaacacguaacucuuaaaacucaacaauagaaagacaacccaauuaagaaauggauaaaggauuuaaauagacauauguccagagaagaaauacaaauggccaauaagcacaugaaaagauacucaauaucauucaucauuaccaagaaaugcaagucaaagccacaaugagauaccacuuuacacccacugagauggcuguaaucaauaaaacagguaauaacaaguauuggaaggauauguagaaauuggaacucucaugcagguuggcagguccucaaaaaguuaaauauagaguuaucauacggcccagcaguuuuacuccuagguacauacccaagaaaauugaaaacauauguuacccaaaaacuuguauauaaaugcuuaugcuuauagcaucauucuucauagcaucaugcucaaagcaacauuauucauaauaagcaaaagugaaaacaagccaaauaccuguuagcuggcaaauggaugaacaaaguguuguauauucauacaguguaauguuauuuggcaauaaaaaggaaugaaguacugacauauuuucugacauggauuacccuaaaaaaacaugcuauguaaaagaagccaggugcaaaagauuaugcguugcaugaugccauuuauaugaaauguccaaagacagaaaguagauguuuagugguuuccuagggcugggcauggaaaugaagaauaauaggcaugagguuuucuagaguagcugcagcauuauuuucugacauggauuacccuaaaaaaaaugcuaugugaaagaagccagguacaaaagauuaugcauugcaugaugccauuuauaugaaauguccaaaggcagaaaguagauguuuagugguuuccuagggcuggggauggaaacaaggaauaauaggcaugagguuuucuagaguagcugcaguauuauuuucugacaugaauuacccuaaaaaaacaugcuauguaaaagaagccagguacaaaagauuaugcauugcaugaugccauuuauaugaaauguccaaaggcagaaaguagauguuuagugguuuccuagggcuggggauggaaacaaggaauaauaggcaugagauuuuguagaguagcugcaccauuuuaugcucucaccaacaucauaugaagguucauaucuuuccacauccuugccaauacuuguuacuaucuuuuuaaugaaaacuguucuaguggaugagaaauggcaucucacuguuguuuucauuuguauuuuccugauaacuaaugaaauugaacaucaacuucauuaguuagccuuuuguauaucuucuuuggagaaauauuuagucaaauucuuugcccauuuuucaguuauguugucuuuuuuauuauugaguuguaagaguucuuuaugaauucugaagucccuuauuggauauauuauuugcaaauacuuucucccauuauauggguuucuuuucacuuucuuaauaugccuuuugaaaucaaaaguuuucaguuuugauuaaguuccauguaucaauguuuuauuuuaucccaugugcuuuuugguauuguaucuagaaaaucagugcccaaguaacccaggaucacauagauuugcuccuaaguuuucuuugaaaaguuucauagauuuguguguuacauuagguccuugauccauuuugaguuaauuuuuguguauggugugagguagggguccaaacucucuucuugccuguggaugugguccugcaccauuuguugaaaagauuuuuuuuuuuuuuuaaccauugaauuuucauggcacauuuguugcagaucaguugacugugaaucuaggaacuuuuuucuaagcucucauuuuugugcaguugaccaauguuucuccuuuugccaauauuacacuguuuugauuacuguggcuuuguauaaguuuuaaaauugggaaggcuaaguccuccaccuuuguucuuauuuugcaagacuguuacagcuauucuggguuucuugcauguucauauuaauuuuaggaugagcuugccauuuucugcaacaacaaaaagccaacugguuugauaagguuugcauugaaucuacugaccaauuugggguguauugccuguuuguuuguuuguuuguuuguuuguuuguuuguugagagagggucucacucugucacccaggcuggagcgcaguggugcuaucuuggcucacugcagccuccgcuuucccaggcucaagugauucuccagccucagccucucgaguaacugguacuacaggcaugagcuaccaacacccagcuaauuuuuauauuuuuuuagagacaggguuucgccauguugcccaggcuggucuugaacuccugagcucaaagcaauccuccugccucugccucccuaaguucugggauuacaggugugagccaccacgccuggcccuugccaucuuaacaagguuaaaucuucuagccuaugaaccuggaaugucuauuuauuuaccucuuuacuuucuuuuggcauuguuuuauaguuuucaguguacaucauugucuuguuccuuuuuuuaggggaaaauaauucagucuuuauuaaauaugauauuuguuuaguuuuuuuuauacaugcccuuuauuggguugagaaaguuuccuucuauucuaguuuuuugaggguuuuguaaugaaugagugcuagauuuugucaaacacuuuuucugugucuacuuagaugaucacgaaguuuuguucuuuauuaauacuauguauuacauuaauuaagaauguuaaaccaguuuugcauuccugggauaaagcccauuuagucaugauguauacuuuuuuaucaugauguauauuuuuaaucugcuguuggauucuauuugcuaguuggggauuuuguguguacauucaugagggggauauaaguuugugguuuucuucuuuugugauuacuaucugguuuucauagcaggguaguacuggccuccuagaguaaguuggaacguauuccuccuccucuauuuacuggaagaguucgucaaggauuagcauuaauucuucuuuagauguugauugaauucaccagugaaaccaaaugggccuggccuuuuucuuuacaggaaaauuuuuaauuauuaauucaaucuguuuguuauagaucuauucagauuuucuuuuucugagugagucaguuuugguaaucuguuuuucuaggaauuugucuauucucaguaaucaaauuuguuaacauacaguucguaguauuuucuuuuguuuuuuuuuuuuuuuuuuugagacagagucucacucuuucacccagucuggagugcagugacgugaucucugcuuacugcaaccuccgccuccaggguucaagugauucuccugccucagccccccaaguagcugggacuacaggcgcacgccaccacuccuagcuaauuuuuuauuuuguuuuguuuugcuuuuuuuaguagagacaggguuuuaccauguagaccaggauggucucgaucuccugaccucgugaucugccugccuuggccucccaaagugcugggauuacaggcgugagccaccacgcccggccaguucauaguauuuucuugcagguugcucuuuagcaauauguagucuccuguuuaaccuguuaacgauuuuuuuuucugucuaauuugguuuuauuauucuuuuacauuuugcaagggcucuaaauauugugaggguuuuuuuuuuuaagagcuugcucucuuauauuguggaugcaauaauuuaagccuuauugaauguacuaaaauucguauuuuucauucucucauauuucuugcauuaacccuuccuucaggauuuguugcugugcguguuuauccuggugguauucggagauugagaguuuucuuauacugguuaauccucaagguuaauuuguauuaauaacuaaauguguagaucugucaauauuggucagugguugggugugcugagcuguugugaaagugugguaugauguccuggaaaagcuagcaagccagccucaggacacuccagcucugguccacuucgacuguuguugacuggugugcgcaucucccucauuggaagaaggaaggagcaauggaccuggguggcugggugcaauuagcauguucauggguguggcaagugccucccagccuugggugguagggccaccuaaagauagcuggcacauugccuugaguuuucuuucauucuugcuugcuugcuugcuuuuauuuuugagauggaguuucacucuuguugcccaggcuggagugcaauggugcuuucuuggcucacugcaaccucugccucccggguucaagcgguucuccugccucagccucccaaguagcugggauuacaggcaccugccaccaccucuggcuaauuuuuuguauuuuuaguagagacaggguuucacuguguuggccaggcugaucucgaacuccugaccucaggugauccaccuaccuuggccucccaaagugaugggauuacaggcaugagccaccacacccagcugaguuuucuuucaaacacucaaauacuaacaggugcauaaacagaacaaguacaaggcuauggaagguugccaagauggugaaaaacugcaucacacugaucaaccaaggcagaucugaagaaucagauuuugcuuacagugcagguugugcacuauguaaauguuucccccauccuauuccccccuagaguucugcagugcacagccugugcagcuguccugagcaguccucagagguccaagcuucauauaccuuucuaguuguaaagcccuauauccauuaggagucuuaguaaucccacuuguggaaauguuuauccguaaagaugguuauuuuucuaauaaugaaaaauguaaagcaaacuaaauauuagaauauaagggaaugguuaaauaacuguuaagauucaucaaaaucauucuaccauuugaaguuuuguuuauaauugaugaaauaaggugguaaaauaguugugaucuaaguuaagaaaggugaauauuaauaugaacauaauugugcaaauuauguucuucugguauagaaaaauaccagaagaaaauauaucaaaugugaacaguggucucugagugguuggauuguauaugaucuuuccccauccuucuauuuuuuaaguauacugucaugagcauacguuauuuuuuagugaauaacaacaaaaaauauuuuuuaauaucacuaugggcuuucaccuugcugugauacauuuucaauuuuccuggacuagcucuucuuugauauuuuuuaucuuauuucucaaauuaguuuuuagugggccaguuuuggugauuuaucaaagauaaauuaacuacagagauaguugcagauaaaucuuauugaacuuaacuacaugcaguucuuccaugguacagaccccuugaaacucuuuuucuugcagcuugccaaugcaacggccacaguaaaugcaucaaucagagcaucugugagaagugugagaaccugaccacaggcaagcacugcgagaccugcauaucuggcuucuacggugaucccaccaauggagggaaaugucagcguaagucaaauuggucagguuuacucauggcaaaucgguguggaacacagcacuucuauuugacuugaauaucuaggaggaaaaaagccacuuuguuuuggauaccacauuucuuauuaaaucauacuggucagaagcucagcugagcuggaagaaagaaccaagguuucaguguagcugguuaaagcaacaagccaaaaauguuagagucaagccuuugaccacauucugcagugguauaagcaagggcccaaaaccagagaaagugccaacuuccccuguuuccuuuccucccauugaacagggcacaggucaauagucagagggaucagcucagacaugggagucuuggggcucaucucacugaggcccggacaaaagguuccagcaguauauggacacuaagguugugggaagggcaagguguaagggcuaggacugggaaaguccuggguuggagucagaguuaggaaagugucuucugaauucccccuccuccccccaucaggaggccuuggugccugaagaagaccucagcccaaggccucagauagggagccugggaauaaaggcuccagggcuaggaaugugaacaugugaaggagcgugacccgugagguagaccugaguccuuaacugcaccucucucagagccccacacuuaggcccaccucacaggucaugcucugccagguaaagccuguggcauugccuguggucaggccugaaaaaucacacacgggcuuuuuaaccaggagccagacuccucaauacuuauaguguauuuuaaagguuuaaauagucccguguuggcuggguguaguggcucacgccuguaaucccagcacuuugggaggccaaggcagguggaucacuugagguuaggaguuugagaccagccugaccaacauggugaaaccccaucucuacuaaaaauagaaaaauuagcugggcaugguggcgggggccuguaauccaagccacucaggaggcugaggcaugagaauugcuugaaccugggaggcggagguugcagugagcuaagaucacgccacugcacuccagccugggcaacagagugagacucagucucaaaaaaaaaaaaaaagaaaaaaaaaaaaguccuguguuuccccauuuaugucaaauagaagccugcaagcaauaggacauuuuauuaugagaacaaaaauuaugacaagugauauuaaugaacugcuuuuuuuauucuaguuuccagccaaaaaacauaaugaguacuauagucgaaagacuuuucaaaguucugagcaggaaaaguaaacaacauagggaaaucucuaccuacuccccagaucccaacuccaaacucuuuggcauggcccuucagaaucugaucugauccaagaccagccaggagagaggcagcguucuagcugugugucccuuacucucccugggguucaguuuccuccuaauaauagggugguuguuaagaugaaagcagagcagcacaugacacauguuccacaggauacuagucaauacuuaguagaugugggcaauucuuauuacccuucuaaugccauucuccacuacuccuaaguaaaaguucuugcucagauuaaaagguauuuggugaaaauguuuuccccacucuuugugaauagacuuaauccguuagacaguaaccagaguaccuaacagagugguggaguguacaaggcauugugcuguuacccacucaagacacaggugcuuuuauuauccccaagaucaaguaaacugcccagggucucacagugagauguggccaagcuaagaaccacgcccagucugugcugaccuuaauuacuuggcugguugugcuuccagaugccaucauacccacaucagcagcugcuaucuagaagcaucacauuuuccucugugagaucuacagggccugaguacaauuugccuuauuuuucagaguccuaauccacgguagaaagcgugguguuuauagaauacugcagauggcaccaagucuuugauguuuucuucuuaaaauuguauaguccuuagguaacgauaguagccaugauuucuugaaugcuuacuguguuugagacaucauauacauaucaucacaaacaccccuaugagauagguacuguuguuauccccaucauauggacaaggaagcugaaacucagaaagguuaaguagcauucccagagugacagaagagccaaguagaggacgcugaauucaaacccaggcagauggacguaaggccuuugcuuuucacuauacauuacacaccuucccccagucucaacagagccaagugucagacacucaugauucugacuucagcauccauucuguuaaucucugcacuauucuguuuuauaguuuucuuugggugauuccaaaggauuuauuuuuaaagcauaccucucuccagcugaaugccuuucauuuauucaccagcaaaacaggguauaaagugaaaagguguugaccaaaaaggcuuucacuuuuuucaacuggaguauaauauuuaucacggcuuguauuacguuggaugauaaaaggagagauguugaguuggccagaugagggagaugggaagagcuauuuucuguaaaggcaaaggaaaaggugaagcaaggguggcauguccugagggccccuaaagcgcugaccuuggcauuggauccugguucugagcccugcggugauuccaaaugugaccaucguggagaaggcaccucagccaagaccagcccuccuucagaggacagucaccuccagagcaccucccuaggggcagcagcuaugucuguguccccacacccagcaccuggcauucuagagaugcuucacaaauauuuauugaaugaaucaaagaaucauagcagugaaaaagagagucuauugaaaagaucaaaauagucauugcuucagaaggcaguggguaccagcauucacuuuccuccuguccuuuguuugguuccuuuaauguuaccuauacauuauuaucauuagcugaaaaaucaugaaucuuacccauugaaugcucguacuuuaaucugucuuuccuacugaacucaauucagauaaaauugcuuguuuuggaaaaagucuccaauagucagaauuuuuuaagccaguugugaccucuguuccuuuuucuucucugcagcaugcaagugcaaugggcacgcgucucugugcaacaccaacacgggcaagugcuucugcaccaccaagggcgucaagggggacgagugccagcugugaguaccauacucccuggaccaccagggaggaccaagaggcugugcagcugccugaaccccacccugagagccacccacuucccugugucuuguugcugugggcucugagggaucccuggguugauuaguuugaaauuuugcccauucuauuucagacaggucaguccccaaaaugaggaggucgucgaguuagcagcaauuccuuaauggcucuugaauucacauuuuuguuuaaaugauacugacauuuccuggguuguccauuuggaguagucauuuuaacuucagcaacuacuugauuuuugucaugucaagagauuauacucuuucccaaagaguagagauggaagagcugguguuuuggugauggcauuuauuuggcguuugguugucugauuguggaaaugauccucuuaccuuuaacauuucccauuacucuagcauuuuccuuguugaagcaugucaggcaucuuccuggagaggguuugaaguccccauccaugaggaugcaggugcagcagcaucaggcauguuuaagguuucagaccuggcccugccuccacugagcaaggugcucuugaggcaaaucacuguuccccccaucugucaguagugggacuagcaguaauuguuuuugguguccugguagguugaaacaggaaggauaguuccucaaucaauguauaccgggcugucucacugggaaaccucauaaaaugcauguauccgcauuuacucauucucaagaaaaaacuuaaaaaguguuuagugucaaaacacugagcugauuaaucauuguaaacaucauuauuucuuaaauaacaguaguaauaaugccaccagugauugagacaucauugcuggugcuacucagcaggguuuggucugucuacuuuuuaguuuauaucugcauauauguuuacuagcuucauguugcccuaaagccaauaugugaagaaaagucuaauccaagguuaaauuuaacuuuuagguccacauucccuuaaacagaaaaaugucaucgagcaaaauuaaucacucuuacccucaguuagcugaugcaacaaagacaugagguggcaucaaguaagacuuucaaguuccuucgagaucgcagauguaggcaggugcugcucaucacccuggcuaaagggacacagcauaccugccugggaaaggccauuacccacuucccgcccuuuccucuucaugcauagcuguuguguuuaccuaaaugcuucaugaagugggaggcuggguuuugcugauguuuauagaugaucuguauggggaaauuguuuucugaguagaacauauuuuuuuucuacagacuggugaacacuuguuccaggguuuaaaaaaacagugauucuugguauuuagucuucucucacuuguguuuaaagaagagaauuaguuuauccagggaacauaggaaagaagugagaaauuaguauuugaaaaauguuuugacugcacuuuuagaagaauauguaguccacacaaaauugaaaauguuuuucauuauaguaaauagguuuauuacauuuggauuucucucauugcuuuggcaaaugcuugucaauuguccucauauaguuggugugugaacugcugagcagucaguauugaagcguucaugcaugcucuuccuagacugccugagcugaguuauggugaaggaugcaauuauaauggcuccagacuaucuguacuuuauauaaaaggaucuguuugguuuuaaaaugaauucaguuucuguuuuaaauagcaguauaaaauagucuuuuuucccccccagaugugagguagaaaaucgauaccaaggaaacccucucagaggaacauguuauuguaagugguuuugcaauucuuauuucuagaagcaaaguaguucaguaaaacuucauuguuuaaacggguuugagaauaguaagugcuauaagacuauagcagccaccaaugaaguguucccagacuugauauguuuacauucuguuaaguuuacuacauauaggagcacuguuuuaagcuguuuuaauuguguuugggguuaacguuaauguguccauagcagauagcaggagagaguagagaggcaugcaucuuugucuauccacauuuauguucucuuaaaacuuuacuuuauuugccauuaccuaguuggggucaucauauuucguguuuuaggauguagaucaaaaacagaauucuuacaauaugguugaacuuuuugucauucugucuggaacugauuuguguuaaccaccuugaggugaaaggugagucugacaaggugaccauguuuuuauggguaaauguguuuucucuuuaugggagaauccacaugguagaccagaguacgggaccagaaaaaaggaguuaauguuauggcauauccauuguaauuauauaccugcuguacuggguugaauaacaucccuucaaaauucauguccacuuggaaccugugaauaugacuucauauauauauauauaaaacuucuaaaagaaaacaagagaaaaacaucuugaccuuggguggggaaaaguuguuagauaggauucuaaaagcauaauucauaaauaaaaaguagacuaaugaaacuauauaaaaauuuaaaacuuguaggaaaaaaccauccaaaacauaaaaagccacagacuagagaaaauacucgcacaucaucauauauuugauaaggaguuuauauccagaauacaugaggaacucuuacaacugaauaagaugacaauuccaguuaaaaacaggcaaagauuugaaaagacauuucaugaaagaagauauuacaguggccaauaagcacauuaaaaacgacuuaacaucauucguuauuuggaauggagauuuuaaaaccacagucagauacagcccuaaagugauuagaauccaacgcuaaugccauggcuuuuuagaagacagugguaaucucaugucugcuucugcauucagucuguugcaguacaucuuuuugguuaaacacaugaaaaaaaccuggccuuaccaggcaugcaguuggaaaaggguauagugauacccuuuuaauagccuuuucagauaauuauggacguuacuugauauuaugcugaaacuggacaacuggucauuucuuuaaagcgguuugauggguuaacccaaauaaaaugauacugcccacagacuugauuuucuuugaggaaccuggguacagcugaguuaaagugcuuuccucguuacuuaauuuauaagaaaagcagccuguaucucuaaagaccuguucuauuuuguguguguuuaguuuuuaaauaugcauuucuuucuuuccauagauacucuucuuauugacuaucaguucaccuuuagucuaucccaggaagaugaucgcuauuacacagcuaucaauuuuguggcuacuccugacgaaguaagauuuuuuaaagucuuccuauuuuguuuugaauuuguauggaucuuuuucuuggucauuacggauggacguacugccuuaacagugcucuccagacuggaguacacgagaugaucucuagagguauaggaaagaaauguuagacucuacguuaucuccuuuccacauaaaaggcaaaagugauguuaauaagauuuaccaggaucuuagacacagacugacauugauuccacgcauacuuacucugccugucagcccaucauggccucauacagaaaggggacuccaccaucagagggcagauagcagagccuggguuuacucucucaagagugaccagaggcuuaaagacacugcugauugaaaugccagugaugcagccccaaucagacagcaagggaggggaccccaaucagacagcaagggaggggaccccaaucagacagcaagggaggggacacucugcuccuagagugaguucuuagccucauuaggaggcaaaacagcaaaggcuuagucggguccauuaagaaguuagccaggaauaauuuaaauuguuaaaauauguauguaaaauguggauuuuuuuaucugcugucauuaacgaugaagcccaaccugccuuaagguauuaccuagugguagaaggaaggccacacugcgggacauuuaaaacugaaacauacagaacacgaagaugcaccuguacaguuucuucaaugaaauauaaagucaugcaguacccacuucaguauuuaaagaaauuuugcuaaacauaaugguaaauuauuuaggaacuuccuuggagauuucuuacuucucaugaacauacacaaagccauuuaccauuacaaaauuccauuaacaauaaaugugacaaauaauacauggaaaacaauauggcaguaagacaaaguauauugcuuuguuaacaaauguuaucuauaaacauugcuaaauuuaauuuuaaaaguagaacaaagucuauagugugguauguuuacuauacaaguaaaugaaaauaggauuuguuuuuaauauucuauuucaaagauaaaauuaagaaaaaauguacuagaaaagauacauucucaaaaguaaauugcuuuuuaaguaaaaauaauaaauuacuuuaaaugaauuauuuuauggaaaaacuauagguauuaauauaucauuugaguggcuguauugacuggaauuuuuuucuuaacgauuuuagaauaagauuuuaacaaaaguaccauauaugaaauguauucacugccucauaagcaagcguuugaagugcucaaaaucuuucaggauauacuucaugccauuaaugucauuaaaaaaauaaauauaguagaaucuuuguaauacuucuuaaccaggugggaagcaaccaugaaaguauuuggaccuuucuggauuucccaguuuaucuuacgacagaauacuuacuagaguuauccaaaugcauauguucuguccucuauaaaaccacaagcauuuuaaguuuauugauucuuucuguggaaagacauauaguugacccuugagcaauacagguuaaaacugugaggauccacuuacacguagacuuuuuucaaccaagcguggaaugaaaauacaguauuugcaagaugugaaaccugaguauacagaggguggacuuuucauaugcaaggguucuaugggcagacugcggacuggaguauguguggauuugggcaugcucaggggguccuggaaccgaugacccacguauaccaaaggaugacuguaauuguuaguugugugcugccagcaaauacuaaauacaaauaaguaaacacuugagcuguccuuucaagaugaaggugaggucuuaucaguaaaugagaagguaaaugcuuugugagagaaacuucugguuuaaugaucacauuuuaaaaauagcuguuuggaaauguuuccauuguugugauuuugugcuauuaaaaugaucaaaacaacacccuuaaaaaucuuauucuaaccucucaagaucuuuuaaaaaugaauaauuucaguacagucggaugcaucuguaaaagauaaaaauauaacauugauuaguuugcaaaaauaauuguuugaccccaguuaagagauguacuagucaaauuucaguuugacuaauuauuaauguuauaauuuaccuaacaucaccaacaguacacuuccuccacuggcuuaacagauuccucagcaauaucuuuauuagucauuaagaccaaggaucaaaauaaauuaaguuagauuagcccugugaacugcuauaucucuaagugguagacaagguuuucaaaacuaagaagccauacucaaucauauuucucuugaaauaauauuuuuaguaagagaaaaauauuuuucaaaucaugaauauaauaaaauuauuuuuuaaauuaaguacauuucagcucuauaugccuuuuuuaaaggcuguuuccaguuuuggagaaguuuuacacuguauauaaucuaugaguuuagaauuauauggguuucaguuauaaauaaauauaauuuugggcacuugaucaaguguuuuauugguaggagugaacuucagacauuugaaaacagcugcccagagaauccuuaggagggugauuccccagcacaggucaggagaugcaaaucacugugcucugauaggggucuuuuuaaaaggcacuuucucaugcaguuaggcauuugauaaagcauuaaauuauguauacuuuaaugggagggaauaaaauuuuauuggcauauauugcuuguauuaaggaaaauugguuagaaauuuugcuaacucuucugugaguuucucuaaagacaucauaaaauguuugugauuaagaacauuuagaggaguaaacuuuauugcuuuauuuuaaaaucuagaaauuguuuuaauuaauuuucuaauaauuuguaccgcucaucagcaaaacagggauuuggacauguucaucaaugccuccaagaauuucaaccucaacaucaccugggcugccaguuucucagguaaagacauaccuagagaagaccccgcaaaugaaggugugguagauuaagaaauguaauauaggaauugagaaagcgagcucaggagacagauugguuugaaacccacccuugccacuuacuagcuaugagaccuugagcaaguaucuaaaucccucucuaaaccuuagcauuauuuuauucaucuguaaagugaggauaaugauacuuaccucuuagaauuguuguauagauuaaauuagguuauaccuaccagagcuugcuguggugucaggcucagugugugguuacuacccuagcccaccaccaccauuucuguucuugcuguggccacuggcacuaccaucauugucuacauucgugcuucggaagugaaaaauucaaaugauucguuucaauaaaugaaaacauuuuaaauaaaaugagauuuuaguagguacagagaaauguaacuugggaauuacaucaagcucuaaaagcacagcucuugcugucugccuuacugugauucacugaagaucuacuguauagaaaaucuaaagaaauaaaggaugaaggccaagugcuguggcucaugccuuuaaucucaacacuuugggagacugaggcaggaggauugcuugagcucaggaguuuaagaccagccugggcaacauagugagacccugucuacaaaaaaaaaaaaaaaaaaaacccagguguagugacucauaccuguaaugccaacuacucaggaggcugagaugagaggaucacuugagcccagggguuggagauugcacugagccaugaucgcaccauuguacuccagugugggcaaacagagcaagaucccaucucuuuaaaaaaaaaaaaaaaaaaagaaaaaaggauaaucacuacuuaacuugauaacucaacaaguagauauggguuugaaauuuguccauuaaauuuacuugcaccgugcuguuaggcaaguuacuuaagguuucugagccaguuuccuccuguauaaaguaggauaguaaaaacaccguccuggcagggcgugauagcucaugccuguaaucccagcacugugggaagccaaggugggaagaucaccugaggucaagaguuuugagaccagccuggccaacauggugaaacccugucucuacuaaaaauacaaaaaucagccaggcguggaggcacgugccuguaaucccagcuacucaggaggcugagguaggagaaucgcuugaaccuuggagguagagguugcugugagccgagaucacgccacugcacuccagcuugggugacagagugaaacuccaucucaaaaaaaaaaaauaaaaaaacaccuucccaaguagagugaugugagaauuaaaugagauaauaaaugaaguacucaauauagugcuugaaaugugguaaaugguaacuauauuuuaucauuauuacuauuacaauacuggguuuuuuaaaaucaaaaacacaaagcaaugagauugaugcaaaauaagaauauugccuuguacacgccacuuacguuuaucaucuuaaaacauuguguagaauuugagaaaaguucagaaacucucaaugaggagggacuuuuaagaaaaagucugaauuaucagaguauuuggagaaaggcaacaucuccaggcaugugaaagauuugcaaugagccgggcgguggcucaugccuguaauccuagcacuuugggaggcuggggcagguggauuaccugaggucaggaguucaagaccagccugaccaacauggugaaaucccgucccuacuaaaaauacaaaacuagcugggugugguggggcgugccuguaaucccagcuacuugggaggcugaggcaggagaauugcuugaaccugggaggcggagguugcagugacccaagauugcaucauugcacuccagccugggcaacaaaagcgaaauuccaucucaaaaaaaaaaaaaaaaaaaaaaaaaaaaaaaagauuugccaugagugucucaaugaagacgugauaaugugggcucuagucacagggucuaacucagacauggaaaaaaguccauuucauuaaucuuuaucggcacuugaauuccuggcuaagggagaauguggaacauugaaggacucucugggaauaggauggaguuauaccagauuagggggacuuaaauacugugguagcuggugguagaagggaggacugagugaccccuugaaccccuccucccugcuacaguggguuaggcagugagcgguacaucagcauuacuggcaugggagucuggcgcauugccaaggagguguaaaggggaaaugcaaaggaauugaaguggugugggcaaagugaaugccagugcuuguuaauaggauucuagugguaucuguauuuucaugaucaugugugucaccuguuuggggguggggcaaggguggaagggaguuacauggauuccugguaaaaccauuuuucuuucuuucuuuuuuuuuuuuugagacggaauuucgcucuuauugccuaggcuggagugcaauggcgcaaucuuggcucacugcaaccucugccucccagguucaagcgauucuccugccucagccugcugaguagcugggauuacaggcaugcgccaccacgccuggcuaauuuuguauuuuuaguagagacgggguuucuccauguuugucaggcuggucucaaacuccgaccucaggugauccacccgccucggucucccaaagugcugggauuacagaugugagccaccgcacccggccaguaaaaccauuuugguuaggggcauaggcuuguauaucagccugcccagcuuuaaaucuuaucuccauuucuuguuggcugugugacuugagggaaguuacuuaauuucugugaaccucaauuucccagucuauaaaugaagauaauaauagggcagcugugaggauuaaaugagauugagcucuuaaaggcuauuacuggaacacaggaaauguuugauaaaugcuauuguccuuauuauuaaugaggccagauucuguucucccccuagccccccaaaaaaugucucuucucuuucauguuuuucuuuuaacagcuggaacccaggcuggagaagagaugccuguuguuucaaaaaccaacauuaaggaguacaaagauaguuucucuaaugagaaguuugauuuucgcaaccacccaaauaucacuuucuuuguuuaugucaguaauuucaccuggcccaucaaaauucagguaagaagaggcuuuuggucucauaccugcaaagguggugaaaucucuuuaguaagacuaaauuuacuaauuuggagcuugugguaaaugagaugugcaauguggcuuugccuuuguaacguguauggcagaggagugcugagcacaugcaugcugcacagaagauuggaguggggauggacuguaucacucaugaaagacauuugcaaaagcacuguugaaagcaaguuggcauguaacagauuuggucauuauaaacguauucacuucuucagugagcauuugccaugugaaagccuguagggcuacacaaagaacuucaauucuagaguaagguggauguaagugaaacaaacccacauauaacaacugaaagccagaguguggaaagugacaugagaugaucccagaaaugcuaucaaaguuuaaaggaggacaaauggggagacuauguugaagaacaucagccuucuagucagacagagguggauugauuccuggcuccuauacaaaucauacagccuuuccaagucuccaguucucugugcaugugaccugaaggguaguuguaaggggcugugcagcugcugcagugucuuguuagccugcuccuuuccucuguucccagggggccaguguacucccucuuguccgagacccauggccccauuuuaacuuuuuauacucaugucaccuggggccuuuccucaauaccuucugcuucuuaccuucuucauuuaggugaauguggagguuagggauaggugggcuuucaaggacugguucaccuuuaaccauggaagcauggucacuggacggaggcuguugcuguuugccaauguucagaagcauaaucaaccucagaagcaagucaccacaaacauaugaaaaaaguucaacaucacugaucauuagagaaaugcaaaucagaaccacagugagauaccaucucacaccagucagaaugucuguuauuaaaaagucaaaaaagaacagaugcuggcaaggcuguggagaaacaggaacgcuuuuacacuguuggugggaguguaaauuaguucaaccauuguggaagacagucuggcaauuccucaaagaccuagaggcagaaauaccauuugacccagccaucccauuacuggguguauauccaaaagaauauaaaucauucuguaacaaagauacaugcacauguauguucauugcagcacuauucacaguagcaaagacauagaaucaaccuaaaugcccaucagugauagacuggauaaagaaaaugugguacauauacaccauggaauacuaugcagccauaaaaaggaaugagaucauguccuuugcagggacauggauggagcuggaggccauuauccucagcaaacuaaugcaggaacggaaaaccagguaccacauguucucacucguaagugggagccgagaacacauggacacaugguggggaacaacacacacuggggccuauuggagagugauggggaggaaggagagcaucaggaagaauagcuaguggaugcugggcuuaauaccuaggugaugagaugauguguguagcaaaccacuguggcacacguuuaccuauguaacaaaccuauacauccugcacauguaccccugaacuuaaaaauuaacaauaacaaaaaaagcaaguuaucacucaucaauuaggaugccuugggacugugacuaaagaacaguugaucuuuccauucuggaaauauggaggacaaaaacuauguuguaguuuuucucaccacccucucuccuuuuuccugucuccauggucuaagauuuguuaauccucucaucagcuucucccuuugcccucgcauacucccugugucccuccucagccagucuuguaagcaucagccacgcuucuuauuccuguuuucucuugucuagucacacaucugcucacaauggucuggccucuucccucaccacauccugaaacuguccugucauagugggccccagugauggaauuuuucaguccccuuuuuaucucauugcauggcuuugaaucaucaucuuucuugucuuccuggauuuuucuuuuccucguuuucuggccagucuuuuuagggaauccucuuccucuuccuuaaacacugggcuugucuaggauucagaccugguccuuuucucucuucacuguuuccugcaugugggacuuguggugccacaucuauucuggugauucucagugcugucuccagaccggcacuggcaguugcugccuggacagcccuaccuggguagucaaagcucccugcguucggugcauauuccuucuugugaucuuagccccagacuuccaugcuuccuuucucuguaaacagcaccaccaucacccuguuguacaagcuagggccugaugaucauuugcauuccugggauaaacccaacuugagcaugacguauuauuuccuuacuuuacacguuguuggauucaguuugcuaauauuuugguuagaauuuuguaucuauuucaugaguaagaaugucugauaauuuucccuuccuguccuuguuaugguuuugauaucauguuaaacuaacuuuuaauaauuauaauuugaggaguuuucacucuuucucaucucuggagauguaagauuagaguuaacugaaccucaaguacuugguagcucucuccuguaaaaucauuugauccuagugucuuauuuguggagauacuuuuuagcugcugauucagcuucuuuaauaguuauaggauauuuugaauuuccucuuuauuugauucccuuuuuaauauuuuuucuagguuuuuauaucauguuuuuaaauguauuuuuaauuuuacuuuuuaaauugauacauaauuguacguauuuaugagguacaugagauauuuugauacaugcauacaauguauaaugaucaaauaagaguaauuaggauauccaucaccucaaacauuuaucauuucuuuguguugaguacauuucacaucuucuagcuauuuugaaauaaugaauaaguuauugcuaacuauagucauaaugacuauugugccauugaacacuagaacuuauuccuuguaacucuauuuuuauacccauuaaccucuaucuccccagccccccagcagcugguaaccaccauucugcacucuaccuccaugagaucaguuuuuuuagcucccacaucugagugagaaaacauaucuaucuuucugugccuggcuuguuucacuuaacauaaugaccuccaguuccauucauguugcugcaaaggacaggauuccauucuuuuugugacugaauaauauuucauuguauaauauauacaacauuuuauuuguccauucauuuguugauggacacguagguugauuccaugucuucacucuugugaauagugcugugauaaacauuuagagcaugcaguaucucuccaguauacugauuuucuuucuuuuggauauauacccagcagcgggauugcuggaucaugugguggaucuauuaugagcagucuucauacugucuuccauaguggcuguacuaaauaauuuacauucccaccagcagugaacuaguaucgucuuucucuguauccucgccagcaucuguuauuuugucuuuuuaauaauagccauuuuaacugggaugagaugauuucucauuaugguuuugauuugcauuugccugaugguuacugauguugagauuuuuuucauaugccuguuggccauuuguaugucuucuuuggacaaaucucuauucagaucauuugcccauuuuuaaaucaaguuuuuuuccuauugaguuguuugaauugcugguauauucugguuauaaaucccuuguuggauggauaguuugaacauauuuucucucauucuauaagcugucucuucacucucuuguuuccuuugcuuuguagagcuuuuuggcuugauauaaucccauuugucgauuuuugcuuuuguugccugugauuucgacaucuuacacaaaacaucuuugcccagaccaauguccugaaggauuuucccaauauuuucuucuaguaguuuuaugguuuuaggucuuauacuuaagccuuuaauccauuuaaauuugauuuuuguauguggugagagagaggggccuaguguuauuuuucugcacguggauauccaguuuucccagcaccauuuauugaagaaccuguccuuucccucacugaauauucuugacuccauuauugaaaaccaguuggccgugaauauguggauuuauuucugaguucuuuauuuuguuccacugguccguguaucuguuuuuaugcugguaucaugcuguuguggguacuauagcuuuguagcauauuuugaaguaaggugauaugaugccuccaguuuuguucuuuuugcucagaaaugcuuugguuggcugaguacagcagcucgugccuauaaucccagcacuuugggaggccgaggcugguggaucaccugaggucaggaguucgagaccagccuggccaacauggcaaaacccugucucuaauaaaaauacaaaaauuagccaugugcaguggugggugccuguaaucccagcuacuugggaggcuggggcaggagaaucucuugaacccgggaggaggaggcugcagugagccaagauuacgccacuacauucuacccugggcaaacaaagcgagacucugucucaaaaaaaaaaagaaaaaaaaaaaaagaaaugcuuuggcuauuugaggucuucugugguuccauacaaauuuuaggauuguuuuuucuauuucugugaagaaugucauugguguagagauuacauugaaucuguagguagcuuuugguaguaugguuuuuuucacaauauuaauuauuucaguccacaaauguggugucucuuucaauuuuuuugugaccucuucaauuucuuacaucaguguuuuauaguuuuccuuguaaagagggcuuucaccuccuugguuagauuuauuccuacgguuguuuuuggaaguuuuaaaaaaaucuaucgagaaugggauugcuuucuugauuucuucuuuugcuaguucguugcuccuauauagaaaugauucugauuuuuguguguugauuuuguauccugcaacuuuacugaguuugucaguucuuaguuugguggagcuuuuaggguuuucuguauauaagauuauaucaacugcaaauagggacacuuugacuuccuccuuucaguuuggaugcccuuuauuucuuucuuuugccuaguugcucuggucaaauauguugauaacuuguugaugcuguccucuaaugcucgcagcgucuguguucaugaaacccuuuguuguauuccaauguugauagcauuauucacaguaaucaaaauguggaaacaacccaaauaucuaucaguggaugaauggauaaacaaaaugugguauguauguauguguguguguguguguguguguguguguguguguguauaaaauaaaauguuauucagcauuaaaaaggaaugaaauucugauacaugcgacaacacaagugaaccuugaaaacaugcuaagugaaauaagcuaguugcaagaggacaaauauugaaugauuccacuuaacaugaaauaucuagaguaguacacagauucuuagagacagaaaguggauuggagguuaccagcagcuagggggagcgggaaauagggaauuacugcuucaugguuauuaaagaguuucccuuuggggugaugaaaaagcuuuggaaguagguagugauauugguugcacaaaauugugaauguaauuauugccacugauuuguacacuuaaaaaugguuaaagugauuuuauguuauaucuuacuacaauaaaaaaagucuuuaaaaaucacagcaagauguuuuuguagauauagacaagcuuauucugaaauuuauaugaaagggcaaaaguucuagaauagcuauaacaauuuagaaaaagaagaauaaaaugggaagaaucaaccuacccaauguuaaggcuuacuauuuagguacaguaaucaagacauuguuucagguagagggguagacacacagaucaaugggauaggcugaucuauagguagaucccagaaauagaaccacauaaauauguccaacugauuaggauuugauuuuguuugugguguuuuuuugagacagggucucacuaugauguccaggcuggucuugacuccugggcucaaguaacccucucaccucagccuccugaauaacugggauuacaggugcacaccgccacgcuaguuccagcugaauuuuuuuuuuuuuuuuuuuuuuugagacagggucucacuuugucgcccaggccaaaguguaguggugcagucacagcacacugcagccucaaccucccuggcucaagugauccuccugccucagccucccaaguugcugggacuacaggugcauaccaccaugccuggcuaauucuuuuuuuuuuuuuuuuuuuuuuuuugguagagaugagaucucccuguguugccuagucuggucucaaacucucaaacuccugggcucaagugauccucccgccuuggucucccaaagugcuaagauuacagacaugagccguugcgcccagcccccagcugauuuuugacaaaggcccugcaaaggcaauucaaugaagaaaggauagccuuuuaacgaauagugcuagagcaguuggacaaccauaggcaacuaaaggaaucucuaaaucucacaucuuauauaagaauuaacgcaauauugaucacagaucuaaauguaaaacauaaaacuauaaaacuuuuagaaaaaaauauaggagaaaaucuuugaaucccaaaacgaaacaaaaccuuuuuagacucgauacuaaaaacgugauucauaaaaggaaaacuugauaaacuggaccacauaaaaccaaaaguuuuugcucugugagaaacccuguuaugaagaugaaaaggcaagcuauggacugggagaaaauauuugcaaaccauauuucugggaaagcacuugaaucuagaauauaauaacucucaaaacucaacaguaaacaaacgaacaauucaguuagaaaaugggcaaaagacaugaauagacauuuaaccaaagaggauauacauauggcaaauaaugacauaaaagaugaucggcaucaauaaccauuagagaggccaggugugguucacaccugaaaucccagcacuuugggaggccaaggcaggcagaucaccacuugaggucaggaguucaagaccagccuagccaacauggcaaaaccccgucucuacuaaaaauacaaaaauuagccaggcaugguggcacaugccuauagucccagcuacucaggauacugaggcaggagaaucgcuugaaccugggaggcagagguuacagugagcugagauugugcuacugcacuccagccugggcaacggaaugagacugccucucaaaauaaaaauaaaauaaccauuagagaaaugcaaauugaaagcacaaugagauaacacuacacacuuaucaaaaugacuaaaauuaaaaauaguaauaacaccaaauguuggagagaguggggaaagauuggaucacucauacauuguuggugggaauauaagaugguacagucacucuggaaaauacuuuguuucuuaaaaaacuaauguuauacuuaucauauaacccagcaauugcauuccuaggcauuuauccuagagaaaugaaaaccaguguucucacaaaucucuguacacccguguuuauagcacuugaaagcaauauuuaacagcuuuauuuauaauagcccaaaacuggaaacaagccaaauauuccucaacaaaugaaugcuuaaauaaaugaugcuacauacacaccauggccuaauacccagcaacaaaaagaaaugaacuguugauauacagaaacacaacaacuuugauaaaucccaagcaaauuuugcugauugaaaaagaaaaucuuagaaauuuauauacugcaugauugcauuuauauaacauuugaaaaugaaaauuuuagaucuuauauaccuaugcacauauugaauaaguauccugaagcuucaaauuucucugacuucuuaggacucugaucucuagacccuguuuuaaaggagcuuaucugauuaggucaggccuacccacacaggaguagggaagauacagagcgugcccaucaagagguggaaaucuugggggcauucuuagaauucucccugcuguaggcugcauuuggaauagagcuugcagggguuucgguaguuucuccgauccgaaagagguugagcucuagguuccagucaguauaauuucaguuuggcaacaucuccugacacuauuaagauauagauuauauauauuuguuagguuauuuucauguaaacacuugauuaggguucuaguaaauaaaauuuauuuauuuacucauuuuaaguugagauuguuuuuguacugacauaccucuccauauucucaaucuaauugaacaucgugcuuuguugcuuauagcugacaaaugauuaauacuuuuuagauucuuagugaaaaucuugacuuaugcugcugacacuuuucccagucugugccuauaagcaggcuuuugugcuggagauggccauacuuguugccaaugccgaguuuuuuuccucccaguucccuauugcuccacccucugaaagucacugaagugguuuuagagcuuucauucuagagggagcucuuccccacacuuacuucuaagaaguaauaauuuuaaguuucauaaucaaggagauguugauuuucuuccugguuuucuggugcuccuuaucuuuucuggaucacuaacuuaaauuaagauccacuuaugaaugcugcauucaggagcacuugugaaaauaaacgauggcaugcccaccauuuaguuugccaagcuuuccuugaaaacgcagguaaguucuauugcaaacgugucuuuuugcuguuugguacaaaugacugcacuauucacugugacuaggcccgugucaccguguguucucaguccucgcaugagagccugguugacacugguucucucugcuuuggggaccguaucuggcugugcgcuauguggagggcugagcucgugucuuccuggguaaauacaucauguucucaacaagggcugcauguuucuuuauugcuguuuuuuccccagagacuuagcuuuucuagguguguagcauggcucuuaaauacacacauuuagcaacugugcaaauucaguaaaaauggagagacuuauuuaaggaagacaguagggaaaugucuaaauagugcaguguaggccauucaguuaaauuucaguauggcuuucgaugcaggcaaagccguuuugccuuugauucucauuuuuuaaauuagauuuuaaaaauugagauucuccuuuuuuaaaugagauuuuaaaaauugagauucuccuuuuuuaaaugagauuuuaaaaauugagauucuccuuuuuuaaaugagauuuuaaaaauugagauucuccuuuuuuaaaugagauuuuaaaaauugagauucucauuuuuuaaaugagauuuuaaaaauugagauucucauuuuuuuaaagcaaaguaacugaggaaaucuaauucucuaguuggaaauuuguguaagcauuggggcuuuaaaaaugguaauacuaaacucaaguuccuucacucugaaccaaucccaggauucuuuuccauaauuaggaacagaucaaaaccuauaacugcugagggaauuugaaacugacuauaaaaaucuuuguagaugcagcuaaaaaacaaacaaaacccacagacugaaaaguccuguuucugggaggguggcggguguguuggggccgguugugccuguuuuuugauugguuguuccugugggugagcacccuucccucugccccugcuuucugaaagcuauccuaguuguucuccccaguaagccggggcucagccggcuucagcuauguccauaguuugggggcgugggcgguagguauucaagauagaagaugguuggacagaaagugugugaggugggaagguggaguggugaggcucuggcucguucccgacucugcaacagagguuguuacuguaauguggagcuaauauagaagucugcgugcuggguguuucaucuacuguuuuauguaagaggccaguguucacaaguaaaggcaacacagaauugguauugagaacugggcauucauuuagauuuuagaguucuguuuaugggugcuaacaggaucgcuauacugagcaagggaugugugaaacuuuuguucacuuggaugugcuuuuuuucuuauaacagcuuuauugagacaucauuuacauaccauacaguucgcucauuuaaaguacacaauucagugguuuucaguguauucacagaagcgugcagccacccgucacuacagccaauuuuagaauauuuucaccacuuccagaagaagccccuagcagucaguccucauuccccccucuuccggcaacccccagucuguauuuccugucucuguggauuugccuauucuggacauuuuauauaaauugagucacaugauaugcucucacuuagcauacuguuuucaagguucacccguguuuaguauguuucaguacuuauuccuugucauagcugaauaaucuuccuuauauguauauaccacguuuuguuuauccauuuuucuaucgauggaugcuugggugguuuucacucuuuggcuauuaugaauagugucagauauacuuuuaauguuuauauuuauuguauaauaacagugcauauccguaccuccugguguuaauugucuguaucuuaagaguuuuaagaauuauaugguugugcuguaauucuagcacuuagggaggccgaggcgggcagaucgcuuuagcucaggaguuugagaccaggcugggcaacauaguaaaacccugucucuacuaaaguacaaaaaauuagcugggcguggugaaguguuccuguagucccagcuacuugcaaggcugaggcacaagaaucacuugaacccaggaggcagauguugcagcgagccaagauugcaccacuguacugcagccugagcgacagagcaagacuccugucuccaaaaaaaaaaaaaauuuuucuuuaugaugaaacccacaaggcuguacaagaaccuuaaauauaguuugaaacaaagaaagacacaugcuuuuaaguacaguuuaauucuuuucuuuuuucuuuuuucuuuuuuuuuuuuuuuggagacagagucucacucugucgcccaggcuggaguacaguggugcaaucuuggcucgcugcaacaucugccuccuggguucaagugauucucgugccucagccuugcgaguagcugggacuacaggaacacuucaccacgcccagcuaauuuuuuguauuuuaguagagacaggguuuuaccauguugcccccaucauucucagcaaacuaucgcaaggacaaaaaacugaacaccgcuuguucucauucauaggugcaaacugaacaaugaggacgcauggacacaggaaggggaacaucacacaccagggccuguugugggguggggg

SEQ ID NO: 191242 - RNA, 35017 nt, Homo sapiens
ugcccuuccaaaaacugcuuguuaaguuucagguacacaauuaaccugcccaauuaauuuugcagaaccuugaaauaaaacauguuuuacaguaaguucacacacaggcuuaaugcaaaccagaguaaugcacagaugauugccaagaccauauugacaaauugugauuagauuauaacgcauaguagccugccuuacauucagcaaguucaaacaggacacaaaaccagucaacugaacacagagcagcucucuucagaagcacuuccaaugagugaugcagagauuucaaaaauacaaagcaggcaacuuauauacagcaaauccucacacugccuggacaugugccacuuuuuuguuguuuuuaauauauuuuuccuuccugguugcuaauuuagacugaauucuuaaggauuuaucuugaugacuuagaaaaauacaccuguccuuucucacuuuguuucagguaguacagucaugaaauugaguaagucucuuaaaaaaaugaaaguccacagaucccauuguggaagguuucaggaaccccuccccagguaaugaucacgggaucuucaacagcucaaggagugcuccaacagcuccaaaauaacccugaaagaaaauacaccaaaaauaagugcaauuuuccuuagacuuauucaaaucaccuuacacaugaugacuaguguuaaagccaaccacugcccacacacagcauacccauuuccugagcaccccagaagggccaaggccagccugggagcagagacgcccuaaggagucccugucuggggagggggcuggauguccuagacuauccaagcacuucagaccacugugauaagaggaaaaccaaacccgcagugagggcgacaggagcuaugaggccagcagcagcucaguuaccucugguaagagacagaaccugacuguuucuggggaaugaggugagaagcagcagaggccuggagcauuuccagacaacuaaggaaugaaggcgaggucggaugcaaagugcaaugaaacaggugaaguugugaggugggucacagagggugagagcccgacugagcugggagagggagggagaguaagagauaagauggauucaagauucaccccuaacagaggacaggacagcaggagggggcagcauccccgagaaaggggacacaggaguaagagguguggagagcaaggccggugggugaguucccuacaggacaugggaagcugaggugcccacagcagccaagcagcugugcccggguggucaccagacaccuggaucacuggcccagaagcaggcggcacaggaaugaaaaccaccacccaaagguaacgugaagagagguacagaacaaagagcaaagccugaggaagcacggaggcucccgagggagggcagcccucagcccuccugagacacagaagcagcagcugagagacgacaagcacuguacugucuccagaagcagucaggucacaugcaaccaagaacucaaaaccaaaacacaggaauagcacauuagagaaaacggggcaaaccccauaaugacagaaaagagaacacuagcaagaaucagaggcaaauccuaaaacgaugcagaauccaucagggucuccaaccuguaagguaagauaucagacuacuuuuuaaaagaaauaacuaaaaaaggaaugagaagauccugaaagacuuguguauggauuuuuuaaaagucucugaaacauaaauaacuaccacucuaucuuucacgaaaagcuucuucaagaaaccugaucaaacgagaggccaaaggcuuucuugucacacucuaguuggcaauuuaaaagaaaggcauauuggcugggcgcaguggcucacagguaacccagcacuucgggaggccaaggcagguggaucacuugaggucuggagcucaagaccagccuggccaauauggcaaaccccgugucucuacuaaaaauacaaaaauuagccaggugcgguggcacgugccuguagucccaucuacucaggaggcuuagacaagagaaucacuugaacccaggaggcagaaguuaaagugagccgagacugcgccacugcacuccagccuggcugacagaguaagaccccaucucaaaaaacaaaaaaaagaaaggcauauugaccaucuuugguuuugguguguauaaauaaaauaaaggcagccacaccaaucugugaugugaggcggccagcagcuacaggacaaggcacagcugaaauacagaggcaaggcuguuugucuuaauaguucacuauacaguuuguuuuaggcagcuuucuguaccuuuuauuuuauaauaaaaauauagaagauacaguuaaccauuauauauauauaugggggggguccacugaagacuaggaugcuacuaucaagacagaaacaggugguuauaaacuacaacgugcuaagaugagaauaaaggaucaaagaggaaacgcuugagagaaucuauacgaagcuuucacaacaaaaguuaaagugacuucaaugugagggcaagaaaauauuucaaggcucagagaggcuaaaauaaucaaaguucugaacugaacaaugagaacacuuggacacaggaaggggaacaucccacaccagggccugccaugggguggggggaggggggagggauagcauuaggagauauacuuaauguaaaugacgaguuaaugggugcagcacaccaacauggcacauguauacguauguaacaaaccugcgcguugugcacauguauccuagaacuuaaauaaaaaaauaaaauaaaauaaucaucaaaguuccacaagggcagagaugcacacaagagucaaaggccugaaugcaaauggaaaacacagggacaaauggaccagcaaagcuaagcagugggaaaaacaaagucagcgagcaauaaggacaaaaugcaaccaagaauuucacgaaggcuuauaacuauuaugaugauaucgguuugguguuuuguuuuuuguuuugagauggaguuucgcucuuguugcccaggcuggagugcaguggugcgaucucggcucaccgcaaccucugccucccggguucaagagauuuucccaccucagccucccaaguagcugggauuacagguaugugccaccacguccagcuaauuuuuguauuuuuuguagagacagggcuucuccauguuggucaggcuggucuugaacuccugaccucaugauccgcccaccucggccucccaaagugcugggauuacaggcgugagccgcugcaccuggccuguuugguguuuuuguuuguuuuguuguuguuguuuguuuuuguuuuugagacagagucucguucuguugcccaggcuguaguacaguggugcgaucucagcucacugcaaccuccgccucccagauucaagagauucuccugucucagccucccgaguagcuggggauuauaggcgcccgccauugcgcccagcuaauuuuuguauuuuuaguagagacaggguuuugccacauugaccaugguuggccaggcuggucuccugaccuuaggugaucugcccaucucagccucccaaagugcugggauuacagacgugagccaccgcacccagccuauuuuuuuuuuaagguuaacuuaaaaaacuaaucuccauguucuaccuaggaaaagguuaaacaagaggcagaaauaaagcagaaaaagaucuaacauucgaguuuaaaaaauucuaauauaaagcaaaauaaaauaagucagaucacaaaaaaagauguauacagaaacaugaacuguaagaaacuuaauggcaauucggugcugguuuacaaauacaguaauguuagaauuuuaaaacuaaguuagaugacuucaauuuuaagcuuuuugauauggggauuuguguacuuuggacuucaacuaugaacuaaagcaauuuaaaaagaaaaacuuaaaguaacuuuaaaggaaaaaguaaucucuagcacuucaaaucugugcuauuaucuggacuuugauuuccuuuaauucauauagacuguuaaacuaaauaugcaauacaauucugaaaaauguucauaauaacaguaucuaaaauccaagaacaguugaaagaauaguucaacugccccacaaccaagaagggaagaaagaaccccuacacgccuuuccauaccucugcuucuuuuuccccaaauaggaaaaauaagagugcuuuccaagacaggcuaugagguugagcaauuugauucuuuuccauuucaucauuuccagccugucuacaauuguacuuaaguucuuaugauaguaugguucuagucugagagguuuacucaucuauucauuuuuacaacaugcaucuuaaauaacuggcacaagaauuacaacaauauauaaaaacuggcacugaaaaaaaugaaaaaaccagaacccagaguaaugacacagucagugcaauagaaaaaauauagaggauaguucagacaaaaauauggcaucagaaauauaggggaauguucaaggguuuuucucuaaaauuccuuaagcuuacaauuaaauuaacccaaaauuuaccuugcauuaguaucagggaagaaacagcuuucaaauguuacgaaauuaaacuaccaaaaaaguucaggcacagugguucacaccuguaauccuggaacuuugggaggcugaggcuggcagaucacuuaaggucaggaguuugagaccagaccagcuuggccaacauggugaaaccccauuucuacugaaaguacaaaaauuagcagggugugggggcgcacacuuguaaucccagcuacuuaagagacugaggugggaggacugcuugaacccaggaggcggaggcugcagugagccccaagacugugccacgcacuccaaccuaggugacagagcgagacuccgucucaaaaaaacaaaaaacaaaagaaacacugcagcccauuucaccuccacccucuaccucaaguuccaugacagugugacccacaagcccucuguguacauaauauaccacaacgaacaagucagcuuaccucguguuccgaaaaaagugcuuucaacugccccuuggaccaauaauccaaagcauaugccaaaagccgcauggcgaucguauuaauucucaagaaauuuccaacaaauaccaccugguuaauguucugagcacaccaaaaaaaggcaauuaguuuucaucuuaauuucuauuuucucauaaaagcuaccccaaauacagcaccaugugcauagcucuuagcaacaauuugacugcugaucaaauuuaguccaguugguccagggcuacuuaaacuugauccccagacaacucuggacccacugcaaagcaugcuagauaaugucacaggagaagaaaacagauuaggaaaaacauuuguauuaaaucugaccaacaauaacuaguuuugaauacaauguuuuauacagauaaguuaaaauaaacaaaaaaaaacaguaugacuccaauccaaaaggacagugacacaaacaggcaaaguauacaagcaauauaacaggcagcgaaaaauucaaaccacuagucaucaaacaaaaguaaaauuuuagaccuauuaaccucgcaaaaaaaagcaacugaaauuccaccaccaccaucaguaguuguaguaaaauuaauccacucauucaccgcuaaagaugaucuaaauuggugcagcccuugugcaaagcaucaugacgauaaaugucaaaauucaugagcaugaucauuucuguagaccagaaaucucacuccuaagccccauaucaagaauaaaauucaaccaaagaauaacuucaugcuuaaaaaugcuuacugccgaguuaugagcaagcaaccaaaugccaagcucuguuauuugauauaaaagaacuugaucaaauaaauauacaaccaugaaauguauauuuaaguauaaaauacaaauugugguaugcacaccaacuaaaauuucugaaaauacguaagcacaggaaagggaacauacaauaaagaaaaaagaaguuaugauauuccaacaaauguuuaauuacuugaugcugauacaguauuuuuuuaauuuaaaaugagacaaauccuuugugucuuuugagguuuccuuuuaagcuacaugccuauuauuaucuaaagaauaacuucuuaaaaauaaaaauaaaagaauaauuuaacaacuauacacacagggacaagccauaagcugcaccaacuggauccuagauccucuuuucccaagggcagcccauucuugguucuuucauagcccuguacaaugcugcuugaccugaaugcuacaaggcagcacuguaaagaagcugaaagcacaaagacgcagcucugcugaggugggggagccaaggagggcaccccucggccugcucagucuucucccagcuuccgugacuuccucuggauuccucccuagggccucuagagcucagcagugaguguggagucuacauucagcaucguuauccaucaucacccccaacaguccccaauaucuggaacacuggcuaccuuccacucuuccucuacuuucuccucaaaagaugucauuuuaccucuagacaaguagcaauguuuaucuucaguuuaaaaaaaaaaaaaagaagauuaaucuguauuugaagaguuuuaacuucgugcuaaaacaaaccccaccccaaaugacuacauuuaggcacuguucugagaaaacagacgugauggggcccacuuaaguucaguauuuuccuuagagcaauuaaagaaauccauguccccuuacuucauuaagggcacacauucuugcuauugagccaauguuguuggugauggugaucaaagucgcucuggccagguccucuuuacugacagccucucgcuucuccuugcucaucauguuuccaaagcugugaugggggaaaaaaaaucccauugcuaaaccaacagcaacaaagcccaacagaacuugaauguuacuuuauugaaauaaaauuagcuuuuagggcaacauuguugaaaucuucaaaccuuuuauuuugcaauggagcaucuguucaaagagaaaugcaaacuucaaacagagcccuccaacauucuaaaugagcagacagcuuucccugcgguuucuacugaaaucuagcuuggauaccagauauucacauauucaguuagaaucucaucagaugcacuggaaggcaccauugcuccugcaaccagacaguuccaggacaacaccucuaacagcaauucaucucaacugcacagcuguuccacucagauggccacaugcacaucugguaaacugcucuaucagagcagaguaaagcacagacagcugagucccagagugagcugcuuaagaauuucagguuucccuagaagauaaaguacuucaaaguacaugcucagcagaacugcuacaauaauuuuccaaucagaaaaggaagugaugaccaacgagcaaauguuacaaacagaaaaucaacagcauugaccaagugccuaaaacuuaguaaacaagcauguauacauaugauuuuucuauuaguaaaagccaugugccccaauauacgaaaaacaauuguacuucuaaacgaucucaaaauggagacaaugauuucauuuauaauagcauuagagaauaaaacacuuacggauauaucuaacaaaaguauuaacaccuguacaauaaaaucuacaaaacacugcugaaagaaagcaaagaucuaaaucaaugggaagacauuccaucuuuuuggaucagaagacuuuguauuaggauggccaaaagauucaauguaaucucuauuaaaaucccaguugucuuauuuacagaccuugccaaguuaacccuacaauucauauucucaagguacccagaauagccaaaauaaucucgaaaaaagaacaaguuggaugacucacacuuucuuacuucagaacuuaauacaacgcuacaguaucaaggcaguaugguacugguauaaaaacagacauauauaucaauggaacauaacuuaagaguccaggaguaaacccaaacaucuauggucaacuaauuuuugacaaaggggccaagagaauuuaacagggaaagaaucaucuuuucaacaaaugguacuaggacaacuggauauccacacgcaaaaagaaaugaacuuggagcucuaccucacaccauacacaaaaacuuacucaaaauggaucaaauauaagagcuaaauauaagagcuaaaacuggcgggcgugguggcucacgccuguaaucccagcacuuugggaggccaaggugggcggaucacgaggucaagagaucgagaccauccuggacaauauggugaaacccugucucuacuaaaaauacaaaaauuagcuggguguggcggcacgcacuguagucccagcuacucaggaggcugaggcaggagaaucgcuugaacccgggagguggagguugcagugagccgagaucgcaccacugcacuccagccuggugacagagcaagacuccaucucaaaaaagaaaaaaagaaaaaaauacacacacacacauauauauauaugagcuaaaacuauaaaacucuuaaaagaaaauaaacaauucuucaugaucuuaaauuaggcaauucuucaugaucuuagauuucuuacacauaacaccaaaagcacaagugacagaagauagauaagauuaacuucaucaaaauuuaaaauuuccaugcugcaaaggacaccaucaaggaagugaaaagacaacuaacaaaaugggacaaaacauuugcgaauuauguaucuaauaagggacuuguauccagaacucaauaauaaaaagacaauccaacuaaaaacuuagcaauagacuucagcagacauuuauccaaagacuacagacagauggccaguaaacacaugaaaagauguucgggcugggcacaguggcucacaccuguaaucccagcacuuugggaggccaagguggguggaucacuugaggucaggagcucgagaccagccuggccaacauggccaaaccccaucucuacuaaaauuacagaaauuagccaggcauguuggcauaauuuacaggugugccuguaaucccagcuacuugcgaggugaagcagaagaaucacuaaaacccaggagguagagguuucagugagauaagauggugucacugcacuccagccugggcaacagagagagacccugccacacacacaaaaaaaauguucagccaggagugauggcucacaccuguaaucccaacauguugggaagccaaggugggaggaucacuugaggccaggacagccuaggcaacauagcaagacccuaucucuacaaaaaaaaaauuaggcaaggcagugcacagcuguaguccuagugacucaggagacugaggcaggagaaacaccugagcccaggagacacaggcugcagccaguuaugaucgcaacacugcacucucaugugggcaacagggcgagacccugccucuuaaaaaauaaaaacgcuacaagauaucacuucacuccuauuaagacaacuaaaaccaagaagacagauaauaacaaauguugacaagaaauauaaacgcucauaaacugcuaagauuguaaaaugggacugccacuuuggaaaacaguguagcaguuccucaaaagauuaaacauuaagugaccauaugacucagcaauucuacucucagguauauacccaauagaauuagaaauauaugugcaggccaggcgcaguggcucacgccuguaaucccagcacuuugggaggccaaggcgggcggaucaugaggucagcagaucgagaccauccuggccaacauagugaaaccccaucucugcuaaaaauacaaaaaaaauagccgggcgugguggcaggcaccuguagucccagcuacuuggaaggcugaagcagaagaauggcaugaacccaggagcuagagcuugcagugagccgagaucacgccacugcacuccagccugggcgacagaccaagacuccgucucaaaaaaaaaaaaaaaauauauauauauauaugugugugugugugugcauacauacaaagacuuacauauaaauguucaacauuauaaccaaaaaauggaaacaacccaaauguucaucaaccaauaaauggauaaaauguaguauuauccacguaaugaaauauuauguggcagccgggcgcgguggcucacaccuguaauccuagcacuuugggaggcugaggcggcagaucaccugaguucgagaccugcccggccaacauggagaaauccuuucccuacuaaaaaauacaaaauuagccaggcuugguggcgcaugccuguaaucccagcuacucaggaggcugaggcaggagaauugcuugaaccugggagguggggguuguggugagccgagaucacgccauugcacuccagccugggcaaaaagaguaaaacgccgucucagaaaaaagaaauauuauuuggcaauaaaaaggaauaaaguacugauucacacuguaaugugaauguuugaaaacauaugcuauaugaagaaguaaucacaaaagaucauauacuguaugauaccacuuauaugaaauguucagaagaggcaaaccuacauugaaaauaaauuacuguuuggcaggggcuguggggggaauggagagucguagcuaaugaacacaagguuucuuucuaggaugauaaaaauguccuaaaauugggauuacagugaugguugcacaauccuguaaauauacuagaaaccacuaaauuguacgcuucaaacagcugacuuuauaguacguaaauuauaucucaauagagcuuuuuuaaaaaauaugcccaauauuauuauuuuaugucuuuuuuuuuuuuuuuuuuuuuuuugagacagagucucacuccguuaccuaggcuggagcucaccgcacccuccaccuccaggguucaagugauucuccugccucagccucccaaguaccugggucuacaggcgcgcaccaccaugccuagcuaauuuuuguauuuuuaguagagacaggguuacacuauguuggccaggcuggucucaaacuccugaccucaugaucugcccaucucggccucucaaaguuuugggauuaaaggcaugagccaccgcgcccggcccgccuguauuucuuagaacacacaugcccccuuaccuugaagccacagcccagccuggcaguccaaaccucucauaguccccuccauaaauaucucguacuaguuuauccacuuuggugcuaucuccacgagaugccauuucaagagcuucuucaaaagugguacagccaguaagaagacagcagagaccaaaaaaaguuccuccuccaagacuaugauuaaaaacaauuaacacaguauuauaacauuuuuaaaaauaagaacaagaaguuaacauuuaugaaccccaaaaccauauucacauauccaacccaaucaugcaaaugccacugguaggaaacaagucugugaaaagauaaggugccugauauacaccuuuaagguacauaugcaugugagccaacaugcaaaguacaaaacacagggcccauguccccagugcagucuggcugucugccaaguaugaagagccucaggugcaaauuagccugacacgccuggggccaugcuaacaccuccucccuuucccuucuccaaguacauucccugagucauucucauccaagcaccuugucacccuggcuuaucaguacacccccaaacauacuccuccugcaacguguuuugucacaaaaaaauuacuccucuauuuaaaucacaacuguuuuuuuaaaaaaauuguuuaucccaaucccuagaugccuguuuuuccugaagugaccucugacccuuaagccgaaacauucucuucuuccaucuaauccucauuuuuuuuuuuugagauggaguuuagcucuuuuugcccaggcuagaguacaauggcacgaucucggcucaccgcaaccuuugccuccugguucaagugauuuuucugccucagccucccaaguauaugggauuacaggcaugugccaccacgcccggcuaauuuuguauuuuuaguagagaugggguuucuccauguuggccaggcuggucucgaacucccgaccucuggugauccacccgccucggccucccaaagugcugggauuacaggcauaagcugccgugccuggcccuaauacucucuuuucuuuuuuuuuugagacggagucucacucugucacccaggcuggagugcaguggcauaaucucggcuuacugcaaccuccacccucugaauucaagcaauucucccaccucagccucccgaguagcugggauucacaggcgccugccacugcgcccggcuaauuuuuguauuuuuaguagagaugggguuucaccauguuggccaggcuggucuugaacuccugaccucaugauccacccgccccagccucccaaagugcugggauuacaggcaugagccaccacgcccggcuaauccucucuuuucauacuaccuucccucaauaauuuuucuacugaucaguacauaucaacuucuaaaucacauacauagaauacaucauuauucuacacacacauguguguggaagcaugaaauuuacacagguuucagagcuagguccuuucccgugccuucuccuuacagaugcugccuaauaacuuuagcuacuuuguguaugcacaccauaaacuaucugagggcaaaggcuacaaugagucugcugaugugaucuuuuaagaaacaccuaggauaauaaaucuugaacaguagagauuaaagaaaacuaggucauaaaaucagaauuuucaaagagaaacauuuguuugcauaauccagaaacacuuucaccuaacagguucuugaagguguaguuacauguaauaccugaaaacucagcccguuaggauacuaagaauaaacagugaguuuuauauacaacuuaccuaguaccugugacccguuuguaauuaucuuuggaauauacugcuaagaugcuaaccccugagccaauguucaccagaagcagaggauacggauuuuucaaaucaaaugguaacuucugacacuuuucagaaucagcaggguuuucaaaguaauagcacugugaccguccauugaauccgacugagucaauguauaaaauuccuuugaucaagcaaucuaguucauccaguuugcaaagcugaagaucaccuaucuguaaugaaauaagaauguacucagacuuuuuaauaagccaacagaaacaaaaauuccauucaauaaggcauccccacuacgugaaacaaccaugaaagugcacucacagauguguauuauuugugcaugcuuuacagaacagauuuaggagcaaaccuagggacacagugcugagacagacuccugcuacuacagacccaaauacacucuacauagaaacuacugcagcagcugaauaagugugaccaaaaaaaaaacaaaaaaaacaaaaaaaaaaaaccacagcauuuaucaaccuucaaacagaaauucagaucucugcuuacagggacaauggggcugauaccaagcucaggccacagcacuaucagaaaccaccuugugacacagggugggagccacaaggacugugacagaggaccaucucaaggcuuuggagcaguaucaaaagaggccacacauuauuuaacaaacugaagccaaaaggcugaaaguauccaguuagaagguaagauuuuuuucacuaucuaaacuagcuacagccucuugggagggaggggaauuuuagcagucaaaauuugaacuguuucauaaucaauuaauuccauuuaaauaauaaaggaaugacuaaauuauuauucguauuauggagcacuguauagcaacuaaaaaugaagaggaucggccgggcacgguggcucacgccuauaaucccagcacuuugggaggcugagacagguggaucacaaggucaggaguucaagaucagccuggccaacauggugaaacccagucucuacuaaagauaaaaaaaaaaauuagcuggguaugguggugcacgccuguaaacccagcuacucgggaggcugaggcaggagaaucucuugaacccaggaggcagagguugcagugagcugagauggcaccacugcacuccaaccuaggugacagggcgagacuccgucucaaaacaaaacaaaaaugaagaggaucuuuauguucugaagugggaagaacuccaaggcauguuagucaaaaaguugaggccaggaacgguggcucacaccuguaauuccaacacuuugggaggccgaggcaggcagaucacuugaggucagguguuccagaccagccuggacaacauggugaaaccccaucucuacuaaaagacaugcagaauaacaggcagaaucugggccgggcaaggugacucaccccuguaaucccagcacuuugggaggcugaagcaggcagaucaccugagaucaggaguucgagaccagccugaccaacauggagaaacccugucucuacuaaaaauacaaaauuagccgggcgugguggcacaugccuguaaucccagcuacuugggaggcugaagcaggagaaucgcuugaacccgagagguggagguuguguugagccauugcauuccagccugggaacaagaacaaaacuccaucucaagaaaacaaaacaaaacaaaaaggcagaaucucuuucagacuaauauucucucauuuagcaacagaaaaacagucagucacugaagacauuuucaaucuguauugcacccugacggucaggaucuuggcuuauucauuugucaguucuccggccuacccccaccauccacccugaaaggaccuagccucaaggucuugcucacaauguucuccaguguucacucaaugaaagcaagauagagcgccuggcagcauuccccaggggccagacaugguggcgagacuccaguuaagugugcagcacagaacacaucagaaagcauucugggagaggagggcucugcagucacccaucucagaccagcccugagccugaaaacaccacuuuugaccagaguuccuuauuuuuuucaguuagugaacaugccagcaaacaacugagggagacaagagaaauuaugugguagacaagacugaaaacaauuuuaugacaugaaaugauuuuaauuauauuucaaucucauuguucaugaucuaaugauguuccuuuuagguaguuucuuccucaacguauagcagaugcccuaauuuuucauacuaaaggagcaauaaaaugcuacccuuuuagugguucugauugucguccauacaucugaacuagacaaccaccucuagauggccaacuccuaucacuagcguaccuuuaaucuucauuugacucaagaaaauucaaguuccauuagagauggaaauuauuucaccacuugcuacuggcauuauuuuuaacaaucaaauuaccauaaauuguauauaagcuaaaaaaugcauacugugagaaaauccugcucaaauuuguacgcuccaccuccaguggcacaaaagacaguguggagacucgagaaguuuuuaucucugcccauuugaauaaaagcaggcaugucaugagugggaaagcguauaaagugcagauugccuuugcguccacacagagucagguccuucagcucgaggugcacgucccgaaugccuguagacccauaagccacauuggaggucagguacuuccgaaugcuuuuaagacuuuccacuucuuccucuucuucuucagcagugaugucuuuggguucaaaauauaccagcuugaccagaguuccaccgauauccaguccaaaccauggaaaaacuaaauggggaagaaaaauaagucagaacagcuuuuuucugaaaauuaaauuuacccuuaccacaguagcaacuuauuucaaacgcuaggguuuccaaagaacauaauucuaggcaaaaggguuuuggggcaaagaaaugugauucugucuugauuuagaugcauaacuuaaaaaaaaaauacuacggcaaagacgaaaaagaaaaauaucaaaguauugagccaacccaaccauucugucagacaagcgcaaaccgcacuaugaaguguuuuaaaaauaacaagaugacuacucguaagccucaacugugaaaaacaaagauucagaaugaaaaucucucuuuccuaucggcuuaaaaaaaaacauugagacuucagaguucugguuuagcagcaaacuagaaacaggaaauucccaaaccuauguaacauauaaccuccaauggucaauuuaucuuucaaaaucugauauuccaaaaauaaaagguuucaauagacauuaacaccgguucccaaaauguccuuuaggccaagcgcaguggcucacaccuguaauuucaacacuuugggaggccaagguggguggaucaccugaggucagaaguuugagaccagccugaccaauaugguaaaaccccaucucuacuaaaacaaaaauuagccaggcauggugacgugcaccuguaguaccagcuacucaggaaaucuaaaccagaacugcuucaaccugggagguggagacugcagugagcugagaucacaccacugcacuccagccugggcgacagagugaggcucugucucaaaaaaaaaaaaaaaaaaaaaaggcagggcugggcacgguggcucacgccuguaaucccaacacuuggggaggcuaaggcaggugaaucacaaggucaagagaccaagaucauccuggccaacauggugaaacuaucucuacuaaaaauacagaaaucagcuggcugugguggcgugcgcuuguagucccagcuacuccggaggcugaggcaggagaaucgcuugaacccaugaggcagaagcugcagugagccaagaucgcaccacugcacucuagccuggcgacagagugacacuccgucucaaagaaaaaaaaggccugaagagauuggaucaaaguggacugcacagacauauggaaggucccaauuuaaugagggcucaaaguaaugauuuuucaaauuuacaauggugcaauaagcauucaguagaaacucuacuucaaguauuuauuguuuuuuuuauuuuuaguacaguauucaauaaauuacaagauauucgacauuuuauuguaaaauaauuaucuuuuauauuauucauuauuaaaucaucuagcuuuaugcuagaagauuuugcccaacuguaggcuaauauaaggguucuaagcacauuuaagguagguuuggcuaagcuaugauguucaauaggcuggguauauuaaaugcauuuugacuuacaguauuuucuuuuucucuuuuuugagguaaggucucacugucacccaggcuagaaugcaacgccacaaucucagcucacugcaaccucugccuccugggcucaaguaauccuccuaucucagccuccugagcagcugggacuaaaggugcaugccaccacacccaccuaauuuuuguauuuuuuguagaaacaggguuuccccauguugccaggcuggucuugaacuccugggcucaagcaguccacccaggucagccucccaaagugcugggauuacaagugugaaccacugcgcccagccugauuuacaguauuuugaacuucugauggguuuauggaauguagcauaaacaucguaagucaaaaagcaucuguacaugcuuccccucccaaucuaaaucguagaaauuacuaaagauguggguuuaggccgggcacgguggcucacaccuguaaucccagcacuuugggaggaugaggagggcagaucaccugaggucaggaguucaagaccagccuggccaacauggugaaacccccaucucuacuaaaaauacaaaauuagccgggcgugguggcgggcaccuguaaucauagcuacucaggaggcugaggcaggagaauugcuugaacccgggagguggagguuucagugagccaagacagcacuacugcacuacagccugggugacagagcaaaacuccaccucaaaaaaaaaaaaaaaaggguguggguuuauugauauauuugauauauuauuuucuaaaauaauucugggaaacaagaagagauagcaggccgggugugguggcucacgccuguaaucccagcacuuugggaggccgaggcgggaggaucaugaggucaggagaucgagaccauccuggcuaacaaggugaaaccccaucucuacuaaaaauacaaaaaaauuagccgggcgugguggcgggcgccuguagucccagcuacucagcaggcugaggcaggagaauggcaugaacccgggaggcggagcagugagcggagaucaugccacugcacuccagccuaggugacagagcgagacuccgucucaaaaaaaaaaaaaaaaaagagauagcagcagcagaacuagguuuacagaggcaauaaccaugcauaagccucaaaagaggaaugcuauuaaaacugggaucagcuaugaaggugagagagagaacguagggguauucuauccaagccguagguucagggcggcuaccauggggaaacaaaagcaggucuggugcaguggugcagucacaagcgaugguggggaaauguguuuggcacaaguggacaggccacucccucuaccaauaaccauguucuauccccaacacugacagaagcaaagucuucacuggaaacaggcacuggagccccagaaucaggauggcacucagguggcugcuauuacccagaagaaauaaggagacauuuuaccccauauuuugccacguaucucauaccuccccuaaaaucaauccugaccaacugguaaacagacacugaauccacuggcagaagaacaggaauucucaaaccagagauuaucacuuuuacaaacuagaaaaacuacaagggaaauaaacacuacaaaaaugagaaacuaaauaucugaagaaagaguugcaggaauaaacagaaucaaaaauauucucagagguaaaaucauaacucauccauaaaaaaagcuaccauagagaaaaaucaaaaauuaaaaaacgauugccagauguguguggcugcaaaaauuaacacgauaaaauuauauacaacuaaauaaacaacguacaaaagaauccaugcaaaacuguuucuauuuauuuuucaccuuuuauuuuuauuuuuagagacagcguguugcucuguuucccaggcuggagugcaaucacaacucaaucacaacugacuguaaccuugaacuccugggcucaagcaauccuccugccucaucaucccaaguaacuacgacuacaggaacacaaccaugccagcuauuuuggagagacaaggucucacuguguuguccaggcuggucuccaacuccuggccuccagcaauccucccacuuuggccucccaaagugcugggauuacaggccugagucaucaugcccagccaaaauuggcaaaauuuaaauacaguuuguccauguuaauuuccuaauugugggaaagaaugcucugaaaaccaaaaaaaagggacaaacuacuacauauuuaauauucaugaaucucaaaaauagggugaguaaaagaaaccuugcacaaaaggcuacauacuauauuauuccauuuauaugaaacuuuugaaaaugcaaacuggccgggcacaguggcucaagaauguaaucccagcacuuugggaggccaaggcaggcagaucaccugaggucaggaguucaagagcagccugaccaauauggugaaaucauauuguacuaaaguauguacguauguacuaaacauauguacuaaaaauacaaaauauuaggcugggcgcaguggcucacgccuguaaucccaacacuuugggaggcugaagcggccggaucacaaggucaggaguucgagaucagccugaccaauauggugaaaccacgucucuacuaaaaauaaaaaaaauuagccgggcgugguggcacaugccucuaaucccagcuacuaagaaagcugaggcagcagaaucgcuugaucccaggagauggaggcugcagugagccgagaucacaccacugcacuccagccugggcaacggagugagacuccaucucaaaaaaaaaaaaaauuagcugggcgugguggaacgcgcugaaaucccagcuacuugggaggcugaggcaggagaaucacuugaaccaggaggcagagguuacaguuagccgagaucaugccauugcacuccagccugggcaacaagagcaaaacucagucucaaaaaaaaaaaaaaaaaggaaaagaagaaaaaaaaaagccgggcgucguggcucaugccuguaauuccagcacuuugggaggcuaaggcgggcggaucaccugaggucaggaauucaagaccagacuagccaacauggcaaaaccucguuucuacuaaaaauacaaaaauuagcccgguguggcagugcaugccuguaaucccagcuacucgggaggcugaagcaggagaaucacuugaacccaggaggaggaguaaauuucaaugagccaagauugcaccacuguacuccagccugggcgacagagggagacuccgucucaaaaagggggaaaaaaaaaaaaaaggcaagcuaaucauuuuuacaucugaaagcaagcaaaucaugggcuugagagcugggguuggacugcacaggaggagggaaaaacucugguaacccaacucuuguuuggggguaaaaggggugugugugugugugugugugugugugugugugugugugugugugucuauacacaucugucgaaacucauggaacuguauauuuuaaauggaugcaguuuauuguauguaaauuacaacauuaaagacgcuguuauaaaagagaaaaaacaauugcuaaaauaaaacuugacagauauauuuaacagcaaaaugggcacagaaaaaacaaauagaaaacaaaauuaaaagauuauccccaaaugcuuuucaaguaugaaagaaaggucaauauagucaauauagagaaaauggaaccuggcugggugcagugacucacaccuguaauccuagcauuuugggaggccgagaugggaggaucacuugaagccaggaguccaagaucagccaggacaacacagccagaccccaucucuacuuuaaaagaaaaaaaaaaaacuaggccaggugcgguggcucaugcuuguaauccuagcacuuuaggaggccgagguggguggaucgcuugaggucaggaguucgagaccagccaggccaacaugaugaaaccccaccucuacuaaaaauacaaaaauuggcuggaaaucgcuugaaccugggagguggaagucgcagugagccaagauugucccacuguacuacagucuggccacagagugagauuccgucucaaaaauaaaaaauaaauaaaaaauuagccaggcgcacaccuguagucacagcuacuugagaggcugaagugagaggauagcuugagcccaggaggucaaggucguagcaagcuaugaccaugccaccgcacuccagccuggguaacagacugagacucugucucuaacuaaaaaaaaaaaaaaaagagagagggagagaauauagaaccagaaggaccaacaucuuauguuaguuccagaaauuuccuuggggaaagggaagacaccaaucaucagguuacucuaagggcugaacaguguuuaucggucagcagagaaggggaagacaacuuagacacauccuauugaaauuucaagauaucauaaggaaaaaacugaauuccuauaaagauacauaaaucacauaaaagucaguaucagacuuuucaucagcagcacagaugccagaagacaacggagcacuggcuucaaaguuauaaggaaaaugauuuugaaacuuauauccagccaaccaaauaagcuuucaagcgggagugcaaaaacaauuuucacauauguaagggaucaacuuuacuuuucaaagaccuucucuaacauaauugguagaugaaugccauaauuuuaaaacauccaagagcuuuaagaaacuuuuuuuuaauccaagagcuuuaagaaauaaacaaaaguacugacuuuuacaaaaauaagcaaucugaaacuaaaauacuuacaugauuucgacauaggaaguugaagagggaagagaagggagaaggaaaugaaagcaagcagcaguucugucuuguuggaaaagggaagaaaagauagauucugauuaauucuacacaagaauauagaagugauaguuuaaaugugucaaaauuuagagguaacuccagaggagaaaaaaaaaaugacuuucacauuagaaaaaaaauaaagcaaucaguucaaaaaagcugauugacaagaaauggggaaaaguacaguaaauacaaaacagccaggugugguggcucaugccuguaauuccaacacuuugagaggccaagguggguggaucacuugaggccaggaguugggagaccagccuggacaacacagcaagaccacaucucuaaaaaaaaauuuagguaugaucacgugcaccuguagucccagcuacuccaggggcugaggcaggaagaucgcuugagcccaagaguuugaggcuagugagcugugauacagccacuguacuccagccuggcagcagagcaagauccuaccucuuaaauaaauaaauaaauaaauaauaaagccuguaaucccagcacucugggaggccaaggcagguggaucacuugaggucaugaguucgagaccagccuggccaacaucgugaaacccccaucucuacuaaaaauagaaaaauuagccaggugugguggugcacaccuguaaccccagcuacucgguaggcugagacaggagaaucgcuugaacccaggaggcagagguugcagugagccaagaucgcaccacugcauuccagccuaggcgacagagcaagacuucaucucaaaaaaaacuuaaaaauaauuuaauaaauaaauaaaugaugggaaugacugcacuuaucaguaaucacaaauaggucaaauuucucuucuagacugaagaggaaauucugugagcuuaaccaggaauuaggagagaaaaggagaaauucaaguauauguugauguaaaaagauaccucaaacaagauuauacaaguaaacugaaggaaaaaugguaaaucacccacaauggagucacaccaugaggaggaguugaaugcuuugaaagaugaaaauggcauuuagucaaaaguauuacacauuauaaaaauguuaagcacucuuaagcaccucacuagagaugaauacuagauagagcagcugauuuacauuuaagagccauaguacaguaaaggucauaccuuguuucaagaccaguguuucauuuggcaaagagcuaugcucacauuacaagaggugccccuccagacaaucacgccccuuccuuucccuacaggggaaaggagagucaccauucucaucccuauacucacucauaaucauauaguuacugacggaaacacuggguagaaucgcuggcaccauucacuuaacucacuugcugaauuuauacacuugaauuuaaaugacuaaaauaaaugccuggagaaugcuacuccacuguaucaagcaaauguuaacagcaagcagauacaauacuagcagaccaaacaacacaaacaaaaaagcauuaagaagggacaaaaaaaaaacucucucaugugcauaaaaaguacaacugaugggccaggcacaguggcucacgccuguaaucccagcacauugggaggccgaggcaggcggaucacgaggucaggagaucgagaccauccugugaauggugaaaccccgucucuacuaaaaauacaaaacauuagccgggcaugguggcaggugccuguggucccagcuacuugggaggcugaggcaggagaauggugugaagccgggaggcggagcuugcagugagccaagaucgcagcacugcauuccagccugggcaacagagcgagacuccaucucaaaaaaaaaaaaaaaaaaaaaaguacaacugaugaauguaauagccauguuccuuaugcacauaacacauacuucgaaaacacuaacagagaaacugacacaucuacaagucaguaugagaaugacacagaccucaggaauuuguagauugcacacacaccuacaaaauuaugguagaaagagaauuuuaauaucauggcuaauaagguggaucuaguaaacacaaauagaacucuggggaaaaaaaaaaaaaacagccggauguaauggcucacaucuguaaucccagcacucugggaggccaagauggguggaccaccagagguuaggaguucgagaccagccugacuaacauggugaagccccgucuccaauaaauacaaaaaauuagccgggcaugguggcacaugccuguaaucccagcuacuugggagccugagguagcagaaucacuugaacccaggagguggagguugcagugagccuacacuacaucacugcacuccagccuggaugacagagcgagacuccaucucaaaaaaaaaaaaacccggcugggcacgguggcucacgccuguaaucccagcacuuugggaggccgaggcagguggaucacggggucaggaguuugagaccagccuggccaagauggugaaaccccgucucuacuaaaaauauaaaaaauuagccaggugcaguggugggcaccuguaauuccagcuacucgggaggcuaaggcaggagaaucacuugaacccgggaggcagagggugcagugagccgaggucgcaccacugcacuccagccuagacaacagcaagucuguuucccaaaacaaacaaacaaaaaaaaacacucaagaccagcaagacuguuucccaaaacaaacaaaaccaugcaaacauuccuuuaaaaacccauaaagcacucacaaaaauuaacugcacuagcuuaaagaacuucaaauuccaaagaacaagucacauucacuuacugcaaaacuucaaaauuagaaauuaauccaacaaacaaagaaauaaaucuaucuacuuugaaauuuuuaaacuauuaacucugggauuaaaaaggaaaucaaaacaaaauuuauuuuuaaaugaaugacagugagaauacaauauauagaaaccaauaggauauacccaaaguaguacuuaaacggaaacaucuagccuuacauauuuauuaaauauacucagcaagaaagccuaagggcgaggcagcucaugccuauaaucccagcauuuugggaggccgaggcgaguggaugaccugaggucaggaguucgagaccagucuggccgacaugguaaaaccccaucucuacuaaaaauacaaaaauuagucaggcaugguggugggcgccuguaaucccagauaaucaggaggcugaggcaggagaauugcuugaacccgggaggcagagacugcaguuagccaagaucgugccacugcacucuagccugggugacagaaagacuccaucucaaaauaaauaaauaauaaaauaaaaaauggaaucuaguuguacaguaaaauuaauaggccauagccaaaagagauucuucucaguaaugcagcaauggcuuuuacauuagaaauuccaauuaguaagaugaagggaaaaaaaucaugauuaucucaacagauuccaaaaaacaaaauccaauauaaccaauuaaaaccaagagguuuuuuuuuuugagauggagucucgcucuguugcucagauggagugcagcgacagaccucagcucacugcaaccuccgccucccaguuguucaagcgauucuccugccucagccucccgaguagcugggauuacaggcucguaccaccaugcccagcuaguuuucauauuuuuaguagagacaguuucaccauguugaccaagcuggucuugaacucguaaccucaacuaauucgcccaccucggccucccaaagugcuaggauuauaggcgugagccacugcacccagguuuuguuuucguuuuuguuuuuuugagagacacagucucacucugucauccaggcuagaguacagugguacaaucaccagguucaggcucacugcagccucaaccucccuggcucaagugauccucccaccucagccucccaaguagcuggacuacaggugcaggccaccacaaccagcuaauuuuuuguagagacgagguuucaccauguugcccggacuggucucaaacuccuaagcucaagcgauccacccgccucagccucccaaaguacugagauuacagacgugagcuaacacauccagccuagagcucacugauaagagaaggccccugccuucuaguuagugaguccuggccauuaauuuucagauauuucagucuauucacagcccuuaacauauuuccugauauuaagaccuccaagguacucagucuagacaaccuauacuugacuuaggccacauuucaaaacguaugcaaagcacaaggucccauaauaggucucaacgacugaaauccuuuaagaguguggaaaaacaaaguuuuuccucugcucucacaccacagcaacgaucaacacagaagacuucugugagcccacacacaaagcaaguaaccaauucugcagcacucaccagcugggugcccuccaaugcaauuccaacgacuauguaccuggagauagcaucauaugccacaggucgagggcuaagucccucaagacugcuccuccaccacaccucugccagacaccaguugccaaucugggccuccagaacuucugaucaacuggcuucaaguuggaguuugcaugaccccucuuugguuuggauuaauuugcuagacuggaucacagaaccuaagaaacacauuuacugguuuauuauaaagauauuucaaaagauucagaggaagagacgcauaguacacaguauaggggagggacacggaacuucugugcucucgggcacugcacccuccuggaaccucuuguuuggccauccagaagcucuccaaacccuguccuccuggguuuuuaauggaggcuucauuaguagguauaauugauuaaaucacuguccacuggugaucaacuuaaccuucaagcccccaccccuccccagaggcuggagaggagugaaagucccaacccucuaauccugucuuguucuuuccaugacuaaguccagaggcuuccagccaucaguuaacuccuuagcacacaaaaggacaucacuguggaguuucuaaggauuucaggaguuguaugccaggaaaugggcaaaagaccaauauauauauuucacaacaucacacuuuccaaugggaaauacauaguucaguaggcugggcaugguggcucacgcuuguaaucccagcacuucgggaggccaaggcaggcggaucacgaggucaggagauagagaccauccuggcuaacauggugaaaccccgucucuacuaaaaauacaaaaaaaaaaaaaaaaaaaaaauuagccaggcgugguggcgggcaccuguagucccagcuacucaggaggcugagccaagagaaagggcaugaacccaggagaaggagcuugcagugagccaagaucgcaccacugcacuccagccugggcgacagagcaagacuccgucucaaaaaaaaaaaaagaaacacacaguuuacuuuuaaaagugugcucaauuuuccaauauuaugaacuacacuuuuaccagaccacagaugguuaaugacaucgcaaauccaugucuaggcuguucuaggaaagcaauaucuuggccuaacauugaaagagguacuuuaauaauuauucuuauucccaaaauaguuuuaaacucagggacuagauacuuauaaaagaccacauaccguaaaaucagcaaauucaacaacaaauucuacauucaggaaauauaaacacacaaaauguaacgaacuacuaaaaaacugagauggguuucauuuuuagaaagcaaacuuuaagccgcaauuuagaaaaguuuucacaucccagucagucuuaccugaacagugccugaagauaccccaaauuaugaaccugagaaaagcucacaaggcuacaaacuuuaaguccaaaaaacaucaccgcucuuuuaaauaaucaaaauagccauucuuuucauugccugaugcucuacaauagccuagucuaucuuccuccuccuauuuuuugaaauguuuugagaaaaaaaaaaagaaaaaaaaaaaaacggagacagggucucccucugucgcccaggcucgagugcaguggcaugaucauagcucagugcaaccucaaucuuccgggcucaagcaauccuccgggcucaagcaauccuccugucucagccucccaaguagcugggacuacgaccaugugccacgacauucugcuaauuuguuuauuauuauuuauuuauuuauuuauuuauuuuauuugagauggagucucgcccugucucccaggcuggagugcaguggcgcaaucucggcucacugcaacuuccaccuccuggguucgagugauucuccugccucagcguccugaguagcugggauuacaggugugagccaccaugcaugcccuuuuuauuuuuggagagacgaggucuggcuauguugcccaagcuggucuugaacucguggucucaagugaucuucccaccucagccuccuacagugcuaggauuacagaaaugagccagcauacacagucagcaaaauauuuuuaacaacauacaucucuuccugcuauggucuccccagauagaaggcagggacaccaacacuaaacaaccauauuauccaacugcaugauucuuacacauggccccuaaaguaauauacuguaccauuuuacacagcugcauaaggggacgauuuuuagucccugcuuauugcuuaguauuuauuauauaucuaagaagacaggcuguauuuacuuugguuccacuuaaaguugauaaacuggccaggcacgguggcacacaccuguagucccagcuacucaggaggcugaggcaggagaaucacuugaaccugggagacagagguugcagugagccaaaauccugccacugcacuccagccugggcgacagaguaagacuucgucucaauaaauaaauaaauaaauaaaaaguugauaaaucaauagguuaaaaaacaccuucaggccaggugcgguggcucacaccuguaaucccagcacuuugggaggcugaggugggcagaucaccggagguccagagcucaagaccagccugaccaacauggagaaaccuugucucuacuaaaaauacaaaauuagccaggcgugguagcgcaugccuguaaucccagcuauucgggaggcuaaggcaggagaaucacuugaaccugggagguggagguuguggugagccgagaucacgccauugcacuccagccugggcaacaagagugaaacugucucaaaaacaaacaaacaaacaacaucuuuucggucaggcacgguggcucacaccuguaaucccagcacuuugggaggcugaggcaaauggaucaccugaggucaggagcucaagaccagccugaccaacauggugaaaucccaucucuacuaaacacaaaaaauuaguuggccauggugguacaugccuguaaucccagcuacuugcgagucugaggcaggagaauugcuugaacccaggaagcagagguugcagugagccaagauugcaccacugcacucuggccugggcaacaagagugaaacuccucuaaaaaaaaaaaaaaaaaaacaaaaaacaaacaaaaaaaaaacucccaucuugccucucccaaugggccacaaagcuauagcaaucuaacauuuuuccucagcucccaggggucaauccguccuaauucccugaagcugaaaugcugagccuaauaaaggcagccuaacagggccccggcuccaguuccauacugccaacagcaacgcuccucggaaagccaagaaaaaaugauccauuuucuaggcuaguguugucaagcuacaaacaaaaacuguauuaugaagguuagauuuguaggaguccaaaaucaacaagccccaaaggucucccuggcaugcuacaacaugccuugcgagucaucuucaaaggauaaguuuguuguccacacuacuguggagcacucugaucacagggcuuccacaccuucugcacaccugcugcacauaugcucaacaccuggagcccuugauaaaaauguauguucucuuguuacaugagugucuacauuugccaaaauuguacauuuuacucuauuuaauuaugccucaauaaaauuuaaaauauaauuuuagaccccuuugcagaccuauaucaugcaaugguagguugagggaaaguuuuaaaaacuugagaaccacagcucuggauuacaucacacauaccuucccccaccccaaaauguggaccaagaacacuggaucugaagucaagacaccaggaaucaaaacccaacuccaucacuaacucacuauauggccuuggacaaaaggacaauuucacugagccuguuuucucaucuggaaauuggggauaaaaaacaccuaccucacaggauagcuaugagacuuaaccaagaugcuuauaaaauacucggcauaguguccaagacaaauaagcacucagaaaaugguagcuacauuaccaucauuagcgucuugguuuccaucauuuuaaaaucaaucuuuauuugguauuucuuucagcccugcgagacauaccccccuccccaccugaugcaaaacuuuugaagaacuuaaauauacacaugccuagccucaucgcuagggauucugaugcaguaagucugggacaagggccgguuugggaacuacacugcucuaggaaacgcgugacagaacacgacuacaaccaggaccacaagaaugccuaagauaaccugaauagcuccuucgacuuucaaaugacaacuaguaucuaucugcaccuuuagacaaguagugcgguaucagaguaaggcuuuuuuuuuuuuuuuuuugagacagagucgcucugucgcccaggcuggagugcaguggcgcgaucuucgaucacugcaaccucugccucccggguucaagcaauuaucugccucagccucccgaguagcugcgacuacgggcacgcgucaccacacccggcuaauuuuuuuguauuuuuaguagagauaggguuucaccagaaagguggcaccauuccauacccaaaccucccaacaauaaauaaaaaagauuuagucuuaguugaauucucucagagauaagacugaaguauacucuaggaggguucggcagucaacaagcugcuucuccuuuuuuuuuguuuuuuuuuugaggagucucacuguaucauacaggcugcagugcacuggcacaauuucggcucacugcaaccuccaccucccagguucaaauguuucucccaccucagccuccugaguagcugggauuacaggcaugcaccaccacgcccagcuaauuuuuguauuuuuuaguagagacgggguuucaacaugcuggccaggcuggucucuggucucgaacuccugaccucaggugauccacccgccuuggccucccaaagugcugggauuacaggcaugagccacugcgcccagccugcuucuccaccuaacaggggcaccccuagauaguacagaagaaacaaauggaaggaagaacaaucaguauccuguucauuccuuuagcaggucuuauacuggaaagauggguuuucaugauuuaucagccagagaagauaaugaagggaaucacgacaaacaucaaacaucaaaacaaaauauaaauccuauagcaugaauaugugucuacuuaguucccuaaaauaaguuucaaaacuaccuuaauauaauucuccccacccaguguaaaccgguuuuucugaguguggucuuugagucaccuguauuugaauaugaggagcuuaacugggcccacugaaucugcacuuuuaccaggucauucucaugcucaauauuuggaaguacuuccacaguaucuaaaaauuuucgccucaaguaagucagucuugaacacaaaagaucaaacuuaugcuuggucuuagagcaaugaagaaauaacuaacagaacguaaauaauucagaaaaacacagugguccaccgcaaaagcuaugaagcuagcaauucugaguuuacauuucuauuucacaacgcacuagccauuugaccgggcaaacgugucccaguuuucucaucuguaaaauggaauacuaccaccuaccucagagccacgaggcuaaugaguuaccaaagcucuuaguagacgacugccaggucgggcacaauggcucccgucuauaucccagcacuuugggaggccgaagugggaagaucgcuugagaccaggaggaauucaagaccagccugggcaacauaagagaucccaucucuauuuaaaaaaauaaaaauugaaaaauuagccuggcauaguggcacgugccuuuagucccagcaaugcaggagguugaagcaggaggauggcuugagcccaggagguuaaggccacaaugagccaugaucaugccacugcacuucagccugggcaacagaacaagacgcugucucaaaguaaaaaacaaaaaacaaaccaaaaaaacccuuguggcuaauggcuauacucuuauuugcugaaucuuuggaauuuacauccauuuccaacgauguaauacaaaaccaugaaggaucucauauuuugcauugcuucaaacucaggugcuucucaaauaaaacaaaacuaggugacugacucugaaaauggcacagguuaagaaucuguuuuccaaaucuguugcaagaagauggaaaaagacaaaagaacugaaaacucccaaacuuuucacagcaaaauagaacuacauuuaaucauccauaucagagaagauucaaaaaagcaguugggugacugggcuaagguagaagacuauucaauaaaaaucucacaucuugccauuuucccucccucucacaaucugcauuuaaacaagucaauuuccugaaauaggaaucuggcaacacccaccaaaaaguccaaccauauguaaaauggcaucacacuguaaagcucauauuacaguaucaggacaauugauacuuucaacagcagcaauggcugccaggcagcgguccugaauugaagacuuguaaaggggagaaaauacacaacacagaaaaagaaaccuaauaaaauggggaaacggauucucugggaggagcguaugcaacucccaaggcaaaauucagaaagauguuguuuccccucaaaacaaagagccuuaaugcccagaaugccacaguucugaaucgugaguaccugcaaauagacagaaggaaaacggaggggauaugugggugagagaugaccuggauucucacgagaagaagggcagccaccuuagaggugcacggaauacaguuucaggccuggugcaacucaaggggcaguucaccauuuuccaguaagcccgaaauugacgaauaaaagggacuuaaaguauuagagagcagcucuuuggaaacccacggaaaacaaacauuggggauucaaaggauuugggaggaaaggagguggaaaugagucaaaagaagccuucucgaggauaaaaucaugugacccucaggaagagaaugcccaaggagcuaagaaaagggaggacagguccuggggaaaagcccuccacuccaacaagcgggaagugcauaccaaugggugcgggggggcccccgaagguaccgcuuucggagcacccgaggccuccagccggaugucaggccacgcaccaacgagggaccaccgugcggggacaguguccgcgcgcgggaaaaacggcggcggggccggaaggggacagggugggccggaagggggggcagggcgggccgggagggcgccccacggaacacuuacgcggccgcuuuuuccucaggcuuucgacgcgcuggcgggagaccgagguggggccgcuguaagagcccagucgaucccgccucgugcccucagccgaggccccgaccgcgggcaccgacgcgcugcucgcccggcgccgcaguggcuccugccgccgcccuucgggguccccggccgccugcuccccagccgacgagacggagguggcggaagcccugccguggcgcuccaugggcgcgccgagccggcccccucccauccgcagcagcagucgcugccgcccgagcaagccccccagcgucggauuccuucucgccuccuccgcggcaguccagccagagcagaggcgcgcccucggccggccgccucuuccguugcgccaacgcgcaggaagccaauccgacgaggcuggggacggcccaaaggccucgcguccagucggcucccuaacucgaggaggauugaccgugccuccguccaaugagaggcuaucgugacggggcggggagagggugguggaggaggggauccggguuccgcggaggaagagaaggcgguguagcccagaagagagugauggcggcgccgcccaauggacgcguggguggaagggcccgagccuccucauccacccccuccuuccgccccccacuugugcaugccucugcccccccgggccgcggaacucuccuggggcgaccccgagucccaccccgcugcuccgugccguccucgcagcucgagcccuccuccagcccagcagugcucccgcagcgucuggccgcuggucgucggcagacgaaagggcuugaaccgcggcugaccuuagccuuugucccucggccuaguuccgcagcugccgucgaggccgccagccccucccccagcau

SEQ ID NO: 191243 - RNA, 15438 nt, Homo sapiens
auuaaagaugauuuuuacagucaaugagccacgucagggagcgauggcacccgcaggcgguaucaacugaugcaaguguucaagcgaaucucaacucguuuuuuccggugacucauucccggcccugcuuggcagcgcugcacccuuuaacuuaaaccucggccggccgcccgccgggggcacagagugugcgccgggccgcgcggcaauugguccccgcgccgaccuccgcccgcgagcgccgccgcuucccuuccccgccccgcgucccucccccucggccccgcgcgucgccuguccuccgagccagucgcugacagccgcggcgccgcgagcuucuccucuccucacgaccgaggcagguaaacgcccggggugggaggaacgcgggcgggggcaggggagccgcgggggccgagugaggaccccgggccucgggucccaggcgcaagggugcccggccgggcggggucgggaccccagugaggaggggccgggggcugccccgcgggcgcgugacgcgucucgggccugcccggcugcgcuggucuccgcucgggugaggcggcuuggcuucgcuuuucagguuaggaaagcucccuuuacugcgcguuggggggcugggggagcuggcggagccccguuagggaggucgguggcgccggggugucucagcgcccccugcaccccgcgcggguccggcccagcgggcgaucgcuggcgcccagggaacuccgggagggccgccagcgggcuccgcagggcgcggggcggggaggggcgccugggggccgcggggcucgcgcuccccgcccguuggccgccccucggaggccgagaucggggcccagaacgccccuuggcaaggccuggcgcuuccgcgaugcccagagggugcuuggggggauggagagaggggcgcccgccgggggaguuccgggagccucggugccucccgccgcagcugcagcguuccucccgggaggcggcccagcccuucauccucgccgccugagcuucuccgaggggggcugcagccuugcggccguugccaccgccuggagaagcggcccacgcggacugacgggcgggggcggggccucgggccucggcgggggcgggguccggggaggccccacccucuguucuccaggggcggggagagaggagcugcaggucugcggccuggccccaggugcgauggcggaccccagcuuggccagucacauuccucccagucccccuggagggagaacgcuggccauggggggcuccaaggaacaaccagccucggaugacgacccuugggucaccggucuccccaccugugcggcaggcgccuucacguuucauuauuaaacaauggggagaaauccauguuuacuguccuuuuuaaggaauuuuuugcucuucucuuugagguggcuguaggaaauagauuuuuuuuuuaaccucgcaauuccaccacggucacauccauccucgccaucgcagagccacagcucuccguuuuuguuuccuagccuccagauucucacacaacacagugcaguuucacugcuguaaugaugaggaucuucauggccgcguuauuuucuuguucugagagcaucacgguuuaauuagcaguuccccauaugauuugaaguguuucccguuuccuuagggaaaacuccugguagaauaggauuaaggauuuuuacaaauauaauuaucaaaaacauaggaacagggaauuggauaaauauguuaaacuucuggaaaaaucaacaacgcucuuagauuuguagaagaaaggaaaaaaucaccaguggaaaggagcaauuuuacuuacacaaacacagagaaggucuuacagugaaaaaaagcuaaccaguaaggggaaaagcaggcagagggguaggaugugauuuguauguuauuuauaucuaacacaagucuuccacaccgaaaggaaaauauuaagauuauaauagauaaauggcaaaaugaugagucauuuacacaauaaaaugcaaauuagagcauguuuggguuaucauuuuacaucuauuaaaauaaccaaaauaauuaauaguaacagcaacccuugcuggaagguugcccaaaacuuggcauuuucaagugucuggggagguggcagggcuuuggggucacaaagaugguucugcagucaauuuugugaccuuggacaggcuaccuaauuuccugauccuccuuuuguccauucauagaauggaggaaaugauagcuacuuucugcgucuguauguaugaguuauugggggcauuucgaaccagugacaaacauuuuguuaagcaaucuggugaugcauuaagaagcuggaagcugugacccagaaaccccacuccugagaacuuaccugcaauggaagaaacaaacaaacaaaaacaggcauguauuccuagcagaaugaucuaaaauuagaacaccuggaaaagagccuaaauguauaacaccagggcaguagcuaagaaaauuaugacacauuaacugaaaugaacauuauguaaccacuaaaaaucaugauuuuggagccugugauauguggggaaaaacugacaaguaaaaaaguggguuauuaacugcaccugcuuacucuaacgugaacgcauaugugaaaaaucugaaaggaaaagcacagaaaauggacguuuucauugaaauugucggugaucuuaauuuuccuuuggugaauauauugcucucacuaagggcguuuaaaaaauaguucacagguuuuaauuuuuuagaugaaauggacccacaguuuucuguaagagaaaggagagauuguuauauuugcuacuuagaauaaaagauuuuuagccaacguuguuuccuuuuucaaauauuuuuccauuuuuuuaguugauuaaugauuuaguaauuuguguauuggguuuuuuuaagaaucaguucuuagauucauuuaucaauucuaguuuuuuguuguuguuuuuaaggacuccugaauauuuuucaaaacugaacaauuucagccaugucugagcuuuccgucuuccuggaggcacaaaucuaguuuagcugaaccacaacagauuguacauauccugcagaaccucuguggucuuaggaagguugaaagucaccaaaugucacagaaaaugagggucaggaaaggcugugaucacaagcucuugauccagaggccacucgggugcaucugugugacugacaccucauugcaucaucauuucuuguaaaaucagcuuaauuuugcagagaaauggccacagauuuuuagaauuaugcugaauuauguaagggagcagccauuuuaaaaauaauguaaucaaauaacaauaauaacauaacagaaguuucugcaccacacugacacugaacauggcugucaaccaacuagccaaaccaaggugaaagauucucugaacuucaguuuuaacuuacuucguccauucucccuuuucagaucuuauuucuucuuccaaggcaacuauauccacugugaacugcugcauauuaaacauucaaaacaugucuguaucuaacccagugauggcuacagcauuauaaaauaacuccuaagugaauagugugugcagcaauucucacagcuaggagaauuuuuuuugucgauguguuaaccauuccuuuuucuccaacugcauucuacuuaaacuguuacaguauugugugaucacuuuaagggagguaauccuucagugaaaagcauuauaaauguugaagauuagaccccugaggaccuagcacugaagccugaucacgggugccaauucccugagaagcuuuuauagauucccaaaucccaucgcuaggcacucucugacuggcuugugauggguuccagcaauguuguuuuuuaaaagcuccucagguaauucugaucauggaccagguuggggacccuuugcucuguucaguuugugguuucuaggugccagugagaaaccccuacccccaauuuuugugcaaaauuuuuuucagcuuacaucaaguucuuuaugaaccucagaaaauuaaaauauaacaagggaauuuacuuagcucagaagagacaagggacauuauggggugaaggucggggguuguuugacauuugccccuucccgauguaacuaauuaagcuucaaguuguaauguguuuuaugggcuagaaggcuuuagugccuauauuuggaucucagcuccaacaccuuggacucuuacaaccuugggauaaguucuuacuagcucugacucucacuccccaucuauaaaugggaauaagaugaacgggguaauuuauagauuuuuuaguacccucucucuaguuccgcuguuuugccauucugcucaugcaccaaugccaugugaucuuauuguagcuuugcacucugacaccuggcaggucaagugcacccuugauuaucuucucauuaaaaauuuucuucagucuuuuaaguuuugaguauaauuucauaaugucuuuuaaaaucucuuuugaauucuuuuucaaauuuauuuauuuuuucuuugacagauaagauuauauguauuguguacaaaauuagaaagagaucuuuuccucuaagaucugaaacaagacaagaaugcucacacgcacuaguucuauucaacauaugguacugcaaguccuagccaggacaguuagacaagagaaagaaauaaaaagcauccaaauuugaaaggaaaaaguuaaauuguuccuauuuggagacgacaugauuuuacacuuauaaaacccuaaagacuccaccagaaaaccauuagaacuaauaaauucaguaaaguugcaggauacaaaauuaacauacaaaaaucaguaguguuucuauaugccaacagugaacuaucaggaaagaaauaaaaagaaagugccauuuacaauagcuacaaaauaaauauuucagaauaaauuuagccaagaaggugaaagaucucuacacugaaaacuauaaaacacugaugaaagaaauucaaggagacacaaauagaaagauagccugugcucauggggggauaauuaauguuguuaaaauguccauacuacccaaagugaccuacagauuccauagaaucccuaucaaaauaccaaugacauucuucacagaaauagaaaaaacaauccuaaaauugggugaagguggcaucuuugucucguuucagaucuaagaggaaaagcucucaauuuuucaccauuaaguaugauguuagcugugaccuugucauauguggccuuuauuguguugagguacaaugcuucuacaccuaauucauugagaguuuuuaucaugaaagaauguugaauuuugucaaacgcuuuuucugcaucuauugaaaugaucguaugguuauugucucacucuguuacugugauguaucacacuuauugauuuguguauguugaaccauccuugcagcccugggaugaaucccacuguaucauaguaaaugaucuuuuuaaugagcuguugaauuugcuucgcuagaauuuuguuaagaauuuuugcaccuauguucaucagggauauuggccuauacugccauuuucuuguguguuuuugugggacuuugacaucaggauaaugcugguuucuccuguuauuaauuucuaguuuuauaccaucaugcuuagaaaaaaaacuugauacgauuucagucuaauuaaguuuguuaagacuuguuuuauggccuaacauaugaucugucuuggagcaugcuccaugugcuguugagaagaauguguauucugcagcuguuggauggaauguccuguauuugucuguuuggauccauuuggucuaagugaaguguaagucugaugccuccuuauuuauuuucuuucuaaaucucccguccaaaaaucuaagagauccaaagcaaacaggggguuauaaaauuaccuuugaauucugacugaaauuguguuuacuuuguagauuauuugcuggugacuugguaucuuucaauauugguuucccaaacaaaaaacauuguaugucuuucucuuuuuccagucuucuuuuaugucucaguaaaauuuuguagcuugccuacuacuuauuuucagguuaaauccuagauauuuucaauucuuacugccauuaugaaugaauguuuuuccccaugaaauguuuaacuacagcugauuuagggacucacugaguuuugauuuguugauuugaaaaacuaccacccuguugagcucauguauuuauucuaagacauuuuuugagauuuuccagguaaaaaaauuauaccuagaugaauuuauagaacaaccuaauagcauaaaagcaauagauuauuguucaccacauuaaugggaaugccuuuccucuuaaaauuaugauaucuugggcuuuguguuugugacagcauuucuuuaugauggaaagagacuauccuuccaguucuauagaaacguuuuaaaaauagcuuacauuuuuaaaaauuuaggaaugauauugauuuucauugaaaacuuuucaacaucugaagaaaaucuuuucuuccuaaccuauuaauagagcuccugauuuucaaccauucuuguauuccuaaaauaauccauauuggucauaauguauucuucuuuuacuaaacuguuaaaauaaguugggugcuguuuuuuuagauuuuggcaccugugugagaggagggugccauggcaggguggcuaagugugcccaccuguguacuagcauugaauuuugacccuuuaucccauuggcucuaaacacuacaucucaggugaagacgcccaaauguuuaucucuacugaguuacagauuccuauaacaauugcuuaaauugauacucccacuugaaugucucauagguguggcaaaguuuacaugucuauacugaaacucuugguuuucucucccaggcaugacccuccaccaguuuguccuauuucaguagauggcaucaccgccaucucccugguuauggaagucccagacccgggcaacucucacuccuccauccacucaaccagcaggucuuauuggcucuuucuguaaaauaugucucauuuauucacagccugcuagcugcauggacuccaucccaggccacgccaccaucuuccugcagcaguuucuuaacuggccucuccauucccuuucuugucccacuaaauuuucuucuauuuaagaaaaaauguuuuguagacaugggguuucaccauguugcccaggcuggucucaaacuccugggcucaagcaauccuccugccugagcuucccaaagugcugggauuauaggcuugagcugagcuuuugaaaaaacauucuaugauguuacuguccuacuaagacccuuuaauggcuccccacugcuuucagaggaaaauagaaauuucucucuguggaccaugaggcccucaugaucugacccucaccaccucccuagucuuagcaguccaccugccacugucucauggggcuccacagauuugaucuccuuuuugguccuuaagcccaccaagcuaaguaucuuauucaaaacuguguccucagccccuagcacaauucuugacccuuagaauucugacacuugaaauguguguuaagcuaaucaauaaauuauugugccaggcuugguggcacaauaauguguugugggucaccuauauauagcuguggcucacaccuauaaucccagcacuuugggaggcugaggccugcagauugguugagcccaggaauuugagaccagccugggcaacauggcaagaccccaucacuauuaaaaauacaaaaaaaaaaaaaaccaggcgugguguugcauaccuguggucccagcuacucaggaggaucacuugagcccacuggguggagguugcagagagcugagaucaugccacuacacuuuggccuggguaagacccugucucaagaaaaaaaaaaaaagguuaugguacuguaaauauuauauuacaguguauaauuuuugacagcuuuuuuucuccauuucuucuaugguuauuggucaguucuagccuucuauuuuuuuuuuuaagcugacacauacuggcugggcaugguggcucacaccuguaaucucagcacuuugggaggccaagacaggaagaucucuugagcccagaaguuugaggcgagccugggcaacauagcaagaccccaucucuaccagaaaagaaacaacaacaaaaagaaacuggcacauacuaguuauuccauaaauauuucuuaaaugaauuaauucuaaaguugauuuuuauaauuuacaucuuaauagaaagacaauccaucucagagauauuuuuauucauuaaggaaaguugcauaaaguaauuuauuaaccuuuuaaagcauucucuaagccuauuuccccuuauagagauauguuuucuagugauguguguauguuacauuuucaaauaacucuuaauuuuauuuagaaauuccacauuuuuguggguuuuauuuauuaaauucgauuuucaucucuauuauuaauuuaugacaguuuauuuugaaguuuucuguuuucuuccuuuugaguugaauaaucauuuacuuuauuuuacuucuucuauucaguuguauuauccauguuccucugauagccaugcagguuccaaauccucacauuuuucaacuucuuuaaaagauuuuuuuugugcuauccugauaagcguuaaguguuauaucauuuuuuuucauuuuuauuauauucuuaaugauuuugauucucuuuuucuauccuuuugguuuucuuucuuagguaaaugaucaguuauaucuuuuggccauuuuuuucuguuggaauuacugucucuuacugcucuguaagaauuccuugcaaguucuagaaaugaauccucuguugauuuuaaguacuaaaguccccuuuaccauuguguacucuuucuauuaacuuuguccagagucagcuuuaucgugcugaacaagaaucuuuacauuuuaauuuuuuuuuuuaauuuuuaaguucaaggguacaagugcagguuuguuccauagguaaacucgugucauggggguuugucauacagauuauuucaucacucagguacuaagccuaguacccauuaguuauuuuuccugauccucucccucccuuagcccuccgauaggcccuaguauguguuguuccucugcaugcguccauguguucuuaucauuuaggucccacuuauaaaugagaacauguagaauuggguuuucuguuccugugucaguuugcauaucccugcaaagaacaugaucucguucuuuucuggggcugcauaguauucgauagcauauauguaccacacuuucauuaucccagcuaucacugaugggcauuuagguugauuccaugucuuugcuauuguggauaguuuugcaaugaacauacacgugcaugugucuuuguaauaggaugauuuauauuccuuuggguauauaccuaguaaugggauugcugagucgaaugauauuuccgucuuuagguuuuugaggauguaaucaaauucaucaauuauuugccuuaugguuugugcuuuuuguuuaaaaaguucuucccccauuccuccuccaggucacaaagacauuucccaauauuuuccucuucuagcgccaaacuuguaccuuucacauguaagucuuggauccaucuagaguucacuuuuguauguaguuagggaucuaguuuucuuuuucuuguuucccagaagcaugaaaccuuccuccuuuauugguucguggugcccaugucagcacacaucaagucccuguuaaaguguaucuacguggguuucucucucaacuugcuuuucuguuuccuuuggucucuccgucuauuccugagcuuuaccguccagucuucgucacugugguuuuguagugauuucaugucugcuuuggcagauucccuccucuuuacacuuuuuuuuuaagguugaccuuauuauucauggacauuuucuuccccauagaaguuuacugaacuucucaaaaaauugagauuaccuggaauuuuaacuggcauuuuauugcaacuaccaguucauuuaggauaauggacaucuuuauaauacugaguuaucgccaucaagaccauggaaugccucuccauuuuuuucagaccaucuucuguguucucuguauaaugugucacccaucagaagucuuuucuuaguuaagucaauuccuagacgcuuuacaguuugguuguuacuuugaauaucuguauuuucuucuggucaguuauugcuacuguagaggaaugccguugguuuucguaggcugaccuucagucccacaaccuugcacucuagcguugguucucauguuaucccuguuauucuguuggauuuucuaugugcaugaucacacuaauugcaaauagugucagcuagagcacuuuccuugccauucuuacaccuguuacuucuuugcauauggccuuggacagcaccuugagucccaugacaauggaugucccuguuguauuucugaguguauucuuagcauucuucuuaguaauaaacagguauugaccauuaccauauacuuaauaggauaucuugaaauaugccagaggacuaggccacuacuugacuggugacagagaguaucuuagauguauaggcccccagacaugccaguguccucucucaccacccaucuccacuccaaaguugucuggccucacccaccuucugugccugguucuucuccucugugcuucucucacuaugccauguccucgccuguucaggugucucuaagagcucauagauccuuaacucuuacagcuuuaaaugaggcacauucaaagcccgacucagugucauucccugcagucuccucuuccucccaucuuacccauuucagguaauaucuccagccagccagagucuacugcaguagcuggcacaugaaauaaauguuuauuuaacugaauugaaaauguuagcuggccauugucaaaaauacuauuuuguaaauuuauaaauaugguucucuuuguauauccauuauaaauauuuaguauuuaguuugauuauuccuuaugcuuuauaacauguguuuucccauucauucauuuauccagcauuuauuuugcaugucuaugggucaagcgcucugucuaggaacacugcugugaacaaaaccaaacucccgcccuaaaggagccugcacucccguggagaacaugaauaauaagcacagaggaaauaacauaauaucucaaguagcuguaacugcuccagagaauaaugaagccaggaaagggggugggcuagggggugcuguuuuagguagagugaugggaacagccccacugagcaaacuuuagccacaugaguagcuggaagaaaagccuucuaggaccagggaacagcaagugcaacagcccugagacaggaugggcuugucaguuugaggagcagugggaggccugaaccagguuacauggggcccagccaguauggccacgacuuuguguuuuauccagaguacaaaggagccucacugagggacaagggaaguggcaugaugugacccgcauauuaagaggagagcgcucaauggcagccaggggaggagcagggaggcugguugggaggcuguugaagaaaucaggugagaagugauggaagcaccgaauaagauggucauguuggaaaaauugagaagcugaggugcuuagcauugauuuucaagguagagcuacugagauuugcugauagauccaauguaugcugggagagaaaauucagucacucuagagcauuggcuggauuugucacccauugcagcgaauggagaaggugcugacauaaaagcccuuuagacugaaagcuacugacugaggggauggugcccuaguuugauuuccugggguguaugaguagcagggaggccaagagcugggccucacgagauuguggggacuacaucagggaagcaggccugcaaagaaccugcaccacagacccccaccuaaaagagccuccaaaaacccuaacuggcaugaccugaguacuuuaacucugcuuguaacuuucaaauauauuuugauuugcuuaugaccaccaaggcaaaacuucccauuucaauaauguuaguagaaacauaaacaggauguuaauuuauuuauuugguaauucuuuuuaugaauauuauccaguuuaaucauuagcucugaaggagaugaaaaauaauuuucuaauuuuuagaaaaauuugcagcuaauugggugauaaagguaagggguuucugaguucacaaaaauguucuaaaauuggcaacaguuucgguugcacguuucauuaaauguacuaaaaaccauugaacuguacaugguauauggugaauuauaugguaugugaauuauaucucaacaagcuggguauuguuuuuuuaaaaaauaaaaauaaaaaaggagaaagagagagagaaaaacaauugcagaucaucccagcacugaggacaagacuaacuucaguguuccaguauaugccauuauagguuuuacggcacacagugaugauuuggagccuaugauuugaccuaggguacagcagguacuguuuagcaaucauuuuacuauugucauaggucucugcucuuggagcuaagugcccaggguaaaugagaucuuuaauuugaaaagagauuuuugauuugaugaauguacauucuccaaagggucauaaauugucauucuggauguuugaucuguuuguuguuuugguacaaaaauuagaagaaaauaauucacucauaaaauguuaaauaaugaacuaaaagucauucaucaaguccauaacuuagggucacauuuguccuuggagcaggagaaagaguuguguucacccuuuucuuacuuuugcuuuuguccuaagugcuucagagaaguacaggguggcaacaguguuucuacugagcagcugauaccauugcuaugcacucauucauuaugcaggaaacauuuaguaauuucaacauaaauaugggacucugacguucuccucuucauuuugcagagcagucauuauggcgaaccuuggcugcuggaugcugguucucuuuguggccacauggagugaccugggccucugcaagaagcgcccgaagccuggaggauggaacacugggggcagccgauacccggggcagggcagcccuggaggcaaccgcuacccaccucagggcggugguggcugggggcagccucauggugguggcugggggcagccucauggugguggcugggggcagccccauggugguggcuggggacagccucauggugguggcuggggucaaggagguggcacccacagucaguggaacaagccgaguaagccaaaaaccaacaugaagcacauggcuggugcugcagcagcuggggcagugguggggggccuuggcggcuacaugcugggaagugccaugagcaggcccaucauacauuucggcagugacuaugaggaccguuacuaucgugaaaacaugcaccguuaccccaaccaaguguacuacaggcccauggaugaguacagcaaccagaacaacuuugugcacgacugcgucaauaucacaaucaagcagcacacggucaccacaaccaccaagggggagaacuucaccgagaccgacguuaagaugauggagcgcgugguugagcagauguguaucacccaguacgagagggaaucucaggccuauuaccagagaggaucgagcaugguccucuucuccucuccaccugugauccuccugaucucuuuccucaucuuccugauagugggaugaggaaggucuuccuguuuucaccaucuuucuaaucuuuuuccagcuugagggaggcgguauccaccugcagcccuuuuagugguggugucucacucuuucuucucucuuugucccggauaggcuaaucaauacccuuggcacugaugggcacuggaaaacauagaguagaccugagaugcuggucaagcccccuuugauugaguucaucaugagccguugcuaaugccaggccaguaaaaguauaacagcaaauaaccauugguuaaucuggacuuauuuuuggacuuagugcaacagguugaggcuaaaacaaaucucagaacagucugaaauaccuuugccuggauaccucuggcuccuucagcagcuagagcucaguauacuaaugcccuaucuuaguagagauuucauagcuauuuagagauauuuuccauuuuaagaaaacccgacaacauuucugccagguuuguuaggaggccacaugauacuuauucaaaaaaauccuagagauucuuagcucuugggaugcaggcucagcccgcuggagcaugagcucuguguguaccgagaacuggggugauguuuuacuuuucacaguaugggcuacacagcagcuguucaacaagaguaaauauugucacaacacugaaccucuggcuagaggacauauucacagugaacauaacuguaacauauaugaaaggcuucugggacuugaaaucaaauguuugggaauggugcccuuggaggcaaccucccauuuuagauguuuaaaggacccuauauguggcauuccuuucuuuaaacuauagguaauuaaggcagcugaaaaguaaauugccuucuagacacugaaggcaaaucuccuuuguccauuuaccuggaaaccagaaugauuuugacauacaggagagcugcaguugugaaagcaccaucaucauagaggaugauguaauuaaaaaauggucagugugcaaagaaaagaacugcuugcauuucuuuauuucugucucauaauugucaaaaaccagaauuaggucaaguucauaguuucuguaauuggcuuuugaaucaaagaauagggagacaaucuaaaaaauaucuuagguuggagaugacagaaauaugauugauuugaaguggaaaaagaaauucuguuaauguuaauuaaaguaaaauuauucccugaauuguuugauauugucaccuagcagauauguauuacuuuucugcaauguuauuauuggcuugcacuuugugaguauucuauguaaaaauauauauguauauaaaauauauauugcauaggacagacuuaggaguuuuguuuagagcaguuaacaucugaagugucuaaugcauuaacuuuuguaagguacugaauacuuaauaugugggaaacccuuuugcgugguccuuaggcuuacaaugugcacugaaucguuucauguaagaauccaaaguggacaccauuaacaggucuuugaaauaugcauguacuuuauauuuucuauauuuguaacuuugcauguucuuguuuuguuauauaaaaaaauuguaaauguuuaauaucugacugaaauuaaacgagcgaagaugagcacca

SEQ ID NO: 191244 - RNA, 149144 nt, Homo sapiens
ggcggcugucgcggggaccggaggcggaggcugcagcgggcacugcggcgccgaggcgcggcggcaggacgggaaccacgcgagcugcagccaggugagagcccggccgccgcgcccccugcccggccugcgggccgcaccugccggcggggccgcgaggugcucgccgcgcccacgaggccggccuggcacggcccccgcgcgcugucacccaccggccccgcggcgcggccugcgcgcccccaccccgacccaucucccgggaccccgcgcccgccggccacccuggccccggggcccaagaugcccggcggcccucagcuccugccguucugccggccgggccgggcccccgggguacccaccccuucccgccacgggagccacagcgcgcucgggcccucaggccgcgcagcggggaggcaaauggggcgcccccagaaccccacuggcugccgccgccuccucccgggcucugcgcccgcgcguccuggggucgcuucccucgccccucccccgguggugcgcacgggcaucgucucgcccccuggaauucaggggcaucaggaggggcggcaagagggugccuuuuacauucuugcuuucuucccuucuacaaagacugcgcgaaguaauuuuagaagcagcuccuccgaccccggggccuuucuggccuguucccuggggggucgcgagucccccuccuugccaccuuucggggggaaaaaaugacauuucgagugugacuacuuuaaggcgcaggauuuucuccuucguuugguccuagaugcccccccuuggauggguggcugauaggaugucggccugcaggcuggggguuuaagcgugacugaugggaaauuaucgauugucagggcaaaggguaaaugagggcaacugcagguggaagaaagucacccauaagggcuuucugggucugcagcguuuguaguaggugcuacuucuauucuugcagugcugggagacgggcgggggaagaugcagucccugcugacaauugggucaucugcgcgcagagaaggccccgggaugugcgaggacaugggacugggaguccggaggcagucugguuugagcugucacuaauuggccaugugaccucccucagccggcuucguccucucugaagcaaaaggcuggaauugggguggcuggagcauuuuuauuuuaugcuuuuguauuugaaugcuguuggguuugggccucaccguuucugguugucuacaccugccuuuuucaccguugcaggugacguugccugccuccccugaagguguuugaaccuggugagauguauaaagggcccuuuucagcucaaaaaaucagaauucugugcuggguuaugguuggcucuaucagggucacuuaugaacguauuacuacuguucucuuuucauucauccccaauuuaauggcuuuugggcaccagugggugugcccaguguaagcucucauggcacaccugcuaguuaaagggaggcagcagguguguccagccuguuccaugugacauccugagcaugagguaucugcuuucuaggcuauuuccuuugccaaaauggcaaccagcuucuuucuuuuaauaccaaggcauuucucuuuugguuucuuugcuuagaguggagggugauuuuuuaagacaauagguauuucaggaacuuuuuauguugacaguauuuuagaugguugucuggcaguuguauucucugacuguggcacggucaauuaagucaauuaaguuuaaacaucuguugacauguuuaaaaaaugccuauugaaguaccugggccggguguugugguucacaccuguaaucccagcacuuugggaggcugaggugggaggauuguuugaggccaagaguucaagaccagccuaggcaacccagcaagacuccuguuucuauaaaaaaaaaaaaaaaauagcugaguauggcggccagcuuaaaaaaaaccaguaccuggcuagaaaaauguagaugguuuugcuagguuucaugccauacuaucuaucucauugauggagcaaacucuagucuauguagcauugcagaagugagucaugugucccggggcaggcaagcacauguagccacccacugaguagucuguccaucugugucugcccauccauccauccacuuggugaccagguucuguugaacagaucguuguugaauaaacugugucuuuugcccucacagagccuaaggucuaguuugugggguguuugaaaucccgaauuggcuauuguuguccucuucagugucucuaaagacaaaccagggaucuauuuggggaccuauauucugguaccacugguagcuugaggaauuuucccauuuugguuaagguaauuaaaagcaguaggccggggcugggcaugguggcucaugccuguaaucgcagcacuuugggaggcugaggcgggcaggucgcuugagcucaggaguucgagagcagccuggccaccauggugaaaccucgucucuacuaaaaauacaaaaguuagccgggcaugguggcgcaugccuguauuuccggcuacucaggaggcugaggcaggagaaucgcuugaaccugggagguggaguuugcagugagucgagaucgugccacugcacuccagccugggugacagagugagacugucuccuaaaaaaaaaaaaaaaaagaucaacaguaaugauuugaaauuauauggugcuuuguacauguaaauugaagcuuuuuaaaaacguauuuauauuuaauccucuuaggcuuuuuaaauuuaaacaucuuacaguccuuccugaaccguuuccuggccuugcccauaaaacucucacacaccagucuguugguucccagugcccaguaaccucaccucauuaauucauuuucaugcccugcuauuccuccaguuguucucugggcuugcuuuuauucuuucuguagggaaccauccuccuccagguuaagcugugcauugcagccucuagguugaaacgagcccuuugugcgcuaugccguucuucucauuuucucuguggcuuugcuauuuugaaccuguuauuucgucacagguucuagguucuuggcucuccuguaauugaggucugcuuucagcuugcaccuuucauaggccuuucauacauuuauuacauugagugccugaucugugcuggguaauauucuuggugcuugggaugcugcagggagauucccagcccacauggagcccacacuguagggauguggacaaugagaucugguucugugaagaggaaucugacaaggcucgggggauuaaguguggggaugggaguugauauuuuuggaaggguagacagggaggaagguauaugagucugcuaacacugccauaacaaaaauagcacaguguggguggcuuaaacaacggaaauuuguuucguauaauucuggagucugggaaguccaaggucaagguucuggccucuuuaguuucuggugagggcuuucuuccuggcuuguagguggccauccucuugaugaguccucacauggccuuuucuuggugccauuuaucuuucuguucaagcacuguuggucacaccuguaaucccagcacuucaggaggcugaggcaggaggaucacuugagaccagucuaggcaacauaauaagacucugucucuacaaaauaaaauaaaauaaaauaaaaaauucgcuggacgugguaguagugccuguagucccagcuacucaggaggcugaggugggaggauugcuugagcccaagagguugaggcugcagugagccaugauugugccacugcacaccagccugggugacaaagcuacuuuguuuaaaaaaauaaaguuuuccuauuggaucagggccccauccuuaagaacucauuuaaacuugguuaccuccuaaaggcucuaucucuaaauacagccacauuguggggguagggcuucaauauaaugaauucuuucggugguggugggggauacaguugaguucauagcagagggcuugagucauuuuuaacuaaagauguguagggagugaggcauguggagaucugggagaaggaucauucugaggggaggaaacagcagauacaaaggcccugaggcaggaggaggggagaauuuggucuugaggucagagaaaccaugggggucagaucauguaaggccaugcggaccacuguaaggcugguagauuuuaccuugagggugguagaagccauuggaggguuuuggaguaaagaagggagguggacugaucuagcuuuuagcaagcacacucuaggcguugcugugugagacagauugaaggcaggacagcaaggagaccagccagaaugcagggcugaggggagacuagugggauuucaaggugagguugagauuugcugaugaaccagaaagaaaacugaggaggacuccgagguucuggucuuagcaccuagaaagaaagaggccauuaacugagaugcuggaggagcugguuuaggccauguuaaguugugaugccaacccagcauacccaaaugcagcagaaaagcaaggguggagauuuuuggggaaggucauccucaauggaaauauaaaucuugggagcuucucauuguccuuugucccaauuuucgacuuugaccucaggugaccucagccaagucugugaccucagaucuaggugucucuaaggcccucuauggaaauuccauccuuaaaggagagugguuuucucuggucagugaucaggaaaaucuucacucaugaguuguuguuuuuuuuuuuuuuuuuuuuuuuugagauggaaucuugcucugucaccuaggcuggagugcaguggugugaccucggcucauugcaacuucugccucccggguucaagggauucuccugccucagccucccaaguagcugggauuaugggugcauaccacuguacccggcuaauuuuuguauuuuuaguagagaugguguuucaccauguuggccagccuggucucaaacuccugaccucgugauccgcccaccuuggccucccaaagugcugggauuacaggcaugagccaccgugccuggcccacucaugaguuuugcccacucaugaguuuugcucaaagcagcugauggcucgggcuuccuucccaaaggcaucaucucauugagcaccugguggaggucauccaucuauguguguaacucuuacagagaugaaucccucuaucuucuaaguugaauggaagugcaguuugauaaggugcgcuucucuguuggacccucuccaagcaauagaagggacccuagaaagacaagagagccccaugugauagggccaaggaaacagugauggugcccauagguauugauuaugcauugggcacuuuagguuauuauugcuaguccuagcaacuggcaggcaagguggcuucugguccuucauuuauugaugaagucuuggguaacuucuguaaguuaauuccugagucuugaauucuguuccauuaaaccacuguagaacacuauucccagcucucaucugaaacucaggguuucuaaguucucguuaguauagaagagggcagagaagccagugucaguugagugccagggagcucugcccagcacuccuguguucuuucacguugaucagucucugcagcccugugggcuggguauuaacgcuuuucauccuacagcugaggaugcugagguguggcaggagggcagcuucuugccuagggucuuagcgcugacaaguagagucaggauuugacccuaggccggucaguugccaagcucgaaguuagacucuaaucaugcuguguuccaggaugacuuuuggggacuugggauagaaaguaggguuaggcuacagaaguugggaaugacauuccagaucgagggaucagugugagcaaaggguggagcaggagaggcaugugacugggagaggguaacugaguuaggacaguuggaaggaugcugaggaugugaugggggucagguggagagguccuuugauacuguauuauggggcuugaaucuuugucuggaaaggcacggggagauucccagaaggggagugacuuguucagaugugcauuuuagaaaauuuugggguggaguaaagggugcacugggaggaggcugaggcugaaugggagcaggaccgucuccucuugcuccugccuuguuugccugugguucauuccuggcuacaguguuugccuuuaugcacccuagcuuggauucuuucugucaauucccuuguuuguuccuguaggaaucuucuacccaccaccucaacgcucacacauuuuuuccccccacuggcuuuccuuuguucaagugaauauauacauacccccagcuccauucaauuaaauuugaauaagcuuuuucauuuuggaccaucauuucaucucagaguucuuggcuuugugacucugagggucuucuccacccugcuucagaccgaaagcacugcuguguccucagucuucaugaaggaaacacaauugcuuucuuucuuucuuuuuucuuuuuuuuuuugagacagaguuuugcucuuguugcccaggcuagagugcaauggugcgaucuuggcucacugcaaccuccaccuccuagguucaagcgauucuccugccucagccuccugaguaguugggauuacggucacugcaacugcgccuggcuaauuuuuguauuuucauauuuuuuuuggggacggaaucuugcucugucgcccaggcuggagugcaguggugcgauaucggcucacugaaaccuccgccucauggguucaagcgauucuucugccucggccuccugaguagcuacgccuggcuaauuuucauauuuuuaguagagacgggguuucaccguauuguucaggcuggucucgaacuccugaccucgugauccaccugccucagccucccaaagugcugagauuacaggugugagccgccgcaccuggccaacacaauuucuuauacauucuacuuuagaugggauuucagccucaaauucgguuuggcuuuauugacuccucuccagggcuggcuaaaaucauuuccugucuccaaaggcagaucaccuagcugggggcuaacuacaacaccuuccuugucaaacauggaucucauucugaagaucuaggguggaccccgaaaaugugcauuucucacaaguucucaggugacagggauguugcugguggaggcaucaccagcaucugguuuuguaaauaagguuuaauugcaacacagccaagcucacucaagagaccauguaacucuggcccuuuacagaaaaaguuuggugauccugcuucacaguaagguauauguggucagugcugagaauuuucuauugaauucauguaucuauauuuuuugagacagggucugucacccaggcuggagugcaguggugagaucucugcucacuugcagcuucugccucccgggcucaagagauccucccacuucagccucuugaguagcugggacuacaggcauguaccacuacacccaacuaauuguuguauuuuuuguagagacaggguuucacuauguuuuuagagaugggggucuccuguguuggucaggauggucucgaacucuugagcucaagccuccuaaaguucugggauuacagccgugagccacuguucccagcccaaguucauauauuucuuaucaagagcuuuuuugauauuuauauuuauagacauugcuucacaaauuuuuccacagaugcaugauaugggggaauguaugcauauuuaaaaguguuuggaauauaacaagcaugacacuucuuuuaagucucuucuguuuuaucuaaaauuaaugugaauuucucauucuguuucagaaacaucagugcuuguuuuaauauaaaacauuuuucuuccauguucuuugaguaaaguugaugcuacuagauacauuguuuuugaucuugaccugcuugagaaacacguacagguugaauauaccuucuccgaagugcuuaugacuagaaaguguuuuggauuuuggguuucuuuuuuucuuuuuuuuuuuucggauuuuggcauauuugcacuauacuuaccaguugagcauuccuaauuuuuuaaucugaaauucagaaugcuucagugagcguuuccuuuuuuuuuuuuuuugagacggagucuugcuuugucgcccaggcuggggugcaguggcgcgcccaggcuggagugcaguggcacgaucucagcucacugcaagcuccaccucccagguucaugccauucucuugccucagccucccuaggagcugggacugcaggcgcccgcuaccaugccuggcuaauuuuuuguguguguguuuuuaguagagacgggguuucacuguguuggccaggaugggcucgaucuccugaccucgugauccaccugccucggccucccaaagugcugggauuacaggcaugagccacugcgccaggcugagcauuuucuuuugagugucuuguuggcacucagaaaguacugaauuuuggagccuuucaaauuuuggauccuuucaaauuuuggauuuuugaauuaggaauacucaaccuguguuaagauuugcauuuuuuuguccuacuuugcaaauauuuuuuucuaugccuugacuuaaauucaagucuguuggccaagcgcgguggcucaugccuguaaucucagcacuuugggaggccgaggugggcagaucaccugaggucaggaguuccagaccagccugaccaacauggagaaaccccgucucuacuaaaaauacaaaauuagcccggcaugguaguacaugccuguaaucccagcuacucgggaggcugagggaggagaaucacucgaacccgggagguggagguugcagugagccaagaucgccucauuacacucuaaccugggcaacaagagcgaaaaacuccgucuccaaaaaaaaaaaaaaaaaaaaacugucaaucuuuuuuuauuucccauggcuuuguuaucccuaaauuuuauagguauucacucauguuuucucuuaguucuuuaaaaaaaaauuggcuauaauuagucugauauuuguuuuggaguaugguaugaaguaaggauuauuuguccccucuaguuuauauuuuuuggguacuauuaauucauccuuauuaacuuaaaaaauaacaccuuaaucauaugcugaauccuuggaucuguuguuuuagucaguuuaucuguucuuuugccaugaccuuacuauuuuagacauuaaaaucacuuuauaguaggcuuuauuaucugguagugccuaugcucaguuuuuacuccaguguuuuucaauuuaggguuucaaaauacucccuccaucuugagauggagucucacucugucccccaggcuugaguguaauggcgcgaucucggcucacugcaaccucugccucccagguucaagugauucuccugccucagccucccgaguagcugggauuacaggcaugugccaccacgccuggcuaauuuuuguauucuuaguagagacagaguuucaccauguuggccaggcugucaaaauacuguuaaugggaaauuucauuaaaugcauaaguuaauuuggggagacuugucaucuuuauaauauugacuuguucuguguaugaacagaaaaagucagugucucuagauuuuuccuaauauguggucuauagauuacuuuugugugugugugugugugugugugugugugugugugugugugugaaacggagucucucucugucacccaggcuggagugcaguggugugaucucagcucacugcaaccuccgccuccuggauucaagcaauucuccugccucggccuccugaguagcugggauuacaggugugcaccacuacacccagcuaauuuuuguauuuuuaguagagaugggguuucaccguauuggucaggcuggucuugaacugcugaccuugugauccaccugccucggccucccaaagugcugggauuagaggcaugagccaccaugccuggcugauuacuuauucuuuauuuuaaaguauuugcuggacuggacaugugauuuaugccuguaaucccaguacuuugggaagccgacaugggaagauugcuugaggucaggagguuaagaccaguuugggaaacguagugagaccccaugucugcaaaaauuuuuaaaguggccuggcgugguggugugcauaccuguggucccacugacuagggaggcugauugugggaagagaacucaagcccaggaguucaaggcugcagugaguugugauggugccaccgcacuccagccugggcaauagagggagacacccugcucaaaaacaaagaaaauauuugguauuuagaaugcgauuaucuccccucacaccucccucccacccgcuauuacuaacugguauagagcagguauaaagcaaguauacugcuugcaguuuguaugcuguggguuguuuuuuuuuuuuuuuuuuuugagauggaguuuugcucuuguugcccaggcuggcgucaguggugcgaucucagcucacugcaaccuccuucucccaggugauucucuugccucagccuccgauguagaauuacaguccuguuccaccaugccuggccacuuuuguguuuuuaguaaagacaggguuucaccauguuggucaggcuggucuugaacucuugaccucuagcgauccaccugccuuggccuccaacagugcugggaauuacaggcgugagccacugugcccggccuuguuuuuauaauaagauaagagauggaggccggggcaguggcucacgccugaaaucccagcacuuugggaggccgagguggguggaucaccugaggccaggaguucaagaccagccuggccaacauggugaaacccccacucuauuaaaaaaaaaaaaaauuagcugguugugguggugcaugccuguagucccugccacucaggaggcugaguagcaugggaaucaauugaacccaggaaacggagguugcagugagucgagaucgcgccacugcauuucagcccaggccacugagugagacucugucucaaaaaaaaccauaaaauaaaauaaaaaauaagcuagagauggaaucuugcuguguugcccaggcuggccuccagcucccagccucaaguaauccucugccuuggucuccugaagugcugggauuacagggaugagccacugcaccuggccagucuguauguuuuauaaccuguauuagucaggguagguaaugcuaguuaaaaucuguggccugacaaagaaaacauuuauuucuugcucacacuuuuuuagaugguucuuuucuaaguggugacuuggggaucugggcuccuuccauuuuugucacaacugacaagaagaugugaccuuaaguuugccguguaauuuugugcauggaaguuuuuuucaugggccaagcuuggaaguaguaguauuucuucugcggucuguuggcuguauuuuaggugcaagggggcugggaaguggaguccuuugguguguccgugaggaaaauguaauagcaccgugucugcuaugcuacuuaaccaaacucuguuguucuuauuuuucaguagauucucuugaguuucuuagauagguaaucauaauacacauugagcauuucuaauccccaaaucuaaaaugggaaacuuuugagcacugacaggaugccacgaguggaaaauuccgcaccugaccucaugucauggguugcagucaaaacuuuauuucauaugcaaauuuuuuuuuuuuuaagggaucuugcucugucacucaggcugaaguauaguggcaagaucauggcucacugcagccuuaaucuccuaggcucaagcgaucuuccugcuuuggccuuccaaagugccaggauuacaggugugagccguugcaccuggccauuauacacaaaauuauuuaaaauauugaguagaauuaccuucaggcuaugugucuaaggcguauaugaaacauaaaugaauuuuguguucagacuucggucccauucucaagauaucucacuauauauauaugcaaauauuccaaaaucagaaaagauacaaaauuugaaacacuucuggucccaagcauuuuauacaaggaauacuuaacuuguagcugcaaaugaucauuuugucuuuuuuuuuccuccuuccuauaguuagcuauuucuuuuucuuuuuuuuuuuuuugagacggggucucgcucugucacccaggcuggagugcagcagcgaucucggcucauugcaagcucugccucccagguucaagugauucuccugccucagccuccugaguagcugggacuacaggcacccaccaccaugcccggcuaauuuuuguauuuuuaguagagaugggguuucaccacauuggucaggcuggucucgaacucccuccugaccuugugauccacccgccucggccucccaaagugcugggauuacaaaugugagccaccgcgcccggccuaguuagcgauuucuuuuccuuuucccuuucccuuucccuuuccuugacagagucucacucuugcugcucagcuggagugcaauggcgcaaucuuggcucacugcaacuuccaccuccagguucaagcgcuucuccugucucagccucccuaguagcugggauuacaggugccugaacaccuggcuaauuuuuuuuuucuuucuuucuuuuuuuuuuuuugagacgaagucucucucuaucgcuaggcuggagugcaggggcgcgaucucagcucaccacaaccuccaucuccuggguucaagugauucuccugccucagccucccgaguagccgggacuacaggugugugccaccaugccuggcaaauuuuuguauuucuaauagagacaggguuucacuauguuggccaggcuggucucuaacucuugaccucaugauccaccugccucaaccccccaaagugcugggauuacaggugugagccacuguguccagccaauuuuuguauuuuuaauagagacaggguuucaccauguuggccaggcugaucucgaacuccugaccucaggugauuggcccccccucgguuucccaaagugcagggauuacaggcgugagccaccacacacggucagcuacuuuuuguuuuugagguggaguuuugcucuuguugcccaagcuggaguacaauggugugaucuuggcucacugcaaccuccgccucccugguucaagcaauucuccugccucagccuccugaguagcugggauuacaggugcccaccaccaggccuggcuaauuuuuuuuguauuuuuaguagagacaggguuucgccauguuggccaggcuuguuuugaacugcugaccuugagugauccgucugccuuggccucccaaagugcugagauuacaggcgugaaccaucacgcauggccaacuuuuuuuuuuuuuuuuuaaugcaucguggaguacuugcagaauagguuuaacugucauagguuuuauuuucaauuuuuacucaauugcaauauuguaaauauucuuuagugguauucaagaaguguccuaauuacagauuacagucucauacauaguuuuuuuuuuuugagauggaguccugcucugucgcccaggcuggagcacaguggcgugaucggcucacugcaagcuccgccuccagaguucacgccauucuccugccucagccucccgaguagcugggacuacaggcgcccgcuaccacgcccggcuaauuuuuuguauuuuuaguagagacgggguuucaccguguuagccaggauggucucaaucuccugaccucgugaucugcccaccucggccuuccaaagugcugagauuauaggcgugagccaccgcgcccggccacauaguguuuuuuuuagcgaacaaagcccagcaucuugacauugacccugcaauccucacagauauucuugguagucucucccugagagugauaauucucuaaauuuuuguuucccugcugauuugaagaugaccucagauuucuugcugcgaggaguuucacgagugaucguucuucagguuuguccccagggcuucuguuuuagccccggcuguuggauugugcagcugcucgcaucuucugugucaaagauccugaccugcaguguuugaaaauguugucucccucagagaaguuugauggguuuuuguuccucuuccuuuauucuuucauccacucaaagauaaacugaauaaguuagcaauaucgauuuuguuccuucuccuuucuuuccuccaguugacccuuggcuucuguuugaguucuuuuugcacuugcuucuggaccccuagugugaguuuggggccugcauguccacgcugcccaccugcagcccugcaguccccauuuccagugaugguacacccuucccugcggagcuccacaugugaucuacaguagacuucaccagaaggggccugaauuuagugggaguaggaagcuccucugaacccugagagguggauggaggagggaagcuuauuacuugacuuaccaaaguagauaccagggucaaauauacuuuuucugguguuuaguuccauugcuuacaaugaugcuuuaaagugacuucagcuuuuuuuuuuugauuucucuuuuugacucugagaucucacacuuacuguuuuauuucuugaauacggucaacugcuaaaauauauuuuccagacuuuuuguuuugacugacccacuucucucuauuuauauucaucucuguguguguguguguguguguguguguguguguguguguguauguguguauguauguaucucagacaaaaguuucaaggccaggcgcggugacucaugccuguaaucccagcacuuugggaggcugagguggauugagcacuugaggccaggaguucaagaacaguuuagccaacauggugaaacccuaucucuacuaaaaauacaaaaauuagucggacaugguggcaggcagcuguaaucccagcuacucaggaggcugaggcaggagaauugcuugaauccaggaggcggagguuguagugagccgagaucgugccacugcacuccagcuugggcaaaaaaauaaaaagguuucauaccacaccacauaaccuuuguuuuuucuuuuuguggcgaaaggggucucucuauguugcccaggcuagucuggaacuccuggguucaaaccauccuccugcccccgccucugcugggauuauaggcaugagccacugcauccagccagauaaccuuuuaggccguguacucugaaauuuucuaugcggauuucaugauaaaaauuuugguuaugaugcccuaaauugauauagaccuuuaaguaaggccuuugauuuagaaagguuaauuauucauacuauccuauggaaaagaaaccagacgagauucugugggcauggcgggagagggauucccuacauccagaauaacacauaaggaagcuucauugagauaauuuacauaaaauucaguuguuuaaaggauaugcuucaguaguugguagcauguucacugaguuucauaaccacuaccaucuggcugucauuagugguuacucucccuucuccccuuuucacccagccucuggcaacacuaauccgcagucuguuucuauagauguucucuucuggacauauaaaugguaucauacaauaugugguuuuggccaggcacaguggcucaugccuguaaucccagcacuuugggaagccaagguggggggaucaccugagcucaggaguucaagaccagccugaccaacauggugaaacccugcgucuacuaagaauacaaaaauuagcugggcaugguggcgcgcaccuguagucccagcuacuaggcaggcugagguggggguauugcuugaacccgagugguggagguugcagugagccgagaucaugcuacugcacuccagccugggcaauagagcgagacccugucucaaaaaaaaaaaaaaaugugguuuuuugugauaggcuuuuucacuuagcauaauguuuucaagguuuaugcauguuacagcaugugucaguaccuccacuuuauugcugaauaauccauuguauggauauaccacauuuuguuuauccauuaauuaguugauggacauuuggguuauuuucacauuugccuguuauaaauaaugcuguuaugaacauuugaauacaaguuuuugugugaucaucuuuuuacuuuuguugguagauacauagaaguggaauuacuggaucauaugguaauuccauguuuaacuuuuuuuuuuuuuuuuuuuggagacggagucuugcucugucaccaggcuggagugcaguggcgccaucucagcucacuguaaccuccacgucccgggaucaagugauucuccugccucagccucccaaguagccggaacuacaggcacgugccaccacgcccagcuaauuuuuguauuuuuaguagggacaggguuucaccguguuggccaggacggucucgaucucuugaccucaugauccgcccgcauuggccucccaaagugcugggauuacaggcgugagccaccaugccuggccgauucuauguuuaacauuuugaggagcugccaaaccauuuuacaaaguagguucuccagaauuauaugaggguuccaauuucucuguguccuugcugacaacuguuauugcugcuuuuuuugauuauagccauccuaaugggugugcagugguuuugguuugcauuucccuagugacugaugauguugaacuccuuuucaugugcuuguuggccauuuguaugcugucuuugcagugaugucuauucaaauucuuggcucauuuuuuuguuuauauuugagaccgggucuuuuuuuuuucuuuugagacagagucuugcucuguugcccaggcuggagugcaguggugcaaucucggcucacugcaagcuccgccugccagguucaugccauucuccugcgucagccuccaaauagcugggacuacaggcgcccaccaccaugcccggcuaauuuuuuguauuuuuaguagagaugggguuucacuguguuagccaggauggucucgaucuccugaccuugugauccacccgccucggccucccaaagugcugggauuacaggcgugagccacugcacccggccgagacugggucuugcuauguugcccagucuggagugcaguggcuucuuaauaagagugaucauagcucacugcagccucagauuccaagagauacuccugccucaggcuccugaguagcuggacuagaggcaugugcugggucauccagcuuucuuugcccauuuaauuagguuacuugucuuuauauuguugagucguaagaguccuuaauauauucugcacgaguccuuuaucugguauguaauuugcaaauauuuuuuccucuuucuguaagauucuuuuucacuuucuugcugugucuuuuuuuuuuucuuuuagacacaguuuuacucuuguugcccaggcuggagugcaauggcgcgaucuuggcucacugcaaccuccgccucccggguucaagcaauucuccugccucagccucccgaauagcagggauuacaggcaugcaccaccacgccuggcuaauuuuguauuuuuaguagagaugggguuucuccauguuggucaggcuggucucgaacucccgaccucaggugaucugcccaccuuggccucccaaagugcugggauuacaggugugagccgaaccuggccuugcuugugucuuuuuuuuuuuuuuuuuuuuaaagacggagucuugcuuugucacccaggcuggagugcaguggcgcggucucggcucacugcaaacuccgcugcccggguucacaccauucuccugccucagccucccaaguagcugggacuacaggcaccugccacaacgcccggcuaaauuuuuguauuuuuaguagagacgggguuucaccguguuggccaggauggucucgaucuccucaccuugugaucugcccgccuuggccucccgaagugcugggauuacaggcgugagccacugcgcccagccugcuugugucuuuugcaguuaagaaaguuuuaauuuuuguuaaagucucuaugugucuguuuuucuuuuuuugcuugugauuuuggugucauaucuuagaaaccacugccuaacccaaggucauaaagauuuacccccucucaguuuucuucuaagaauuuuauaguuuuagcucuuaaaguugggucucugaucgauuuuaauguuugagguagggguccaccuucauuguuuuacauguggacuuuuucuuuuuuuugagauggaguuucacucucguugcccaggcuggagugcaauggcgcgauuuugacucacuacaaccucugccuccuggguucaagcgauucuccugccucagccucccgaguagcugggauuacaggcgugugcuaccaugcccggcuaauuuuguauuuuuaguagagacaggguuucuccauguugaucagauuggucucgaauucccgaccucaggugaucugccugccucggccucccaaagugcugggauuacaggugugagccaccgugccuggccacacauuuggacuuucgguugucucaucaccauuuguuuaaaggaugacucuaccccccauuacguuguccugaugcccuuuuuugaaaaucacauauuuagguuuauuucuggauucucaauuguauucuguuaaucuauauggcuacccuuauccuaguaucuuuguauguacuuauaccacacugucuuaauuaguauagcuucauauuacuuuugaaaugggguagugggaguccuccaauuuuguuguuuuucaagauuguuuugacuauucuggguccuguguauuuccauaagaauuucaggaucggcuugucaauuuuugccaaaaaggcagaugggauuuugagagugagugcauugaaucugaagaucaguuuggguaguauugccaagaauuacauauuuuuaacugaaaaauuucuugagacaauguuuaucugcauaaggagcaguacauuaugauaauuucuuccagccuagucuagucuacuucauuccauuuuuucaaauuaagaaauugccaucguccgggcacgguggcucacgccuguaaucccagugcuuugggaggccgaggugggcagaucacgaggucaggaguuggagaccagccuggccaacauggugaaaccccgucucuacuaaaaauacaaaaauuagcugggcguggugauacacgccuguaaucccagcuacuggggagucugagacaggagaauggcuugaacccaggagguggagguugcauugagccaagaucaugccacugcacuccagccugggugacagagcaagacuccaucucaaaaaagaaagaggcugggcacgguggcucaugccuguaaucccagcacuuugggaggccgaggugggcagaucgugaggucaggaaaucgagaccauccuggcuaucacggugaagcccugucuccacuaaaaaugcaaaaaauuagcugggcaugguggcaugcaccucuggucccagcuacucaggaggcugaggcaggagaaucgcuugaaccugggggguggagguuguggugagccgagaucuugccacugcauuccagccugggcaacagagugagauuccaucugaaagauaaagaaaggaaggaaggaagaaagaaagaaagggagggagggagggagggaauugccaaccccaaccacugauuugaguacucacucccauggaacauucauuaucuguuguuugaaaaauaugcuucaugucagugguccucaaccucgacagcaaauugcgaucaccugggaaacuuuaaaaaacuacggaugcuggccacauccaugagaccaggaugcaguugaugagaaauucagcccgagcacuuccaggugauuccaggguacagccagagcugagcaccauugcuauaaauaaacuaaaauucagauauuuauacugcuuuuaaagccuuuucauaguugacugaaugggauggaaaugugcguauugcuaacuuacagguccuuaugugucacuuugaugacaaauguauuaggucuguucgugcacuuucuuuuaacguaauaugaccugugaugcaguucuccugagaaauugaaugauuaugcuauugacuugcccuuggguauguaggguugucccuggucuaugcagagagcaaagauagagcaggguguuuggagaucaucugucauuucucagaaauuuuugugucugccuuuuugcaguaggaaauggauugagaagaauauguaggaaauucacagcuauuuuaggaacugucauauagagaccacuaaaucuaaauauacuguugauguauaugaagcuauugguuagaacuaaggucagaauuaguggaaaaauaucgggacugguguccugucuuagagagauuaaggaauauuaggauugugguggaacgcguauacauaaaguagcuuauuuuacucauugaauauucuuuuaucugguuauauuugaaaguaaacuguggcugggcgcgguggcucacaccgguaaucacccagcccuuugggaggccgagguggguggaucaccugagguugggaguuugagaccagccuggccaacauggugaaaccccaucucuacuaaaaacaaaaaauuagccgggugugguggcagccaccuguaaucccagcuauuagggaagcugacacaggaggaucacuugaacugggaggcggagguugcagugagccgagauugugccacugcagucuagccugggccacagaaugagaccccgucucaaaaaaaaaaaagaaaagaaaaagaaaguaaaaugugcauauauacaauauauauaacuauuuuuuucaaaguagagauuauacagaggguauuuaagccuguuuuuuacuuagcaauguaucuuagauaugugacuaaauaguccuuuauuuguagcucauuugugcugaauacaucauguuuuauuugacaaauccuucuauuagguauuuagcuuaugagccauuuucugcugugguggacauaauacaguggugaacagcauuguaccuaaaucugagugcauuuuccugauuauuucuuuagacuaaauuguuggaaggcauaucauuugcauuucuaagacuuuaacacauaccuaacauacaugccagagaccuccugcauucagguuaacacacugggaaguauugccauaauaaaacauuuuuucuuuuuuaugccaauuugagugaagaauggaaucacuauguuuauuuugcuuuucuuugauaccuagugaguuugaguacuuuuuaaugauucuuuuggccauuuauauuuuguuuggcuuauugugguuuuuuuugccaguuuuuccagucuuguaucugucucucuuuccuggugauuuauaacaguauuuuuauaucaaggacgugaacacuuuaauaaauguuauacauauuuuccccauuugccugguaauuuuaugauguauuggagaacuaaguguuauuugcagauuguuuuucuugguuuaauuuucaaauuagaagucucauuuuucaaacucuaaaguuucauaggaaacauuuuucuuaaagaugaauaaaaaucugucagaacaugauuuuguuuaaaguauuuuauagauuucuuauuugcuugucugcuaaaauaaugcuuggaacaaucagcugccaccuuugaauuaaaaagaaaaguaaaauuuggaauagaagauuuuccaauauuauugucucuauauuuuaauauuuuuuucauauauuuagacauuuuuuuuuguagagacagggucuuucuauguuguccaggcuggucuugaacucuuggccucaagucauccuccugccugggcuucccaaaguguugggauuauagguaugagccaccaugcuggccccauugucccaguaaaugugaaccuuaaguuugggcgcuuuugguguuuagacccuuuggguacacauaaugucuguuggguugauggugcucuuuuguguuaauuucuuuuuucuuuuucuuuuuuuuugagaugggggucucacccuguugcccaggcuggagugcaguggugugaucucgguucacuguaaccuccgccucccggguucaagcgauucuccugccucagccuucugaguagccgggauuacaggcacacgccaccacgcuuggcuaauuuuuguauuuuuaguagagaugggguuuugccauguuggccaggcuggucucgaacuccugaccuugugaucugcccgccucagccucccaaaguacugggauuacagacgugagccuuacagacgugagccaccgugccugguccuuugcauuaauuucuuaguuuugcucuaguaguauuaaauuggagacuuuugcaucauacuuagauaauagccuuaaauaacucuuucugauuuuacccuauaggguucuuguuuaaaaaucggcauccguuuguauuccagcucucuggaaacacuuguccuagcuagguuuuagggguuugcuagucuuguuggcuccuugagguuguggaggggagcuuaauguguguagcuucacagcaucuggcucagcacagcucagaauagguacuacaugugcccugugugcauauccuggcauuaucccuuuaacugucucuaggagaaaugagaccaguauggguucugguucuggggcugccuccaacuggggauaagacucuguuuccccucugugucuuccauugccaauggggggccagguugcaggauuucuaagccccuuuuguucauucuuuccacccccuucauuaagcacugucuuucagcagggugcuggggagaagcagccugcccaggcuuagccauuucuaggucguccucguuuugaguucacaauucugaccucuaguuacuuuaaucugguuauuaucuaaucgugaucacuccuagacauuuuggagagguuuagaaaguuuugggguuaacagacauaaaauaggauuuucagcuuaguugaaggucaacagugcuuguucacacgcaaaggcacaguuuaugaagggaaaaauagaaccauuuguguuaacugagcuugacuuauuagcaccgauaguugccaugggaguguuuuuuuaacuuugucauuuugccaggaauguaaaucggggcauuacuccuuagaucuucauguaauuaggaggauggacaaagccccuauuuuucuugaaucaggaguuuauuaucccguuuauaauacgggaguaaauuaggaaaggugucuuuaauuuuuuuguuuguuuuuguagagacccuuguuauguugcccaggcuggucuugaacuucuuggcucaagugagauuauacagugugagccacuaccaguaucuuucguuuuuucaugauaaguacaacuuaggcauugagcaaaacuguuuuuagugacuugucuugcauauauauuuaugaauuuugagcuuuuaaaaaaucacaaauaggccaggugugguagcucauaccuguaauccuagcacuuagggaagcugaggcaggaggaucacuugagcucaggaguucgagaccagccugagcagcauaaugagaucucgucucuuuucuuuucuuuuuuuuuuuuuuggggacagagucucgcucugucacccaggcuggagugcaguggugcagucucagcucacugcagccucugccuccccauuucaggugauucuccugccucagccuccccaguagcugggacuacaggugcaugccaccaugcccagcuaauuuuuguaguuuuuuaguagagucggggaugggaggguuucaccauguuggccaggcuggucucgaacuccugaccucgugaucugcccaccucagccucccaaagugcugggaguacaggcaugagccacggugcccagcuugagagcuugucuuuauuaaaaaaaaauaauaauaauacguguucauuaauaaugguuaaaguagaaaaacaaaaagaaauaggacaccaccuacaucugaaacccugggaagauccaguuaauauuguaguaaguguccuagaaugccuaucuugcugaagaagucauguucauaaagagagagauguucugccuuuuuucaccccacuuuguaauagaucauaacuauuucccugugucaugauaguauacugcagaguggcccuguaguauuuuaucauacaguguuuugcuaucguaauuuauucauucagucuuuacauaguggauucuacuuguccuacaacugaaauauguacaauuacauucaucuaauuacuuuucuagaacagugauuucauuggauaugcauuuuuguuauuuuuuuuuugagauggagcuucucucagccacccaggcugaagugcaguggugugaucuuggcucacugcaaccuccgccccccugauucaagugauucuccugccucagccuccugaguagcugggacuacaggcgggcguguaccaccacaccuggcuaauuuuuguauuuuuaguagagacaggguuucaccauguuggccaggauagucucgaucucuugaccucaugaucugcugccucagccucccaaagugcugggauuacaggcaugagucaccgugcccggcagacucucuuuuuuuuuugagaugaagucuugcucuugucccccaggcuggagugcaaugccaugaucucggcgcacugcagccucugccuccggguucaagcaauucucuugccucagccucccgaguagcugggauuacaggugcaugccaccacgcccagcuaauuuuuguauuuuuaguagugaugggguuucaccguguuggccaggcuggucucgaacucccgaccucaggugauccgcccauguuggccuuccaaagugcugggauuacaggcguuagccaccgugcccggccggggagggacuuucuagcacaaaaguaauagaagaaauugcaaaaagauacuaguaugacuuaagagagacuuaaaaaauguccucuauuucaagugguauaaacaaaauggaaaaagcagucauuugcuuuuucuggggaaaaugcuuucaguagacaaaggguuaauauccuuaaccuauaagaaacucuugcaaaaagaaaaagcaaaguaaaaguaggaaaaaaaaaagaaacucuuggccgggcgugguggcucaugccuguaauuccagcacuuugggagggcgaggcagguggaucacaaggucaggagaucaagaccauccuggcuaauacggugaaaccccgucucuacuaaaaauauaaaaaauuagccgggccuggugacaggugcccguaaucccagcuacucgggaggcugaggcaggagaaaggcgugaacccgggaggaagagcuugcagugagccgagaucgcgccacugcacuccagccugggcgacagagcgagacucugucucaaaaaaaaaaaaagaaagaaagaaacucuugcaaaugaaucagaaaaacccaaacacguacugaaaaaaauggguaaaaggcacuuacaguucauaaaagaacuguagacacauggaucaaagaaaucaagaucaaaaccagaugucauucuuuacaugucauauuugcaaaaauuaaaaaaaaaaaaacaggcggggcacgguggcucacgcccguaaucccagcacuuugggaggccaagacagguggaucacuugaggucaggaguuugagaccagccuggccagcauggugaaacccugucuuuacuaaaaauacaaacauuagccaggcgugguggugcgugcacguaaucccagcuacuugggaggcugaggcaggagaauggcuugaacccgggauguggaguuugcagugagccaagauggcaccacugcauuccagccugggcaacagagugaaacucugucucaaaaaauaaauaaguaauaaaaaacaaucuaggaauggcaagugagguuaacgucauauucuuucuuuuucuuuuuuucuuacucaccgcugcaccaaugaagaaauacauaguuuucuuccguugugcuuugucaguuugucugcauucccagaaggaauugggaagcuuuuucauuucccauuucuuacgaggaaggcugggaaauaacuaagaauuugucugggccuagcaccuuuuggaaaagaguaauuugcuuuuguaauuuucuccauuuauuguuacuuguucagguuuucaaaaaauaguuuuuggccaggcacgguggcucacaccuguaauccagcauuuugggagaccaaggcggguggaucacuugaggucaggaguucaagaccagccuggucaacaugaugaaaccccaucucuacuaaaaauacaaaaauuagccaggugugguggugggcccugcaaucccagcuacucgggaggcugaggcaggagaaucgcuugagcccuggaggcggagguugcagugagcugagaucacgcuacugcacuccagccuaggugacagagcgagacuccgucucaaaaacaaaaacaaaaacacugaaaaaauagcuuuccccccaaaauugcccauuucaucaagauuuucaagugcauacaugugccucuuuuguaagaccuugaaaaaaauacaaacauugggaaugauaguauaaggauaaaggauauaaggguaguauaagguuaaaaauaaacuuaaaaaacaaaaugccaaagcaugaagaauauguaguguuugaguuugcccuuguuuucagaagauauuugucauauucaggaaguaucuuuuaauuugcauugaagauauuugguuuuugcuuuuuauuuauuuuuauuauuauuauuuuuuuuauuuuuugagacggaguuucgcucuucuugcccaggcuggagugcaaugcgcgaucucggcucaccgcaaccuccgccuccuggguucaagcgauucuccugccucagccuucccgaguagcuggaauuacaggcaugcgccaccaugccuggcuaauuuuguauuuuuaguagagauggaguuucuccauguuggucaggcugaccaacuccugaccucaggugauccacccaccucagccucccaaagugcugggauuacaggcauaaaccaccgcgccuggcugguuuuugcuuuuuaaaucaggaggaaguguuuugucagccuuuuuggcaucuacugaauugauagaaugauuuggcuguucaaagguucuggccuguuaugauacuggcccuggcauucucuccuuccugcuuuugaagaguuaacaucccuuuuuaaggaaaugauguugagucagugguagauguuaaauaacauaguaagauacacagauggcaauucuguaguauuucuuccccaguuuuuuguugaauguuuucuguaugaagucagugucuggaaaccacagcauguaguauguacuuuugcacauccuaauuaagaagcaacagaagcacugugaacagauucuugagaguucagcgggccuugaugggggaaagucauguggccaugagugugucccaagugauguuuccucugaccugccgcagcgcccaggcuuugaucucagccccguagccuugcgugcaaaggacaguuuucauguuuccagagugcgguggaacccacgaaugggaggggcauucagcggagcgcucugccagaaguucaagguugcuuacugauagcucagucuuguuuuuguuuguaucgugauuccuucuuaacuccuuccucagagauuccuuucucaaaaauguauuugcauguucccaguauuaaaaccucugacccaguucugugguuuggucucaguacuuguucugugcaguaguuaaguccuuccagccaucuugccacucagcuuagaaaaauacucuccaaaaacaugucuuuaaggagucauaguacuuucgcuuccccauucagaauuuuccaaugauuuguagcuaaaaaugacauucuguuaauuugcacuuugcccucauggagccguuuuuaauuaauaguuuuuuaaaggauuugcaaaagaagcauacacauguugaaaaauaauucuagcuugucagacuuguguuuaguaaauugagaaggucacacgaucuuuucuuauguccccccaccacuucaaagcaguuugaucuguauccuugccagcccuguucuguguacacaaaugcauacuauguaauuauccuuuuaauaaaagugaaaucauaaccacacauauuguacaaccuguauuuuucaaggaacuguauuuguuauuauaacuuaacugaaaguaagccauucuuuuaaagugucucucuuguuuucuuuucucauguucuuuucauuauuccucuugacuagacauugauggaugucaccuuugugccucccuucugacauugcaaauuucugauaaacauagcuuaaggcuuggcauaguggcuugugccuguaaucccagcacuuugggagccgaggcggguggaucaccuaaggucgaguucaagaccagccuggccagcauggugaaaccgugucucuacuaaaaauacaaaaaauuagccaggcaugguggcgggcaccuguaaucccagcugcucgggaggcugaggcaagagaaucgcuugaacccgggaguggagguuguagugagccaagauugcgccacggcacuccagccuggcugauagagcgagacucugucucauuuaaaacaacaacaacaacaaaaaaaccccaaaaaaccccccaaaaacccccacauagcuuaagauagauuuauguguagagauuuuauuuugagaaauaaauuacuacuuuuuuuuuccuugcaugcaaaauguuuuagaaagggaaagacaucaauuucuucauucacguucuaauaauuuaaagugaguauuuuuucccaaauagcacaagaccaguguuuaguuuccaaaauuaaaaaaaaaaaaaagacucauuaaugguuccuugaaggcuggacugguaccagucugauggcauuugugugcuauuuaacuuggggccguuggcgauuguugaugcuaacuugcccaagaacaaaugguaaaaguugaugucucaacauaaggauuuuccagugaaaaucuggcuaaacuguugguugccuugcacguuuuucuucacaagggagggccaggcucauggcuggggcugggauggcuguucccaagacagccacugagucaggcucuggguucccuuuauuguggaacauaugcauagguacaagaguggauaaaacauagccguuuaauaaauaguaaaagaaacaucuguguaccugcucauaucccaguuugagaaacagaaugugaccggcuuuuugagaagcacccuccccgugugcuaguacauuuuuaagaggcuuuaacagaaagugacuuauuuauuuauuuuuuuuaaaucaaagacccugugcuagggaauauggaguuuaaaaguuaucaauggagaaaucccaacugagugcaaaucacuuuuuuugcuuuuguuuugagauggcguguugcucuguugcccaaguaggacugcaguggcacagucauggcucacugcagccuugaccuccugggcucaaggaauccuccugccucagccuccugaguagcugugacuacaggugugugccaccacgacgagauaauuuuuuuuuuuuuuuuuuuguagagacaagguuucacuauguugcccaggcuggucuugaacuccuggccucaagugauccucccaucccagccucccuacaggugugaaccaccgugccuggcccaaaauugcuuuuuauuuauuuauuuauuuuugagacagagucucacucugucauccaagcuggagugcgguugcacagcucacugcaaccucaaccuccugggcucaggugauucuccaccucucagucuccugaguagcugggaucacaggugugcaccaccacacuuggcuaauuuguguguguguguguguguguguguguguguguguuuuguagagaccacccuauugcucaggcuggucucgaacuccugggcuuaagugaccugccugccuugaccuaccaaagugcugggguuacaggugugagccacugugccuggcugaaaaguuuuuuuauagguguucuaaaauacuaucuuucaaaauacuuuguagaaauggagaguggauuuuuaaagaauugagggugcaguuugugacccugccuagagacaggcuggggccuuggaggcaguccauaaaaaugaaguaguaauagagcaaauucuaggauugggcauggcugggugaaaaauagacuccauucaugcagaguaccuccugcuagguuuguuauuacuuuuaauuuaccauuugcuuuucuccagcuaggucuugacuccacuaacggggacuucucauacggcuuugaacuuggaccuuggugcauaagcaaauguaacucagcgaauuguaauggaaagcauauggacaggucuacgccacaucacuuaggugcguguaaaacacaaucuccaguuguguuuccuuuuccuuuucuuacuuuuucugaaacagguucuugcucuaucacccaggguggagugcaguggcacgaucacagcucguggcagccuuggccuacugggcuuaugugauccuucuaccucagcuucccaaguagcugggacuacagacgugagccauggugccuggcuaauuuuuaaauuuuuuuuucuuagagauggggucucacuauauuaucuaggcugguuuccaacuccugggcucaagcgauccuccugccucuaccucccaaagugcugggauuauaggcuucagccaccaugccuggcuaguuaugcuucaugguagaauugggcuggcagcucuguagcauuagaacccuuuuguacuugaccuuaccuuuguacguuuuuuacguguugagaacggucuaaaugcacaaccuuuggaauaaugaauuguuagguuaaugcuaaugauaagguaauagacuucuuuaggccaaauuccacgcaaguagauuaaacuagaaaauaaacaggcacagucuugccacuuauauuaauuacaaaguaggagguaaauauuuucaguuuucuuucaugcuuuugacuuuauuaucagcaaaaauuuguugaguaccuccugcucuuggcccuccgugagguuuauacgugaggaaccuggaguggaaagagauuuaagaauuguuuccucaccccuuuucaagcauucucugcaguuuaauuaaugagacuaaccacauguacauuacucaggagcauucuuuuuuuccuccuucuguuguuucccuuauccccaaagcuugaugaacauuuugauuauuuuuaauuuuuugcuauuauaagcaauacugcaaucaaauuucuucuuggggaaaacaucuuagcaguaguagugaugggcacagugcaugaccuuuuaaaauuugauacauguauagguaaauuauccuucagaaaagccgcaaguguuucacaucugccgauacauucucucagauacucugcuucuggaugugguggugcacgccuauagucccagcuacucuggagacugaaacaggaggaucacuugagcccaggaguucaaggauuuagugagcucugauugugccagcgcacucuagccuggguggcagagugagacccugccucaagaaaaaaaaaaaaaaaaaaaggaugcugucagauacauugacuuguuaaaacuaaauuuauucaguaugguggauguaaaauguuaugucaguguuguuuuaaaaaaauuuuaugugcaguaaaauuuacuuucuguguacacuuauaagagcuuuuacaaauacuuagaggggaucacuccuuuuaaaaaaauuuuaagacuucuaauaaaggcuggguguaguggcucaugccuggaaucccagcacuuugggaagcugaggcgggcggaucaccugagguccggaguucaagaccagccuguacaacauggagaaacccugucucuauuaaaaguacaaaaaauuagccaggcaugguggcgcauaccuguaaucccagcuauucgggaggcugagguaggagaaucgcuugaaccugggaggcaggagguugcagugagccgagauugugccauuguacuccagccuggguaacaagagggaaacucugucucaaaacaaaacaaugacaacaacaaaaaaaaccaaaaaacacuucuaauaaagaagucucuacuuacuacuaaaaacaaaacaaggccgggcacaguggcucacaccuguaaucccagcacuuugggaggccaagguggguggaucaugaggucaggaguucgagaccagccuggccaacauggcuggugaaaccccgucucuacuaaaaauacaaaaauuagccaggcaugguggcgcacaccuguauugcuagcuacucuggaggcugaggcaggagaauugcaugaccucaggaggcugagguugcagugagccgagaucaugccaucgugcuccagccugggugacagagacagacgucgucucaaaaaaaaaaaagaaaaauacacauccugaccuuuuuaaugauuuaccuugucaagccuguuuucuuaguucugaaggaagaggacaccuggcucuuuucuuagaggucaccuuuaauaccaggucuuucuuugaaaucacucccuuaguucauccauuuuucucauuggcauuuucaccauugcaguugccaaggucauuuuccuuggauuaacacaguagcuucuugauccccauuuugagauuauccugugguggacgacugcucuccucgccugcccagaaacucauguugcaugaagccguucuguguugaguuugcuuuucaaggcuacuuugacuccacaaaggguuuucuuccuuugccucccuguccucugaccuccaggugcugggguuaggcuguuguguucagcgcccaaaagacgcaucauaugccaccuaccucuggaccuccguaguggcaucucucuugggauucccgccaucuuucaaggcuaacccuaaucucacuuccuaaaagucauuccugacaacuuccagccuggaguuccaguguccuugagcucuccugcccagcucuaugguuguauguguuuucucugauuugcuagguguccggacuguacaaucagaugggaaagagccucagcauaauguaucuccaucuccuugcuccagcccaccaagggcagucagggaucuaguuggaugguuggugucauuccauuugccuugagaugaucaguacagauccuaaaauaucacggucuuacuaaacugagaaaagaggaggcuugcucguaccuuucguuuuugucauuaauaacauacaggugauuguugagugccuggcuuucauagcugagaacacccauucugcuuggugccugaagccugcagacugggugcaugguucugguugaaggguauuuuagcauuugcuagaaccaccacagaugcugcggaacucaguuauaaacuggaucaaacacuuggagcagugaagagaauuuucuauuuuauuggugccugauuuccaagaggccuauguaucgggaaauccugguguuuuugguuuauagacuuugugcuguugacgucaaugucucauuuucucauuaccaaacaugucguauaaaaauguuguguugcuuaugguuugaucaguagcaaagagaauuaaauauuuacuggagaaauugggugguuucacaaaccuauguaaacacugauggugauuacagagcuuacauaagaagguaaggaaggaagauggaacaguuguguaacaguuacuaugaaagagauuccaagcaaauuagaacaagucuggccuuuucaacugguuauuuugaaaaaucaacauguuaguguuggauuaagaccagcuguuuauaaauugucuaaguuguuugcugauuuuucuguaugguguuaaaaaaaaaacucaucaauaaauuugucccaugacuucuaaugauaauccuuuuuaaauacacauauuauuuuguuuuagguuugccauaaacuggaacuugcagaucaauagcaauaaagccuuucuggauuugaguaauguuuaccuuuggaugggcccuguguuuauuuagauuucuuguacugguucugggcuucccucaaagagccccugccuccagcccuucugaccuuucaucuugugcuucucguuagcacuggauucugcuucuggauuucugcuuuggucucuuuuauaucugcuuccuucccuccucucaguucuguguguggaaaauuagguuauggcaccugcuccccaucauguaaucugcccagcugacuguguaggauauuaauaauaggguugucuuugauguuuggauaaagauggccaugccuguguguguguguguguguguguguguguguguguguguguguguguaaaacuaucaaaaguuuacacauccauaggaugugaucuuaugauuacccugguugugugcacugaaauagcauuuucucuuucccugguauccacguauuuuagacuagcagugccuaauaccauuauaauggaagucacauauguaauuuugagguagcuacauuaaaggaaaacaagaacaauuaauuuuaguaauauauuuuauaagcugauauauuaaaaauaguauuucaacacaaucaauauaaaguuauuaaugagauauuugcauucuuuuuuauuuucauagcaacccuuugaagucuauuguauauguuacauucauagcacauaccaguuggaccaacacguuuaagaugcucaguagccaccuggggcugguggcucccgcauuggauagcacaguuuaaaccccacauagcuuuacuuaccacugagcaauauguuuucaacuuccaagcucuuggauuuuucaguauuucauaauguaagccccuucuauuucagggacuauguaauaauacauacucacacuugaaugaugcuacuaaagcuuccccuuccucaccuuuuuccuuucaaauuuagauuuucuguugccuggaaaaugcacaugaaccaguucaacaaguaaauugaucuccccugcugcccccuaccccagucuauauguauauuuuucuuuuuuacccaagaaucacaaauacguucuauagcuuauaauuuuauuuuuuuggaggggacagggucucccucuguuauccaagcuggaguauggugguaugauuauagcucaccgcagccuugaucuccugaucuucccuuuuuuuuuuuuuuuuugagauggagucucacucagucacccaggguggagugcaguggcacaaucuugggucacuuuaaccucugccucccagguucaagcaauucuccugccccagccuccugaguagcuggaauuacaggcgcaugccaccacgcucagcuaauuuuuguauucuuaguagagaugguguuucuccacauuggccacacuggucuccaacuccugaccucaagugaucugccucccuuggccucccaaagugcugggauuacaggcuugagccaccgcgcccggcugagggugaugcuuccucuucagcuugccugguagcugggacuacaagcaugcaccaccauaccuggcuaauuuuuuguagagacgggguuuugcuguguuacccaggcuggucucgaacuucugggcucaagugauacgccugccuuggccucccaaaguacugggauuacaaaugugagccacugggcccagccaguuuauaauuuugacaaguuaaaguuugguugcaaugaaugagucucauuucuuuuucaaauaaagaagaucuaggaaaugugaagaaguauaguaacuaauguuagauaaagacagcccuuggaagaguugagauccaagaauaaaaaggauuuaaggaaaaucaggaaccccugaacacaguagguuuaccgaguaugaagagcgcuuaccuuuugaccacaccuuugguuuccuaaguuacucaggugccaucagcaagcccuuaggaaugauaaauuuaggcuccugguuaccaggaaacucuagcccucccagcgcucucuccgggagcacacugacuauaucaauaggguguuuuuucucagcacugguguugacugccagaauuucucuucuaguuugucuuaccuguauauuuauuucaguguuguccuuagauaauggcucaagcuuuuaagaauuaugaaagugacauauguacacuguagaaaaauaaggggaaaaaaaaccacauauaaucccaucaucuggagauaaucauguacuauuuugguguuuuccuccauuuuccuuucuuuuuuuuuuucuucuuuucccuucucuucuacucuucucuuccuuccuuuuuuucuuuucuucuuuuuuuuuuuuuugagacagagucuugcucucaucacccaggcugggaugcaguggugcgaucucacugcaacucuaccucccgggugcaggggauccuccugccucagccuccugaguagcugggacugcaggagugugcuaccacaccuggcuaauuuuuuggugucccuucauuuucugcaugugugcacacacugaaaugggauuaucagguuuguuuuguaagccugucuuuuucucagcuuaauaaugcacuccuuacguugccacgucagucacccauguuuuaaucucuguaauaugcucauauaagaaugugcccacaauuguaccaaccaguccucuauuuuaggcauuaauauuuuccccuccgguuuuggauuacucuuaagcauuauuuuaaugaacacucacaaaaugaaaaauuuaagccuguuuuaauuauuuugcuaggauaaauuccuuaagaguaaaauuguuaggucaaaggcuauguguauuuuuagagccuuugauuggugauguuaaauuaccaucuaaaaauguuaugucugggugcagugguucacgccuauaaucccagcacuuugggaggcugaugugggcggauugcuugagcccaggaguucaagaccagccagggcaacguggggagaccccaucucuaccaaaaauagaaaaauuaguaugugccuacaaucccagcuacuugggaggcugaggugggaggaucaccugagcccaggaaggucaaggcugcagugagucaugauugugccacugcacuccagcuucggcgacagagugagacccuaucucaaaaaaaaaaaaauaaguuaauggcaauuauuacucccacuagcaguauauccaaagugcuugcauguuaacgggauguuaaaaauuauuuacuaaauuuacaauuacaauuuguuguguaaauuauaaaugguacauuuuauuuuauuucugccuuuuugauuuuuugcuuuuuuugagacagagucucacuaugucacccaggcuggagugcaguggcacgaucucagcucacugcaaccuccgccuucuggguucaagugauucuggugccucagccucaggaguagcugggacuacaggugugugccaucaugccuggcuaauuuuuauauuuuuaguagagacgaguuuucaccauguugggcaggcuggucuugaacuccuggccucaagugauccacccaucuuggccucccaaacugcuggaauuauaggcgugagccaccgugccuggucagauuuuuuacauuuuuuuuuuuuaauaagaaagcuuacauauggucauauuccuauuggcaacacagagaaucauauuaaaggaguuauggcagccuuagggauucuuauagccaugcagacuacuuuuaaguggcugugacuaagggguccugaagccagcaugccagagcaccugcuuuccugacuugguggcuugcuggauacaucuuuagguauauacccuucgcuuauuuucugcugaucacaauuuaggaacuggauagacccagaaaacguggaucccugguuggcuucaugaacuugagaaaagcauaacuuuggauaacgaaggacauuuggcaugaauugugcuccuugcuuugggagaauagcaaagagugaagugagugguuuggauuuugggagauguggaaaggauuugcugaggaauugauauuuacauucuccagguguugcaguauuuccagguagagggaauagcaggcuguguccuccagccuuaauucaacuaccacuguuaguuuugaagccuuuuuccucuuugccaucaucuggcaacuuuuuuugagauagucuugcucugucacccaggcuggagugcaguggcguuaucuuggcucacuugcaaccuccgccucccugguucuaagcgauucuccugccucagcccccugaguagcugggauuacaggugcaugccaccacacccggcuaauuuuguauuuuuaguagagaugggguuuuaccauguuggcaaggcugaucucgaacuccugaccucaggugauccauugccucgaccucccaaagugcugggauuacaggugugaaccacugcgccaggccaucuagcaacuucuugaccuuucuuuaugccccuugaauguuggcuccuggccugccacauuucuuuccacugugucuucuagcaucaucucucagucauuggcuuauccggccacgggaccucacugaccuuuuaccuuuugcagguaguuuuacuuccaguuuauaucagcucuccaaggcccagucgucucccagacagcacuuugggauccugagcugggagugugucuacacacccuguccucccuagcucucauuccuccccuucauugguccuggugcuccagcucuguggugcucucuggcuuccucuugccuccccaguccuuuuuaccugcuauggacgccacaggaaaucacguggcugccaucuuacuaacauggucuccucccucucugagcugucuccagaacuugucaagcucccucagugcccuggucuuaacuauucuguuuuuuuggggcgggggugguugaacucugcuggagagaaaccagauaacaaggugacuuucucuauuucauauuaugaguucugggcucagcuggacuuugauuuuuuuuuuuaaaauaauaucauuuuucucaucguuuuucuucuuccauagucacuucuguccaaucccauucccagccuuuuuacucucagccaugaccucugcuucuuaguucauuaagaaaacaagugaucagauaagcacucccccaacuuccugcccuucucucaccucaugcugccuugcauaagggcaacugucuacguacaucucuacccacagaggcuaugaggcaaucacugcagauggucuguguggaacuguccgaacaaauuccaaaaguuuuccuaucaggguuauaugagaacugcuuuucgcucccuguggcuuaguuagagauucucuggcugagggggauauguuuguguuuucauaaaagacaauauuuuagaagugaugugauacuuggaggggguuaaaucauccccaaaauuaaaucuccucccaucauuaauggcacagucagggcuggaaucucagucauguguucaguggccuguccuuaucugaaauaaaaauacuuuagaucaaggguguccaaucuuuuggcuucccugggccacacauaaaauacucuaucacuaaugauagcugaugagcuuuaaaaaaaucgcaaaaaaucucaaauguuuuaagaaaguuacgaauuuguguugggcugcauucacagcuguccugggccgagagcuggacaagcuugcuuuagauaggccccacucugggggauuggagauaaagagggcguaaaauuuauuuguaauuaaaaaaauagauaggccaggcgugguggcucacgccuguaaucccagcacuuugggaggccaaggugggcggaucaugaggucagggagaucgagaccauccuggcuaacaaggugaaaccccgucucuacuaaaaauacaaaaaauuagcugggcauggugacacgugccuauagggagaauugcuugaaccugggaggugcagguugcagugagccaagaucgugccgccgcacuccagccugggcgacagagcgagacuccgucucaaaaaaaaaaaaaaaagaaaaagaaaaaaaaaaaaggauguguaaucagaaugugcaugaggacaggccaggcagggagaauaagccuccuuccugucugguccuugucccaguuuccaucucuggaggcagccacuuuuaccaguuuuuguguguucagacuguauauccuuuuaaagauagauagucuuugguuaaacauuugcuuuuaauugugacauuucaaauauaaagaaaacuaaagaaugaaaacuuaccugcuagauacccagaccuaauaaaucuaaacaugucauuuuugcuucagguauuuuguuuuugcuuuuuaaggaaauugaaacauuucagauaccugguuuguccucucugcuagccucaucucccucuuucucuucuucccagagguaccuuuacaguccgugucuuuacuuuuguguuacaugcuuauauauucacaaaccaacauauaauaaugauugcgugauuuaaaaccuuaaauaguagaucuugugugugugcgugugcgcgugcgcuacaaccuacuuaaucacucuggaaaauguucccaaauguugguccaaguagcuagaguucguuuauuuuaacuacaguauuuuauuucauugauuaagcauagcauaacuuagauauucuccucuugacauagcauaaugaacagaaugacugucuucaucuggguggguuucucuggggugaaguaugcuaacuggccuugcuggaucauagugcauacacaguuucaaccaacuaaauauuagcagugguucucccaaguauuugaaccaauuuucuucucugucaacaagauacaggaauuccuguuuauucacagucuugccaauacuucauauuacuaaacucuuauucuagccuuaucugaugaaugugaaaugauaauuguguuuuaauagagauaggccaugugguuuguggauauucacuaguugauguuuacuaguuaaaggugaauguuguuuccagguuuuggcuauuauaaauaaagccgcuagaggccagguaugauagcucacaguuguaaucccagcacuuugggaggcugaggugggagaaucucuugagcucaggaguuugagaccagccugggcaacauagcgagaccucaucucuacaaaaacaaugacaauaaaaaauaauuagcugaguauggcaguacacaucuguaguucucucuacuuaugaggcugaggugggaggauugcuugagcucaggaguuugaugcugcaaugagcuaugagccugccacuguaauccugccuacgugacagagagagacccugugucuaaaaauaaaaauagcugauauggugacucacgccuguaaucccagugaucuggaggucaaggcgggagguuugcuugagcccgggcaagagccugagcaacaugacgaaaccucaucucuacaaaaauuagaaaaauuagccaggugugguagcgcacaccuauagucccaucuacuugggaggcugagaugggaggaucacuugagcccgggagguugaggcugcagugagccgugauuguacuacggcacuccagucuggguagcagagugagaccuugucucaaaauaaauaaauacaaauaaaaaauaaagccauuauuaacauuuauguacauguucuugucugaacguaagguuucauucagccauagaugcccaggaguaguauugcugggucuuauggaaacuuauguuuaacuugauaagaaaugaccaaaugguuuuuccaaaguaguuguaccauuuugcauacccacccaagaguaugagaguuccaguaacuugucagcacuugguauugucuguuuuuguucuagccauuuuaauagguaugucauacaccauuuuuuuuuuuuuuugagacagaguuuugcucuuguugcccaggcuggagugcaauggcacaaucuuggcucacugcaaccucugccuccuggguucaagugauucuccugccucagccuccugaguagcugggauuacaggcaugugcuaccaugcccagcuaauuuuuuuuuuuuuuguauuuuuaguagagacggguuucucuguguuggucaggcugaucuugaacuccugaccucaggugaucugcccaccucggccucccaaagugcuaggauuacaggcaugagccaccacaccuggcccuuucauacagcuuuuuaauccaaagaaugaaacuuaaaaaucaaauuguauuuuaaaguuauuuaaaguaauugauuuuugcccuucuugcucuuggaugaucuuuuuuucuuucucuuuaauucaaaaucagagcauuguguuaggguaaccaaauaguaaagagaugguauaguacagcguaacauuugcagcuacucagccaggcgcgguggcucacaccuauaaucccagcaauuugggaggccgaggcaggucgauugcuugagcucaggaguuugagaccaaccuuggcaucauggugaaaccucaucucuaccaaaaauacaaaaauuagccagucucauaacccggucucaaaaaaaaaagauaaauaaacauuugcagcuacugcuagaaaauuagauaaauguauuuuguugcuaagaaauacauagaauuuuucauuuacuaguuggacuauuuuauuucuggaaaauguauguuaaaacuuuauagugaagaauguuaaaccuccauuuuaaugaugccauccaccuacuggugugauuucucccccuccccucuaggcuuuaaauaagauuuaaucugagaauacucauuccaguacuaaaaagagaagugcagaaacuacaggaguagggcagcaaucuuauuuuacagaggcauuuucggcucacugguuaaugacuuuccugcacauacugcaccaugcauggucuccagugaggggcacggaugccagugcagugaugcuuuaccacuaacccuucuacugcagccugcuaacuaggacacacuguaaugugagucuugagcuggaagggugcagacagucuucacaguggauuugcuuugagaguuggaugaaguguuuuuacuucauugcuggaauugugguaugugcuugucagcacacauucugaaucauggcuugagauuaugguugaguggccagguuuugaguggccaggcuuuaagugucugccaaagaagccaauuuaauaaguuuuuuuuuuuuuuuuuugagauggagucucacucuguugcccaggcuggagugcagugggacgaucuuggcucacugcaacuucugcauuccgguuucaggggauucuccugccucagccucccgaguagcugggauuacaggcgcccaccaccaugucuggcuaauuuuuguauuuuuaguagagaugggguuucaccauguuggccaggcuggucuugaacuccugaccucagguaaucugcccgccuuggccucccaaagugcugggauuacaggugugagccacugcgcucagccuguuggguuuuuuuucuuuucuuuuuuuuuuuuuuugagguuauaguuuuagcugcucugacaugcugggauaagaccaucaaaguuuuuuccucacauaaucuaucccccucuuuaaaauuucuagaguauugauucuuauuuuuaaaauuaauuuuuagagauagugucgcucugucauccaggcuugagugcagugucaugaucauaguucacugaacguugaacuccuagguucaacccauccuccugccucagccuacugaguagcugggauaacaggcacaccucaccaugcccagguaauuagaaaaaaaauuuuuuuguacagaugggagucuugcuguguuguccaggauggucucaaacuccuauccucaagugacccuccugacucaagccccccaaagcacugggauuauaagcauaagccacuaugcuuggcuucuuagaguauugauucuuuuacauaguccaaggugguuccugcagccaguaagaagagggaaggaggccgggcgcaguaacucacgccuguaaucccagcacuuugggaggccaagguggguggaucaccugaggucaggaguucgagaccagccugauuaacauggagaaaccccgucucuacuaaaaauauaaaauuagccgggcaugguggcacaugccuguaaucccagcuacuugggaggcggaggcaggagaaucgcuugaacccagaaggcagagguugcagugagccaagaucgcgccauugcacucuagccugggcaacaagagugaaacucugucucagaaaaaaaaaaaaaaaaaaaaaagaagagggaagggagaggggagggcaugcuuacuuucacccauauccguuggcuaaggcuggcugcaucuagcugcaagggagccugggaaauguugccucaguuaauuuaguugguugugugcccaacuuaaaaccaaggauuuuauuaguugaauuacuaaucgaauggcagagaagggcccacagagauaccugguugccucugacaccucuuaaugaaauauaaaaguugcuacaagaguaagaacagucaguaauuggaagcaaauugaauaugaaaugaaaauguguuuucauuuugucuacuuuucuguauguuugaaauuuuccagaagaaguuuuuaaaaaucuuacauuuagguuucuucuaccaagugccauuagauuucguaacacuagagggugcuguuaaugcauuugcuuuuagcauuucuagcaucugcccccuugucuuauuacagagucaaaguagguuuugucuagcugauaaucuugaaucucuuuuguuguuuuacucaguuuuacaacagcaggggcacagaaaugucaauaucuaacauuuaucuggaaagacagaaaugaugauuccaaauguggaauuaaaagaaaaacacauuuuagauuuuauucauaaaaggaaaacaaaucagagauuauguuaaucagauuagauauuuucaaaugcaaaauuauuucugaagaauuaaaaguuuuuuucuuguauuuguccauauuuagcauuuuaguuguuuugcccuauuuucugcccugaguuuucuaaccauacauacauacuaagaauugagcuauugauaauuuuuccuccuaauauaaggagagggauauaacuaaaauuuuaagaaugcagauaaacacaaaaagaaacacccguaaccccuauauuauagagauuaccaccauaagcugcuuggugcauagccauuuuuuuuuuuaaagcucaaucgcacauguauauauacaguacuuuuuuaaaaaaaaaaauuauuuuucagacagaaucucacauuguuacccaggcuggaguacagcggccccaucucuguucacuacagccucgaccuccacgcucaagcgauccucccaccucaacccuucaaguagcuaggacuaaaggcacugcccccauacccggcuaauuuuuuuguauuuuuuguagagacagggcuucacuauguuucccaggcuggucucgagccccugaggucaaguguuacuccuaccuuggccucccaaagugcuaggauuacaggcaugagccaucgcacccaaccuauacgguacuuuaaagagaggggaaucacgaguuagugcucauguaugggaauuuuuuguauauucauuuuauaacuuacuaucuuucugaaguaucuuauucuaggguguguguguguguguguguguguguguguguguguguguguuuuaacucauuuucuggguagacagaugcauuaccuauaaauaauuauuuugcuuucccuuuuccauuauuugagcuuucaaauucuuuuuucuucuuuuuagagauagggucuuaacucuguugcccaggcuggauugcagagauguagucauuguucacugcagccucaaacucauggagucaagccaguccuccuaccucagccuucccaguagcugggaccacaggcaugcaccaccauguccagcuaauuaaaaaaauaauuuuuuuuuuaaauagagaguaggucuuguuacguugcccuggcuggucuugaacuggccugaagugauccuucuggccucccaaaacaaugaaauuacagaccugagccaccgugcucaaacaaaaucuuuuucuuauuguccuggcuagaacuuccggaacagucuucuauaauggcacccaccagacuccuguuucugucuuuaaagggcaccccucugggugucauucagguuauguaucucauugccuuugguaugagaucaggguucuuuucgaggacuuuuuucuuaacauguguaaugugcuaagaguuuuauucaaaaauugacacugaguuuuaugccuuuuugguuucuuucuuucuuucuuucuuuuuuuuuuuuuuuuuugugauggagucuugcucugucacccaggcuggagugcaauggcacaaucucggcucaacugcaaccuccaccuccuagguucaagcaauucuccugccucagcuuaccgaguagcugggacuacaggcgcccgccaccacgcguggcuaauuguuuguauuuuuaguagagacgggauuucaccauguuggccaggcuggucucaaacuccuuaccucaggugauccaccugccuuggccuccuaaagugcugggauuacaggcaugagccacugcacccagcugaaauguuccuuuuuucaugggguuugaaauuuuccuuguggcaugauagauggugacuuuucauaaaugcucuuuagccauugaaaaugaagcuauuuucuauggggugcaaaguuugauaucuauuauauuagccuuauucauuuuauuggucagauucugugaucaauacaaaauaaaauuaauauggacauggggccuaugcuuguauauccucccuaccccuaucuucuuggagagagauauguuuaugaaguguuggucauuucuucucuauuucuagccauuaugggcuuuauuucagugaaagaauguucagaauguaaagacugacaucauauucuucuugugaauuuuauccuuuagcaauguaaaaugacauccuuucuccugcuuaauacuuuuuggcaugaauuccacugugucugacauuuaaaaaauaauaaggcagcauuaguguuacuuuuuuucacuuuaaggucuaucuuggggguuggcauuuauuuuauuuuuauuuaucuauuuuugagacagucucugucugucgcugaggcuggugugcaguggcauaaucucagcugacugcaaccuccgccuccugcguuuaagugauucuccugucucagccucccgaguagcuaaaacuacaggugugcgccaccacacucagcuaauuuuuguauuuuuaguagagaugggguuucaucauguuggcuaagcuggucuugaacuccugaccccaaguaaucugcccaccucagccucccaaagugcuaagauuacagacgugagccacugcauccggcuggcauuuauuuuuugaugcaaucugaguauuuuuaauuaaauggguuuaacucacaggucuagcuguguuuuagucuguauucuguuucaaauucuaauagugguuuuaagugaaaaacauaaaaaaaaaccucguuucucuaauugucauaguuaaggccuaugauucuuucuguuugggagaagggcuuuagcaucuucuuacucucuguuuucagucuuuauuaauguaaucuuuucugucugcuuuauuuaauuacauuucuuuuuuuauuuaauuuaauuuuauuauuauuauuuuugugauggagucuugcuguguugccaggcuggagugcaguggcgcuaucuuggcugacugcagucuccaucucccggguucaagugauuguacugccucagccuccuaaguagcugggaauacaggcacgcaucaccacgccuagcuaauuuuuguguuuuuaguagagacgggguuucaccauguuggacaggguggucuggauuucuugaccuugugauccgccugccucggccucccaaagugcugggauuacaggcaugagucaccgcgccaggccuuuuuuuuugagucucguucuaucacccagguuggagugcaguggcacaauuucggcucccugcaaccuucgccucccggguucaagcaauucuccugccucagccuccugaguagcugggauuacagguacaugccaccacgccuggcuaauuuuuguauuuuuaguagagauggaguuucaccauguugaucaggcuggucuugaacuccugaccucgugauccaccugccuuggccucccaaagugcugcgauuacaggugugagccacugcgccuggccuauuuaauuacauuucuuauauagcauauguuuagagagcaauguggcuuaugcauugcguuuuauaaccagguuuacacucauuauuuagcuuugucccuaucuugaugguuuuagcauccaugcuuagcagucuuguauacuaguuaguggccucugugaauuccacuucuauauuccaaccugguuggaauauagcuucaggcuuucuuucccuccuuuucuuuugagcucaugcacaucuaaaacuaucuuguuuggcuuucacacaugaagggcaccuuaucuggguauaaaauuccuuguuaagaccuuucccucaguuuguguuuguguuauugucuucugacauuuaauacugcuguggacaacccaggugcuaagcuuaauucaagcuaacacuuaagcaaaccaaacauuuucuccucccuggaugugucuacgauucuuucauccugugguuaaauuauuuugcuaggauguguccaaguauaugauuuugcaugaaccuagaaugcccuuuuagucccuuuacucagauuuuucuuaaucucagaauaguuuuuuagucuacaucuuuuauauuagguuauugaagucugcuccauuuguucuuuuuuuuuuuuuuuuuuuuuuuuugagucagagucuugcucugucgcccaggcuggagugugguggugcaaucuucgcucacugcaaccucugccucccagguucaagcgauucuccugcccucagccucacaaguagcugggauuacaggcacgugccaucacacccagcuaauuuuuguauguuuaguagagaugggauuucacuguguuggccaggcuggucucaaacuccugaccuuaggugaucgucugccucagccucccaaagugcuaggauuacaggugugagccaccacacccgaccucauuuguucuuuuugaaaaaguuuuauugagguguauuacacaucaugauagucaucaucuuaaaauauacaauuuagugguuuuuaguauacuguuauucacaaagcuguacagccaucaccacaauacaauuuuagcacuuuuuuucauccugcagagaauccuaaaacccaugaauagucacucccauccccaccccagccccaggcaaucaucgaugaacuuucugccucuggauuugccuacucuggauguuuuguguaaauggaaucauacagcauagcuggcuucauugccccuuuuguuucuaagucugcuugagaggcacugaugagucacagcuuggccuuguucuuugcuuuuuccugcccagcucugucucggaauagccuuagccuuucuguaguuuuccuugucucucagaguuucucaggucugucacccaccuccguuucagucuuuugugaugccauuucucuggcuuacuucugaguuagugcugguucuucauuucccuacuguucuuccccaccucagcgucuuguuuuugauccauuuucuccauauaauugucaaucuuguuuccucuuuuaaaaaaauaccaacuuaaaaaauguuuuucuuccuuuauuccaacuguggguuuuuguuuuuguuuuaaauuuucuuuuggcuccugcaacaaaucuucucugauguuagagucuucacagcauguccugaauaccguucuuggcuccccuaggcguguugaccugauggguuggaugugucaugugcggaccuguguucugggcgcuugugguggugggucuccugcccugagcaguugaagcaccuggcucccaaccuucuccccaguuucugcuaaggugucacuucuggucagguggugucauccucuuaucccacugcugagcuccucaaaguuucugugaaugaggaauacuuacagcugcuuuucuccaggaauuguccugguucuuuuucugucuuuaucucagggacucccaucuucuaagaugucccuugcugauggucgaugccucuucugccuggcuguuugucaucugagccucgaguucccuuucuggauuugggaagggcagucugguguuagggagauggaggcagguauuugcauauuccacagggcagagggugcccacugcccagguuccugguaggcccuggcuuggagucaggacugggaagggcaaagucuggccacaggugugacuucuuuccuaguccugaugucagacugucagugugcaugcaucacuuuugugucuucauggguacuuccacuguucaguaggaaucaguggagaccugccugcuggaugccacguugaacuggaccccagcagucagcucuccaaugugacaguuacuuguuggcuuugccuaccuuuuaaugaugaacuccuaccuugagaucugaaauuuuuugagcuuugaaaacaauugucuuugggcccugauuggggaaauggaaacuuaccagguaguaaaauuaaucucccuuuucacugagcuggaagcagcauggguggacuuauucaucugaacugaaggguuuacaaagauagguuuuaauuuuccuucuuagugcagguuugagacguauucucagcagcugcuugguuucuacaauagacuauccagccugccauggagaaaccugcuacagauugauguuaaggaaaccauaauagaggcaugcaguaacuguuuguaaccgggugguggcuguuguguaacacaaauagcauuucuaaugagguggugcgguuauacaauuuuggccagccuguguggguuauaaaagcugaaauuccuucagcaccugagagcgucucaugcugaguaccaggacaaucgcaggguugcacagacaccggcacagaaguggugggugacgcacugauuagaggacauuucuguggaaggguggaguuucacuuugaagguaaggccauuuggcgguucugcuuuggggaaugaguugugaggauauacagauugauuacuaucuguuugugucugugugcauuugggucugcguguaucuguuuccaugugaguaucugaguguuuguaucucuggugauguuucugauuuucuacauauaugucuguuucugugugugugcgcgccugugugugugugacugugccuguguaggugggugagaaguucucaguuuugcacagcugcauuacuagaaaaucuccaaaggguuucuuagugcugucagacauaauuuaaauaucaaaaacugaacauuaacauuuaugcacuucuuagaaggcaccgcccuuagguaugugagagagaauagcaauaaaaacuucaucugcagcgaguaaaauuucuguguuuuucaggugcuuauuuacuuuccagaguaaauaaaguaaaaacgauguaaguaaauuacuuauuuucagaguccaaucuagugccaggauugccaaagcucugcuguguguucuuuuauguuuuccuuuuuuuuuuuuuuuuuugagauggagucucgcucugucacccaggcuggagugcaauggugcgaucucggcucacugcaaucuccgccucccagguucaagcaacucucccgccucagacucccaaauagcugggauuacaggugccugccaccacgccuggcuacuuuuuuucuauuuuuaguagagaugggguuucaccauguugagcaggcuggucucaaacuccugaccucagguaauccauccgucuuggccucccaaagugcagggguuacaugugugagccaccgugcccagccuauguuuuccuucuaugcagaguuucagaagucugaugaaaaguaaguaaacaaccaaaaaggaauauaagugaaacaaacuucauggagagcuagagugucuuauagcugagugcagauauauuuuuaauucuuuuaaggucuuuggguuauuaaaaaaugucagguucagauaccagaaaaaagcaagacaucuguagcauacaauucuaagugauugcagucucuguauuuaaugaauauaauuuuuaaugaauugcuuaggaagaacacacuccugugcaggaaaaagaguguauaacauacaggcauggaauauuuaaagccucccauuuauugaagaucagggaaaagcuuugcaauaauuuugaucaccacguaugugguguuaaccuggggaagaauuagugucccagccccagauaauugcagugcaguuuaggcaaacccacucuucagcccuuagguaaucuauuagagcaggugaaucccucagagcucccuuuuccuuaucuugggagagucugcagggaagaggaacucuugguauacuggacuaguggggagcaggggguauggugugguggggagaaacaguacugcacaagagauuugcaaauggaaugucuuccagaugagaccgggaaagugguugguguugagaggacugaauaaaugggccaaaguccagcaaaaccaagcaggcguaauuggguaguuaggaaauagaggcaaaguggagcuggaucuuucucugcaggugaaagaaggaaauuuggcuuugguccuuggagaaugacauggucugaagagcagaucacagagagggcuggugaguccguugaguuacuugagaugcuucucccagcaccugagccugccuucucccagcaggggcagcucuggcaacaguagcuggaggugaccaagugcccuacugaggcuuccucuucagggacugugcuggaaagaggauggagcaggcaucccagacacagugggacugaaucagcagggcacagccaucuccuggaaguuauccaggcucccaagauuuuuguauugggugagccagggggagcaucaaaugacaaaaggcaucuggagaccuggaagagaagaaagcauucuuucuauucccugaaaguaacucacaaauuuuccucagcuuccuucagaaugacuuuuagauaugaccuucucaggccuauucuggucuuuuggccuuuucuucagagucucguucucuuagcuuggaagguaacacgaacaacguuugucuuccagaaugauuguuggacccacaacauuggcccugagcuuuuuugcagagauaaaucaaccucucugugcuccaguuucucaucugugaaauggagagaauaacaaccccucccagaauuuuuauaagggcuaagugaaaccauguuugugccugggacuugauaguucauuaugcacauguuuuuaucuuguuguuaaaauuccauauaaaauuagcuuuucaguggcuccugugaugacugaugauuaauacauuuuaaauaguguugaaauaaaaagcaccaugugugcaaaaagugauguguuaaaucacguaguagaaauaaaugcaauaaaacucaucuuuguucugcuuuaguuugcuaaaauguacauucagauuuuaauuuugucaugcaggcugcacuuuuugcuauacugccccucccuuuccccuuucacgucccagccacaagauuucccugaacgagucagggauuuccccaaguauuugaaugccuuuuaugcauuggacacugugucccugcugccaucucauucugguggggagcggacaggaagcugggaaccauggaaacacagaagacggacagcugacccaggagugcucccuggaggaggaggucucuugagcccagaccugggaacucuggaggucagcgugggcagugugggcagcaccuggcacugaggagaaauggccaggaugacgaggcuuaagauggucuuguuauaauuuuauuuaaauaaaguuuuggaaagaaaacuucugcugaaagauaccagguacaguaggcgcuguagcaucuguuugcuauagcauuagguuagaaaaagaaagacugcggaugacuuuguaucuuaaacccccaaacaaacaaagcauacaccacucugacauuuuacuuucucagacuccaucgcucuucugaacaagcaggcaaaugaguuaucgucuugucaccuagauaccaugaccaucaccuuucauggcucaugcauaauucgauggcagcaaaaugacgugucucaggcuggacucaggagcuuuuuuaggauuuaguguugcauuugggacuagagcuugucuguaccagagcuucugggacuaagucuuugggcuggacugaagggaucuucuguaggcagagcccauucuucaacaucuuguuucauucugucaguugugcauuuuacuuuaugugccauaaacuauuugcugucaguuaggaaugauccuccccacccaacucaccccauggauguuucaggaaaauuucccacguuuauccaguggcaucgcauccucucuggcccacuggugaggaccugagaacccauuuuuagauuauuucuaacuaguacaguguuugcccagggacccuuuuuuucuacagucagagcaggguugcuacugucaggaccccucuuggggcccugggaguggccucuaagggaucauuacuccuggggcucgcuacagauggaaacugguuucugagauggaacuuggcagugguaccuauguucccucucagaaauccagguuuuaucuggcuuccuuuaaaacauuuccaacucuuaaaagaauuaaguccacaaacugagacagugacagaaggcugagauggcacauuagggugcaaaggagauuccuuccauugcagucauuggggguaguuugguuuagggcucugguagauuauuguaauuaauuauaaggccacccuggugcugcaauucuggguacccccuccaucauuguggcaggggaauaugaugauauuuugucaucagugccaucaucuuauaccgcuuucucacuuuggcacaauauuucuaugggcauguuaguuuaaggucaguaaauaaucugauuuaagucgggcacuuggaacaugccuuucaugucagugugcagaguuuuuccaucagugacuugcagacucuuuuccccugacccacagcaugaagcauuuuaccuugacacucucgguuaccccugucuuuugagauaugcucugaaguuuuuuguucugucaaaugccauuguuuuaaaaauucuggucaagauccacuaauuuaauuucaugaccuacuaguagguacugacuugcgguuugaaaaaugagcgcuggcuaggcaugguggcucaugccugugaucccagcacuuugagaggcugaggcgggaggauugcuugagcucaggaguucgagaccagccugggcaacaaguagacccugucucuacaaaaaauacaaacauuugcugggcauaguggcgcaugccuguggucacagcuacucaggaggcugaggugggagguugcagugagcugcgauugcuugacuguacuccaaccugggugccagagccagacugugucucaaaaaagacaaacaaacaaacaaacaaacaaacaagaucaagaguuccugcaguguuuuggagaagacugcaggaugauuguuauuuuuuuuuuaaauucagucacaugcugugagcauacuugucaucacaagaucaaauaaucaccacugcuuacaaguucauucguugcugcuuggagcuuuaaauggaauaauuauagcuaggaucagcaucagaauugcaaacucccugaagucggacucuguguauuagguaaccaguuaagucauuucauucaaaggaaguugaucauauacaaguugaagauuuuuuuuuuuuuuuuuugagaauucagagcguuucauucaaaacuagcccucaccacaccuacaaguugagggcauauguuccaacagucuuuucugacuugaauuaaaagcauuuaggucaaauguuagcauuuaacagaacuuaauggagcagccacaguuugauuauaauccccuuaaugggauuuaagcaaagagccauggauuggcuuuugaaaugugcuucaucauugaaccuagccggcccugaaagcucuugugucuuagugagaaccaaaguagcacuuggcaggcugagguuuugaguguccuuaucccagagggcacuccuucuuagucauauucuuccccugucuggauugguuuaaagaagugcagacaauagcuuuuucccagccaagauugccuaucccaaggugugggugaucugaggaccucuagcaugagaauauuugugcauuuguuaaaaauacagguuccuggccgggugcgguggcucaugccuguaaucccagcacuuugggaggccaaggcagguggaucacgaggucaggaguucaagaccagccuggccaagauggugaaacccugucucuacuaaaaauacaaaaauuagccgggugugguggggcacaccuguaaucccagcugcuugggaggcugaggcagagaguuguuugaacccgggagguggagguugcagugagcugagacugcaccacugcacuccagccugggcgacggagcaagacuccaucucaacaaacaaacaaacaaaaauacagguucccaagcccccaagguaggucuauaggauuagaauaugaggaggggacauuuuuaaaauuggugggauuacaggguuuuuuaauucuuuuagucuucuaaagucaauuuuauugcgauaguguuuacauagagcaaguggauauacauccaaauggagccaccagaaucacagucaaaacaguagauuucuaucauuccaaagguuccauccuuucccuggggagcccuuuccuccauucuugcccuagguaaccacucuccgcuucccguagaaugguuugucuuuugagaaucagacugcaugucucgugucuggcugcuuuaacgaaaugucugugcagcucccuugugcugucgggcacgucagcagacgcucucugguuuguugcuaacuagcaugccuuuugauggacccaccaugauuugcuuacccguccaccucuugauggcucuuuggauguuucuaguuuggggcuguuauaaauaaaacagugucaaauuuuugucuuacauguauuugugugaaagaaaucugucuuuuuuuuuuuuuuuuugagacagagucugacucuguugccugggcuggaguguagucgugcagucucagcucacugcaaccuuuaccuucuggacucaagccauccucccaccucagucuccuaaauaacugggacuacaggcggauaccaccaugccuggcuaauuuuucuguuuuuuuuuuuugguagaaaugggguuucgucacguugcccaggcuggucuugaacuccugggcucaagcgauccgccugccucagccucccaaagugcugggauugcaggugugauccaccgugccuggcccagaaguguauauuuuaaauaagcuucccaugugagucuuaagcacaugagccacugauucuuauucuggcucuuccucucucucguauccuuuuggagaaguguggguuuuugucuagagcaaaugauggauuugccauggauuuauauuucugauauaguauuuauucagugccgucuacuuggaguaaauguaaauuucauuagcauuuauggaacaucuaucuucuccacaccgccccaccccccgcccuguguacuuccuuguaaagagcaucugucuauucuguacuaggagcugggaauauaaagaugaauuuuauguuuuauuuuuuguagagucagagucucgcuauguugcucaggcugaucucgaacucuuggccucaagcaaucuucccaacuaggccucccaaagcguugggagucacugugcccagccuuaaagaugaauuuuacauagggggauucuacucuuugggcagacuauuagugauuaauucauucagccauuggaggguuucuguguuaccugcucacucugcuaggugcugaucaugaaaggacagguuuuucuuaggauuuggugguucuuucgagaaacacagaagguuuugguauuuaacuccacgaauagcucagcucugaaaacuucuggacagugccaucacauuucuccuucagguggcccugcuaagccacagugagaggggugacucuguuuccuggacagggagagauggucggauaaaaugaaguucaaaagaaaucauuacaggcugaauagcugaugaaacaaguacugauuaaaagcuucugcauuugugcgugauuguugguggguggagagcuagugauucaguccuuagggaauuggaagauuuguuacacgucuaaauauuuuauuuuacuuuucuacuuccucauaacagaauuuuccagauggcugauuuuuuuuaucugucagguuuacauuuauuuccaggcgacuuuuuuuuuuuuuuuuuuuuugagacuguagcgauuuccugcuuccuuuaagguagugauuuuuaacuuuggcugcagggagcuuuaagaaaucuagauaccaaguauaauuuguagcaccuuggcuuuucuccacucucuucugaaacccaaaguuauuuuagaacuuuaaacaugaggacauuauuccgcacugcuguauccugagcucacagcagaaaggacugaauugauuugcuugcauuacauuguaaaggggguagaugcuguaaggggaaccagccuuuccccuggacuugagucugaggaguaaggaagaacuggugcuaauguggacaccaugaggcucuuaggggugaaauugggcccaucuuuuguaguuaaguuaguuuagaaaauauagaggaguaaaaacaggaaaauaagucauuuguguuucuaucacucaacauuuugguuaacauuuugguguguguauacauggccacauacuuuacacauacacaguggguuaaugcuguacauacuaucuuuuucauuauauauauugcuuuuaauucuuuucacuuaugaaauaacuuuuuucacucaaaacuaguaucuucuaccauucuuuuuauuuuuuuauuuuuauuaugauaagaacauuuaacacgagaucuaccuuauuaacaacuuuuuuuuuuuuuuccucgagacagagucucacccugucacccagacuggagugccguggugggaucuuggcuuacugcaaccucugccuccuggguucaagugugucuccuaucucagccuaccaaguggcugggauuacaggcaugcuccaccacgccuggcuauuuuuuauauuuuuaguagagauggguuucaccauguuggccaggcugguuucgaacuccugaccucagguaaucugcccaccuuggccucccaaagugcuaggauuacaggcccagccgacaacuuuuugaguguacaauaugguauuguuuuguuuucuggcuaauuuaaaaaaauuucauuuuuuguagagauggaaucuuacuauguugcccaggcugaucuugaacucuuggccucaagcaaucgucccacucuuagccucccagaguacuaagauuauaggcgugcaugagccaccaugccugaccgacguauuguuaauuauaggcacagugugguccagcagaucucuagaauuugcucauguuguguaacugaaacuuuuuuuuuuuuugagacagagucuugcucugucgcccaggcuggaguguaguggugcaaucucggcuuacugcaaccuccgccuccuggguucaagugauucuugugccucagccuccuaaguaguugggcuuauaggcgugcaccaccacgcugagcuaacuuuuguauuuuugguagagacggguuuucaccauguuggccaggcuggucuugaacucccgaccucaggcaguccuccugccuuggccucccgaagugcugggauuacaggcgugagccaccguaccuggcaaccuaaaaccuuuaaccuguugaagucaguucuccauugaccgcccccccaagucccuggaauccaccauccuacucugcuucugcauuugacuauuuuagacgccucacguaaguggaaucaugcaguauuuguccuucugugacuggcuuguuucacuuuauggaaagauguucacccuguguuauguaaaaaggcaaguuaaaaaauaacacauauauaacaggguaaacaucuuuccaugucaauaaauauuucugugcuuucuuaacaauguuaaaauguagacguuaggucuuacuuuuucuggauuuuguuacuuggugguaaccaauugucuuggcauguauaguugguuuuaugauuugaagugcugccauaucauauguacaucaguuuuuggguuuuuuuuuuaaugacuaauaguuacuuuguuuucauacuuguugaacuucuguuuauuacaacuuuacauuaggguucuuaucucacugaccacacuccuccuauuucucaaauauuuguggcuauccuugcuuauuauuauuguuguuauuuugagauggggucucacucugccacccaggcuguagugaagcggcaugaucuuggcucacugcaaacucuaccucccaggcucaagugauccaucucagccucccgaguugcugagaccacaggugcaugccaccacacccagcuaauuuuuuguauuuuugguagagauaggguuuugccauguuacccaggcuggucucaaacuccagagcucaggugauccaccugcuuccaccucccaaaacuguugggauuagaggcaugagccaccaugccuggcccuugcuuauucuucuagaggauuuuuuagcaagcuccucugaccuguuggggggguauuaauggauuuuuauuaaaucuguguagauuauguuaauuggaaaaugaauauucuuacaguaccuuuccuaucgaagaguauccucuguuucuuugguuuuucaaauccuuuuuaugucccucaguaauauuuuaucguuuucuucauaaaggucacacauauuuuuauuuaauuuauccuuaaguauuuaacguuauucuugccauggugagcaggauuccuuuauccuauuauugucaggcaugggcaaaccuuucuauaaaugucuuuggcuuuaggggccaggugaucucagucacauguucuucuuugcuguuguucacaauccuuuaaacauguaaaaaccauuuuuagcagggaccuuaacagaaacaggccagaugguggcuagcuagcugcugauacagaugcuugucgcuggcauuugggaaauguuugauucaaucacaucgaaagaggcuugcucauguguuuuguaacucgcuauguaauuguagguucucugagauuuuucauaucuuuugauguaguuauaauuuggacuuuucuaauacuucccucaucuuucuuggucgguguacauugaugguggugacguugacacccccgacuuguuccugacaucuguugugucacagauagguuugauguaguaagauuauuaaacaaaaccacucuuacauuauaccacaugccuuaaaaaaaucauuuaucaguccacaaacguuggagaaccuuuaauauaugugccaaguucagcaccagggguggagguaagauggugaggcugugauacuguuucuuucuguuucccacagcucucuggcuaggcagacagauagacaugaucuugcuuuguuacaaucaucuuuuaaaauuuuaccuuaauuuuuuuuuguacagauggggucuugcuaucuugcccagguuguucucaaaguccuggccucaagcaguccuucugccugggucucccaaaguguugggauuacagaugugagccaucacacucagcccuccacaugguccucugacaucaugaugagguggugaucagaggaaguauugaugggagucaccccagugagaaggggugagaugaagggggcuuauuuuggagggauggcaugagcaggguccugagagauaggagaggccugugaguaaccacaguaggggccaugagggacugggaaagggggccuggauaggccccauagucaccucuugugaaggaauuugggugucacucuaaauuaggaagccaucaaagagcaugguaauuuucuguugaagcaucaugcuacuuaccauuuggacaaguguuuagagccaucaagauggaaugaggggcccggcaugguggcucacgccuguaaucccagcauugggaggccaaggugggcggaucaccugaggucgggaguucgagaccagccugacuggccaacaucuacuaaaaauacgaaauuagcugggcaugguggcgcaugccuguaaucccagcuacucgagacgcugaggcaggagaauugcuugaaccugggagguggagguuguggugagccgagaucgcaccauugcacuccagccuggggaacaagagugaaacucugucucaaaaaaaaaaaaaaaaaaaaagauggaaugagucuggauuacaggugcaguggcucaugccuguaaucccugcacuuugggaggcugaggcaggagauugcuugagcucaggagcucaagaccacccugggcaacauugugaaaccucaucucuacaaaaacuagccagguguggcacaugccuguaguccuagcuacucaggaggcugaggugggaggaucaccugagccugggaagucaaggcugcagugaacugugaucgcgccacugcacuccagcuugggcaacagagugagauccuaucucaaaaaaaaaaaaaaaaaagauggaaugagaacacgaguuaaguggcuguugugauguugaugagagaccauggugaugugugcuagggagcagccaugcaggugaauagaagugcauauguuagagaguuccuaguccaaggaggguggguaucagcccuggaaaaggagcuugaaggugauuccugccccucagugcccccucaaaaaucacaaggagggcaaaaucaccagcaagucucacagaggcaguguguauaggccagcuggccugggcuguguuuguccagggaaaacagcuguaagcugagcauuuaaagggcaguuuuaugucuuguauaaacaguguaauggcagguucagauuacugauucaaguuugaauccuguucuacugccuauagcuguguauacuuuggcaaguuauuugacuucucugaagcucaguuucuacuuuuguagaguuugugugcaaaccaaguaauauuaugcuuacuggccagaaauaacugucauuuauuuaauaagaggucagagaagugccuggcacacaccgacacuuagcaacuggaaaauugcaguuauuacugccauugucgccaucaugaucuucuaucccucugcuccuccuuccccacugucauguauuaaggccaagacagcgaguggauuugcucauucucuuucucucuuuugcaaaggguaggaaaaggggcaaugagggaccacggguuggcacacacacuuuccccagugucaaauucccggggagauuuugcuucuuguuuuaauacagaaguuaaacuccacucuucccucaccucuccccuuuuaucuguugcauuuugccgcuggaccuuggcauuuauacacaccacgcucauccuguguggauaaacccucugaucucggguugucgcauacuuucugaccuugagagugucugcaucauccuugugcaccgggguguggaaugcucuguccuuuugggcuuuuuauggcguguccaaggacacauuucuuugcucaccccuucuucguucuuccuccauguacugucccugaugaaaggugcuccccucuuccugagcccugcaguccucuucccugacgccuuucucagaacaucacugcucugcgcuguaugagucucauccucuccugugcucuuucaggucuaaggcuucaggauacuccaggcacuacucuggaagaggugggugaagugcauuagugguucccccacuguagcuuaugagguuaaauuaaaugcgugguggagaaauggagcacaguuacuugcuggaagguauucuugucgggauggaacuguguguuccuagcgcuggggacgguggggagggguuugcugcugcaguggauguucaugucuggaacaccaagaugaacuuaaccuaggagaguaaauuuauucugcuuuaaaaagucccaucaguuuccuuagccaggcauggugacuugcaccuguagucccagcuacgugggaggcugaggcaggaugaucgcuugaggccaggauuuugagaccagccugggcaacauaaugagacccccucucuuuaagaaaaaaagucccaucauuuucccuaaaguugauauagauaagggugauuugaaagcucugcugacaugcuagaugugggacaaagagcuuauuggucccuuggaaugugacuauauggcauguggccauguaaaaaucuaccaguauuucacuauccuauuugcccguuuuauuuucugaaaaaauaaacuucugguggucucaaggcagagguccacuguggcuccuucaggcagauuuuauuuuuagguauguuuauuuucacucuggguuuuuugcagauuuugggaagaugauggguggcaguggcuaacucacaauguagaaggcugauggauuuggcuacacaaacaugaugacaacucuggcagcucaaaaggucaucccccaaauucauaaacaaaaagcggggauaaaauguuugcaucaaauacaacaaagauguaaaggauuaauauccuuaaaaugaagcucuguaaacauuauagaaaauaggcgaaggacauaaggggauaagccacaaaagaggcucugugguugccagcagacaugaaaaacucaugaaccaaggcauggcaacauaucugaaaaauuacccacuugcacagauuuuuucuacauagauauagauauauauuuuuuuuaacuuuaauuuuaauuuuuuuuugagauggagucucgcucugucgcccaggcuggagugcagugguaugaucucggcucacugcaagcuccaccucccagguucacgccauucuccugccucagccuccccaguagcugggacuacaggcgcccgccaccacgcccggcuaauuuuuuuguauuuuuaguugagaugggauuucaccauguuagccaggauggucucgaucuccugaccucgugauccgccugccuuggccucccaaagugcugggauuacaggcgugaaccacugcgcccggccugcacagauuuuauauauuaagggcuaucagacuuugcaguguuguagugaucccugcgguagaguuucauauccuuauuaaacagcagaguugugaugaaugaauuaggaccuguaaguggcgggggcuguggcaggguggugggaccccugagguggucuggauguggcauuuuaggcucugcauucauuucucucuggaugcuguaaacaucacuuuuuccuccaguuuuuacuguuaaugauaagaagucugauguuaauauuaucuuuccuuugucaguaagcugcuuguguugguaugguuucuuuuuuuuuuuuuuuuuuuuugagacggagucucgcucugucgcccaggcuggagugcaguggcgcgaucucggcucacugcaaacuccgccuccuggguucacgccauucuccugccucagccucccaaauagcugggacuacaggugcccgccaccacgcccagcuaauuuuuuguauauuuaguagagacagggcuucacuguguuagccaggauggucucaaucuccugaccuugugaucugcccaccuccaccucccaaagugcugggauuacaggcaugagccacugugcccagccuugguuuuuuucugacaagaaguuucaagauuuuuuuuuuuuuuagacagagucucacucuuuugcccaggcuggaguacaauggcgcaaucuuggcucacugcaacguccggcucccagguucgagugauccuccugccucagcuucccgaguagcugggauuacaggcgccugccaccacgccuggcuaauuuuuguauuuuuuaguagagacgggguuucaccgugcuggccaggcuggucuugaacuccugaccucaggugauccacccaccucagccucucaaacugcugggauuacaggcgugagcuaccacaccuggccagaaaauucuuuuuauaaugaccaagcuggaguaagucccauagacgugcuucugugugggcuuugcugucucugcuauaugcauguuccgaguguaucccuuggaggaccugaucuuguccuuaggauuaacauggcacaucugggaugccauccuugggaggagggaagugucuuuaaaugaagauuucucaaucucagcccuccugaaaucuuggugugggaucuguccugugcauugaaggauguucagcagcacaccuggccucuauuuacuagauguuaauagcucuccccgaguugugauggccaaagacaucuccagacauugccagauguccccugcagggcaaaauuacucuggauugagaaccacugcuuuaaaugaauguggauaguacgugaaugaaaaugcaaaugugcaugaauaugcaaacaagaacgaccaccccggaagaauuugauguguguaccuagcucuccguauuccacucauggaacuucacguucuggcagcaguuucuuuguuuuccuuuuuggccuucugauuucugaacucuaaaauuuguguaauucuuucucuuuuuuauuucuuuacauuuuguuuuuccccuggcucauccaaaguguuuauugaaugaagugucccaugaagaguuccucaaacagcaaguucuguacuuguauuuccaaacuuauugcaguccuguccucacauuugcagggcagcuugguuggauucuuuauuccuagugggaagauaauuggugguaagaucugaugucacccuaauuggaguaccaggggaugcacucugcccuucccacccuuaccuguuugcauuaucuuuuucuuuauaaaaauucaggcauagcuaggcauauuucauuguauguaugccauuccuuggagggauccucugugcccucucauuuuuuuuuucuuuugagacugaauuucacuuacucuaucauccgggcuagagugcagugaugcgaucuuggcucacugcaaccuccgccuuccagguucaagugauucuccugccucagccuccugaguagcugggauuacaggcgugcaccaccacuccuggcugauuuuuguauuauuauuauuuuuuuuuuuaguagagacgggguuucacuauguuggccaggcuggucucaaacuccugaccucaagugauccaccuaucucccaaaaucuuagcuucccaaagugcugggaguauagguaugagccacugcgccuggcaaccuccucuuuuuacugcuuuugaguaucuuccccugcuuuuaauugggcacauguagggaauguagaauuauuuuaaugcccaucuaaucaugauuaauuggcuguauccgcauugcccaguauaguagccacaagcuacaaguaucuuaaauuucuauuuaaauuagauacaauuaaaauucaguuacucauuugcacuaagcacauuucagguucucaguagccacaugacucuguuggauaggacagauauauaacaucucccucauugcagaaaguucuauuagguagugcuggguuaugagauauaaaccauaugcauaucaaagaaguaccuuagcuauuuuuuuucucccuaguauugugauauuuuugauaguuugguuuaguggucccccucucuagugggcaauucagaaucaguaggugacuauaaauaaagaagguguugggugccugaaaacuguaauuagguaaaguauuuuuuggaugcuuggguauaauguguagugugacuuuuuuacugugcaagaaacucagugacugcauggccuguguuguuuucaugcuuuggggugauuuggcugugcucuucuuuucuaggugcuaagagaugccguuugcaggccucaucucugcuugagaaucgggggcuccaggcacuagaagagccggcugauccugggcuccuagcuugaauaagccuucacuuccagcugcucuccccaacggcuguguaaacuacucguuucucuuaaugauggguauugguaagaauaccacauccaaaucaauggaggcuggaaguucaacagaaggcaaauacgaagacgaggcaaagcacccagcuuucuucacucuuccgguaaucauauuccccaucuuccuuucuuaaaucucuugaaaguaguuuccguauggaaucaacauaggauuggcuuuaaugcucauguuuucagugaagguuaaggcauuugcaaaccaaauacuuuauaugugagauagucuuugggcuaacucuuggguuuuagcugugcucucagccuggagucaucugcugggauuaacuccaggaaggaaguaugcauugcuguuaacauuuuaaaucuagcccagugcuuacuguguccuggaggauguugaagacuuaauuuuaucuucaaaagguguacucuuaggaaauaaugugcaacccaacaucacacucauauugcaagcugggaggaugaaugacuuacugcuuggaaccccacuguccauauguauuauggcagcaguguccagcguagagguaguuuuauccaaauaagugauagcagucagauaaggcugauuacacacauucauuuauauucaguaagaacauuuuuuucccagauguaggacgaugacuugauuuguauaaaguuaccuauaauguguugguuuaaaaacagaaaaaugcucuuuagagaggucuugccucaagauguuuuccucuuaauacuggagaugugguuaauggcaagaauaguauucuaggauuuuuuucuuuccuuuuuucuuuuuuuugagacaaggccucgcucuguugcccaggcuggagugcaguggcacccuuaaagcucacugcagccuugacuucccaggcuugaacuaucuucccaucucagucucccgaguagcugggacuauaggugugugcagccuguagucuaccacagcuggcuaauuuuuucuacuuuuuguagagauggggucucacuguguugcguagucuggucuugaacuccagggcucaagugaugcucucgccucagccuccuaaagcacugggauuauaagcaugagccaccacaccugguuucaagauuaguuauuauuaucaauguugcaucugaaacuguuggcaugccccauagccugaugauaaagagacucaacaguaagacauuugaggguagauggaucuacagaggugucaguauuauuuuuuaagacugggucucacugugucacccgaguuggaaugcaguggcacaauuaagacucacuguagccuugaccuccugggcucaggcaguccucccaccacagccucccaaguagcugggaucacagaugccugccaccaugcucagcuaauauuuuuuauuacuuuuguagagacagggucuccuuauguugcccaggcugguuuugaacuugagagcuugagcucaagcaauccuccggccuuggaggauucuuuuuuuuuuuuuuuuuuuuuuuucuuaaaaaaauaacaguuauuuuaagaaaaauauauuuuaagaaaaaaauaaaaguuauuuuaagaaaauaacuuuucuuaaaaaaaaaaaaauagacugagucucacucuugccuaugcuggagggcagucguacaaucauaauggagcuuugaauuccagggcucaagccaacugacuuagacucuugaguaguugguauuauggaugcaugccaccaacccuaacuugaacauggcaucuuuuuuuuuugagaccgucuugcucugucacccaugcuggagugcaguggcaccaucuuggcucacugcaaccucugccucccaaguucaagcgauucucccgccucagccucccgaguagcugggacuacaggcaugugccaccacgcccagcuaauuuuuguauuuuuaguagagaugggguuuugccauauuggccaggcuggucucgaacuccugaccucaggugauccaccugccuuggccucccaaaaugcugggauuacaggugugagccacugugcccagcugaacauggcauuuuuuaaguacauugauugacugcuuucguucacacuuuauucguuuauuuuuuuaaauuguauuaauucucagagagcuguuuaacuaauuuuacaacuggcauuaccauuuucuuuuuuccuauaaugaaaaauuuugaaacuggauuuucuucacuguugaaagcuuaagguugacacagauuuucuaggggaagaggcaucaguccaguuguucaagauuaaauuagaugaacuugaagagugaaugggaagguuucaugcauggggguugccucaucucuuugguggcuuuauuuuaucuuacagcccaggagaugauucacucucacuucccuucacuuucgggacaagaacuugaacaugucucaaccaccugccuugucauuaugguccagaauuuaagauuuacuuauucuagguuaaacuuguaguauuuuaucguuagcaguugaauucaucauuguauguugucagcuuccucauuccuuguuauuuuuugcguucuucuucuucccucuuaguuugcuuuucauuuaagauacacugauggucuguggauggucaccaucuuagucuuucuacaucuggaaauaauuguaguuugcccuccacuauuacacagacuucugugaaugauacggcccagccuuccagccuguccucauuucucuuuagcugcuuucucuaaugauuuggguauccucuuccagcacugccuucuggaugaguccuucaguauuuuccgguuuacuuauuuuuuguauacagucauguauuuguguugaauucuuauugcaauaauuauacuucuucuaaaauuuuuauuugguuaacuucugccuauuuuugguccuuaauuucuuauauauauguguuucuuuuaaaugugacuucauuuaaaucauugggaacccugauauacuauaugaagucccucccuaguucucuuuccaucuggaaucuuccaggaauuucaucucuuucucugugcuucugugggguuugugucuucucauuauggauccaguccagaggcagacccuaggguggagcccucguugucuuccccaggguugccaaccauggcauggaagaguggggaagccugccuggccugguucagcccccaccuuguuccccugcuggagccgaggcugccuggcuuagggcuuccaggcucagcccagcaggucccagugucagccccauuuuuuuccauaaguguuuuuuuuuucuuuuucuuuucuuuuuuuuuuuacacagggucucauucuguugcccaggcuggagugcaguggagcaaucacagcucacugcagucucgaccuccuuggcucaggugauccucccaccucagccuccugaguaguuaggacugcagguacgugcuacugggccuggcuacauuuuuguguauauauauauuuuuuaaauuuagagauggcauuucugcauguugccaggcuagucuggaacuccugagaucaagugacccaccugucucagccucccaaaguguugggauuacaggcgugagccaccgugcccagcccauacauguuucuugcguacggaaauguuugucuuuuuaagcuugccuauuuugagguuuuucccucuaucccuguuacauuuuuuagggcaggguugggaaggaauacugcucacagcauuaauuuccagauccaaccuaaguaggagucccugugagagcaugggagcugggaauguggacguaagccauaguuggguguaaauaugauguuaauuauaaaguugauuuaacaguagagccauuuaauuaaggauguuauggaauuuuuaucccagucuagggcuauaaaaggaagccuuaaaaggggaagaaaauaguuuuuaaaauuaugcuaaauugaacuacaaagaguaggaauagagcuggaaucaugggauggagcugcugggaggggagaaaugccaaggauagagauggcagagaguccaaacaugagcucccaggaugauuuggugucagggaugccaagaugaaccuuagucugaacucccaaagcucaagauaaaguagauuacauaaaagaaggaaaacacgaaaacaaaaccucaucaaagaauguuuacaaaggaauaguuugugggauggaguuuuggguuguggauaguuuuguuagaaaacauguuauaggcugggugcggaugcucaggccuguaaucucagcacucugggaggccaaggugggaggaucacuugcagccaggaguucaagaccagccauggcaacauagcgagacccucauucauaccaaaaauuuaaaaauuagcuggacgugguggugcaugccuguaguccuaccuacuugggagacugagaugggaggauucuuugagcccagagguuugaggcugcagugaguuagcaguugugucauugcaugccauccuuggugacagagcaagacccugucuccaaaauauauauaaaauaagaacaggaacacaguacugcccguauuuaaucacuagugaaauugcuacccuaagucaacuuuuaaaguagaagaccauuuugaaugauuugcccauugacagggaaaaagugaggggacuaaguuacagugggucgcuucccauugccugauggaugggauuagugugggggcagcugguuggaggcaggggcagugggguagcacaggaagaauuggugggucugggagauaccaaaggcaugggaauaguaagaacagaggugaggcugauagaagaggugauaggagguuuugagggccaaagaaggagauguuucggauucucaucaagauuuuauacagaagaaccugauuggguauauguuggcuuuggagaaaauaugaagucuagggaaaaccauaaguuuggaggguggggaagauggaagaugauggguuuuauuugagaaguuguggauuugaacugcggugcuccuagagccugcaggcagugggggugugggacuugacacacauagagaucaggagagcuguaaagacucacugugauggcucauguggguggugacugacccgugugagagggugcugcuggcaggcagagcuggcagaggaagauaggguugagggucucaccguuggguauacccacacaugagugacagggaggaucaugccaggacauugcugcaugcuagugccuuguuucauucuggccuuugcaaauguaaauauugaagaauagccagcauggcagcucuggguuuuaucuuuuugucuggaucuguacuguccagcaucauggcugcuagucacaugugacguuuacauuuaaauuaaauacuauucaauaaaaccugaaauucacuucguuaguugcacucgucaaguacuccauagccacacguggcuaguggcuagcccaucucugcuugcugguuagggccuugcgaggcugaaauguuggcucuuauuuucucauuugccucagaauccaaagcugggcuuuaggcugucagcuguuaaggcaucuagagaaaggugugcuggagugcagcgugguugggcaccaguaaccaaaucuggccguugcugagaaccaggcuuguggggugucuccuggaaagggaggugggguguguggcugauaaggaucuuaucuuuagagauucucuuaggcauccuguguuggaugagugcuucccagaucuuuaaacaaaauaaaacaaaacacccacacaaacauuuuacaaagaaaaagaacaaauccauacuuagaaguagaauguccacuaggucaaaguaagaacaagagaugugccaggccccaggacucauggaaauuagaucauguggucagaguugauaucaaauagggggaacauagcaaaagaucuucuucuuaucccacaggacucuaguuaggcaaauucuuauguuuuaaagccagcuaggaaaugcguaaauaggggugaaugcccauggcaagaaacaggaaucaggaaaaaaaaaaaaaaaaaaaaagcaaaaaaaauucugaugaacgaucguacccuagggacauugaucccaaaguacagacaggaagcacggccagaaaaaggcuguguguuugcucagcaguucuuggaccaccuaaaccuggaagcccaguuaacagcccaaacuuccuguuggcacaggcacggcugugacacacacagccuguuguuucagugcgucaucauucagagucagggaaagcguuuaagcuuccuuaagcuuuuauuucuuuuaacagccuuugugagaauauuuggguaucaagaguagauuauucugucuggagauauuagcggcauggaccgacgaguaacuuuaugagguuuagucuuaccagagagugggagaaauacuccuggguguucauaagaaccgaccacuucucaucuuaccuugguguguguucuucagaacauguaaugggaagagcccacagccucacguuccuccauugauuaaaugugucuggugcacauaccugguaaccagcugcuuacagcccagugggggacauauggcaagacagccagcauaccaucaguguuaggguuugaauucugcacgggugcugugauaguguccacgugagacccuugcccagucguguuguagggugggccuugccggucagaugaagguucccaggggagauaacauggaacuccuaaaaaaugucuagguauaguaggucaagaggagggagacugaaggccucucagcugagggugugcauggcaguguccugcuuggggcgcaaguuuagugcagaguacaguggagguggagaugagcagcagggaugcugaggagaggucauaguaaauuugcucguuuugggguaggaaauuccugcggugggugccggggcaggaagggucuggagauaggaaggcaaguuagggugcuuacgcaguccaggugugagccgacagugaccugaccuggaaagugcggaggaaaggaauucuuccauucagcagaugguuauugggcaccugcuuugcgugaggcucuguccuggaauuggccuccuagugauggugggaggagaaaaacaguaaagaaacaagcaaauacgucaaucuuguggcagcuggucacuaauucugugaagaaaaauaaaucagggaggggaauagugagaaauagaaugugaggucagacagugaucauacaggaccugcaagccauucauuaauuuguccuuuuaaaaauaggaacugugugccacucacaggucugggcucuagagaacagcaaugaacagacagacaaaaauccaugaguuuccauccuuuuuuuuuuuuuuuuugacagagucuugcucuaucauucaggcugaagugcagugucaucaucauggcucacugcagccucaaccuccuggguuuaagccauccucccaccucagccuccugaguagcugaaauauggcacaugccacugugcucagcugauuuuuaauuuuuuuuuuuuguagagacaaggucuuaacuaugucacugaucucaaacuccugagcucaagcaauccuucugccucagccucccaaagugcugggauuacaggugggagccacuuugccuggccacagggcuuucauucuggugugggagacaggcaauccacaauagaaauaagucaaauguguagauguuagauauugacaaacacuagggaaaaaaauaagguagagguauggaugcugaaaauucaggcggccaggaaaggcugcaccaagaaggcggccuuugaguaaaguccuggaggaguugugggaagccugcaugugggccucaagggcaaaggccccacagcaggggggugccugguguugcuccaccaggaugggcauugaccagagauuccauaggucuugugggccucaccaggguguuggccugaaaaaaaccuuuggaggccuuugagcagagaugugacaugcucugccuaguggggaguaggcugaaaggaaaagcaggaggccaggcaggagcugguggcccuaggacaggugugcugacagcagcugcauccugggugcuugccauguggaggugggagaagccaccaggcucuggagcagaccuaguuucugugcuuuugggcuggaugagggugggggcaagucccuucagaaagagacacccauuccaggcguugaaaaguaugucaggagaaacucugacuccagagggaggacggggaggagccacaguggaggaaggguuggcuggagguguggccgagagcuuugaaaagaaggggcaaguugcuguccuggaagagacuccuggaaggagcuucaggaggagaccuggggccuguggggcuguguccugaugggugugccuagcaggcaggaggugagcaggacagaguggcgaugcggcucagagcugugcugugcaaggaugcagggaugugaggaugccccagagcggaggggaggagggcagccaccaggaucagggacccaugcuccuuucuuuccuuuucuguuuccuucccaucccuucuuuaagacaaguggccuuggcagaaagauguagggagguacagugaagaaaccauuuaauggcugcuucaguuccucuaaaccccugacuaugugaugacagauuugaacaugccccuuuucagcagugaaaagaaggcaaaaaggcuuuuuggugcaacuaccuucauucuaaaaaccaagcaaagaagcccagaacauguccuuguucuugugacuuucguaccaggugcugugaaguuccuuuuuguacaucccuaaauagagaguuuggaguacuuagaucuuaaaacgaaaagucucaguuggaugguaauaauaguugucugggaaaauguucuuucuguaagaauaauagauuuuggaauugacuaugauuccaagaagggccugaggaugaagagagacuguuuccuggagucggcccagggaauugguuuaauucuccuauuucuguaagaugagaguuuuaauauacugcauaauggccaugauuuaggcaggggaugcccuuaacagcuugaaguggaacaaccaagaugagcacccuuuucuguuuuaaaauuuguaaguuggggggaaaaaguguuagaaaaggaauaugccaauauaugcuuugaaaugaaaacaucaaaacgaugggaugcaagugaagauuuuugugcaugguaagauguucuuuuccuuauccauccucccucccucccucccucccucccugccucccucccuucaagauggggucucgcuacauugcccaggcuggucucgaacuccugggcucaagcagucuucccaccuuggccucccaaagugcugggauuacaggcauaagccaccacacccaguccuagauuuuuaacuuaaaaauuaauuuuuuuuccucugguuuugagguuucagauaaguuuaucauauugcaauauacuuuuaauuugaacagaguuuugguaguuuuaaaugaaaugagagauguuaguaauacaaaguacacaucuaauaguugggagacacacaauuuguuacgaaugaaaauaguaagagguucuugcuacagucucuuacuauagcaggcuuacgaaguugaucagcauucuggccaucucuuacuugugugugugugugugugugcuuuuuuuuuuuuaaagacacggucuugcugucacccaggcuggagugcaguggcgugaucuuggcucacugcagccucugccucccggguucaagcaguucuugugccucagccucccaaguagcuagcugggacuacaggcaugcacgaccaugcccagcuaauuuucguauuuuuugguagagacuggauuuuaccauguuggccaggauggucucaaacuucugaccucaagugauccuccugccucggccucccaaagugcugggauaaaggcgugagccacugugcccggccucucaccucuuaauuucugugaggucagguuuauggaaucuuggucauggaaaaggccuuagaggaccucuuguuuguucugcucuugcuaaaugcugugacaggaaugcaucagaaguaguugacaagcuuccuuccuuuccuaccccaugugaucccccugccuucauccugcugucuccgcuuucugugggucagcaucaguucuuccugggaucaucgugacaaccucugugugaucucccugccccacagccuuggucucuucugaccccugauugcuauuccugccugugccuuuugcacuuccaggacuacuucagauuuccuuucuucuaggugaauccccacuucuaaauuccuaauccccacccccacuaacuuuuauuugccuaagcuagguaggcaggcuucuuaguuuuaaugauuagagauaaaauauuucagauugauuucuuuaccauaaucuaagcccauaauucuauuggagaaaaaguucauucuugcuaggauuugauaaaguacuugaggaggaagauaugauauuggagguuucgaggcaguaaucacucaguugucacauuccccacccucuuaaauugcccuuaaaauggauguuuuuaagcauccauaguucucccuagguuuuacgguacaaacuacauuguuggggugaaauggaagaagcaagaaugcugauauguucuucugccucuuuuuuguaguucucauauguguauuuucugucccuuuuucauuauuuguguaacuuucuucauuuacaagagaaauaaguucacugcagaaaaugcagaaugguaaaaugaggaaaacaaauaauuuaaaaucucacuagccagaaaaacaccacuuucuguuauuuugguaguaacagaaaauauuuuacugauauuuuggguguauuucuuuuuuuuuuuuuuuugguugugauuguuguuugagacagggucucacucugucacccaggcuggagugcagugacaugaucauagcuuccugcagccuugaccuccugggcucaagugauccucccacuucagccucuuggguagcugggacuacaggcaugcaccaccacgcccagcuaguuguuauuguuguuuuuaguaggaaugggguuuugccauguugccuaggcuggucucgaauuucugagcucaagugauuggucucccaaagugcugagauuacaggcaugagccacugugcccagccuugauguauuucuuuccagagauuuaagacaaguauuugaguguucuuuuauaaaauucucaucaacacacaaucugcuuuaugaagacuuuaacuuuguaucauaucguggcaucucaauguuauuagaaacagaacuuguaauugugacauauagcaaaucauggaucuaacuuuuccacuugcauugggacuuuggauuguuucuaaugcuuugcuauaauaaauaacagccuaguuuauauugaccuuauuguaucugauugcuuuaauuuugaguuucagugaagccaaacacuucugccagcauuccuuggccauuuauauucuuucauugugccuauucuucucccuagccccuuuauuccugcggaguaauacuggugaucaaagauacugcaucauacagaacaauuacagagaagaucccuggaucugauagcacuuugagggaauagagggagaaccagccgcaccaccagccagaucugugccugucauuacugauagcccuaggauagggggauguuuacucugucucuguuuagggggagcaguuuuuguuguagaaggaagugucuguaucuacagaucugugucuguagcuccguucuugcucuuuucacuuucugauauacagaugauguucuguauaccugugucaguguauaaggauuaucuucauuguuuuuuauaacugcaaagugauccaugguauagauacaccauaauuuauuuaauuacugcagauagacaucuagacuguuucuaauguuuugcuauuacaaauagcacuacccugaauaaccuggcacauaaguuguuucacucagguguaauugaaggauagauuuccaagagugagauuuuugagucagaggggaugugccuugguaagcugagggggcuacucaccaaauugcccucuguugaggaauuucgucagcaauguguaaaugccuguuuucuugcaugcuuggcagcagaauauguggucagacugggcucuugucccgauuaguagguagaaagagguuucucauuauaguuugguggagucucguucuguugcccaggcuggagugcagugucauguucucggcucauugcaaccucugccucccagguucaagcaauucuccugccucagucucccaaguagcuaggauuacaggcgcgagccuccaugcccagcuaacuuuuguauuuuuaguggagaugggguuucaccauguuggccaggcuggucucgaacuccugaccucaagugauccacccgucuuggccucccagagugcugggauuacaggcgugagccaccgcacccggccucucaucauaguuuuaauguauaucuucuuaugaguaagguugagcaucuuuuuacuguucaagaagcauguuuauuuccuuaguuauuuuccuguugggauguuagcccuuuucuuguuggguuugugucccuuccauauuuacauuuuagagacauggguuuguuaucuguaauguguuagcaccuggaaagaaugggagaggacgguccguuuuggguggagugcuguaaugugcugcguggccucaggaucuguucuugaauccaucuggggacaggauccccagggacaucucuuagaaaccucaccuagcagggaagauguuugaagugcccaaccuagugccaggcaugaauaugugccaggcagacaguagcagucaccagcaccaccugccuggggugugggaggagcacacacugcagaguguuucaguguggaccuuggcagacacaucacccgcccgagcucugcugugggccggcauggggagagguaaggcuccuucuggcuccucuugucgcccuacugggggacaggugagaugcagcuggaauccccggggugcuucuggcugccacagccuuagccuucuggagaaggcagcccuaagaagaccaggcugggccaggcgagugguggaggcugagccauccagcagcaucaccugcacuggggaguuacaggagccauccugugggaagaggcagugaaagcaaaauuagaggcuuugcggcaucagccagauucaaggucgcuagugucauguuagaucuaucggcugcugcaucuuuuugagaugauguaaucuagauugacaagcuuuggguguuuagaauauguuguacuguacucacuugaauuuauuuuucauagugguuaauuuugaaauuucuaauaauauugaaaguagguggaaaguuuucauguucauaguaaaggagcuugcaguaaaggcugggaaacacgaaucuauuaucuucuguauucaaaacacauuuuaauuguggaguagauuuggauacaagaggaaauaacggugugugcacacauugaggagggggauuaauaacuguguguuaccuuucuuuuaaaagaauagaaagcagaaauuuggggaacuuuauuacuauucugaaagcgauugguuuaguauaaagugguucucuuagcggccagacacgauauaguaagugggaaauugaguucugaacacucucauuggaggugugggguuuugcaggugcuagugcccuccgcuugacaggugucacgaagcagcacaugcacugucacuucugcuugagaaaugugggcacacacagcugucaguuucgccuggcacugcugugauacugacaccucuaggcaaugacuucugucacuccugcuuccuacaccucugaccaucucaggagaacuguuuagaaauaaguacuuuaauaccauugucuuagcuuaguaaaaauaaaacacaagcaaaaagacaaguguaagacuugacuuugaguguggaaauguguccguugcucaguaaauacaaugcaaaugcaauugcauauuggagacaaaaucaucugguuaggcagagaaaaccuccuuucauagcugauugauuguacaauguuaguuuaggagacaaaacuuaaggccacgaguuuaguuuaagauaguuuuggagaagaaaggacaucuuguucccaaaagggguauacuaaucugcugauauuuuuauaaaaacuugaucaauuuccugaggugaacgaugccaagauucuucuguuaucuauuaguuacccaaaagaaaaccagacuuuauuaaguuuagaaagcuucccaagacauguuuuauuucccaguuaaaauaauauuuaaaaguuccaaaauaugaagcuuugcuacuaucaucagcauuuuaauccuuuucccauaaaaaauucaguccucaagaacugauuuuuaccauuugauuuuuaaaauuaaauuuugcauuaaaaauaggccauuagaguaucuauuuuaauaagccaaaggaaaaaauguugguaagguagacuaguacuuccaguagaacucuucaucuguaagaaccauuuaggcaagaacuauuuaggcagcccccugcacguaaauagaucagagacgagccagucagacaagagcauuuccagcugguguccccgucuuauuacaggcuuccuuagaggauggggguagcauggagaggagagcuacaucucagcugggcaacaggaggguagcagggggaagcugggcucugagguccccagggacagacagcuggaccugugcaaaucauagguuuucuaggucaguaguauuuacaguuaaauaaacuuccuggacuagccuggcaaaguaaaccuuccuuuuuuggaugauuucugugggucaaacacauuuugaauuggcuuacaaacauuccaccccuaccuccugccagucucuuugggacuggcaccuccauccacccagcuucccagcugagaaacccagccuggacacuuuacucccgugcccccugcugugcugugauggcaucuccccgcuguacucaccacagagcucccauccagacaaucuucagggggcauuaaguccacaucauugcucucuccugaagcugacugucuuucccagaccacuguuaacaccuuugcccagcuccugucuccucgugugccaaagggucauuccuuuaccccacccauccacucuccugcugcacccagaauggcuguccagugcuagcaucugauuguggcacuccuguucuuggcauuucuuuguggcuacugacugccuccuguguaacagcggaauuccuuggcggggcacucagucuggacugagcuccugcagggaggcaggacugcauucucauugccugggauacaaccacaauuuguugaaugaaugaauaugugagcuuuuuuucuaggcuuaggagugucugcauuuuauaauacagauguuccuugacuuaugacagaguuacaccccuaaaaugcauuuaauacaccuaaccuacuggcaauucauagcuuaaccccgccuaccucacaugugcucagaacccuuacauuagccuguaguuaggcaaaagcaucuaacacaaagccuauuuuauggugaaguguugaauaucucuugcaguuucuugaauacugaagugaagagcagagggguuguauggguacuugacaguuucuacggaauacauaucacuuuuguaccacuguaaagucaaaaaauccuaaguuuaaccauuuaaguuggggaucauuauacuuauuuguguauguauaaguagugaguggaaugugucaggggagcaguaggaauugcuaacucauuucaaaaucuaucuucuuagugccauguauacagaugauuuuuuuuaauguaucgaggugaaguuugcauaacaugaaauuaaagugaacaauucagugauauuuuaauacacucacaguguuauacagccucguccauuugguuccaaaacauuuucaucuccugcaaaggaaaccccuuacugguaaaguugcuguucccugcagcaacccgagauaaaugcaggugaagguuaguuuggcuagagucagacuuucaaucauaucuagguuucucuaaugauuuaguaacugauccguguuuuaggagaguucauccugagagcguguugcucuuggcuucucaguggguugagcacugcugcgauaugacuuggagcacaguucucucuguaaguuaagaguuucaucucguggaccugaacuuggccaggaauguguauccucccagcagccaguuuuuauagguaaaccagcuccacaaacucaguuggcuuguguaaaaaacuauaacauguuugagaaauaauuuuaaaagcaggucuuuauuugaaguaauguaagagaauucugcucuguaggaguauguacuaauuaauugagaucucuggcauaguuuuuauuuuuauuuuauuuuauuuuuuauuuguugagauggagucucgcucuguugaccaggguggaguacaguggcacaaucucggcucacugcaaccuccaccuccuggauucaagcgauucuccugccucauccucucaaguagcugggauuagaggcgcccaucaccacgcccagcuaauuuuuguauuuuuaguagagaugggguuuugccauguuggccaggcuggucucgaacucgugaucucgggugaucugccugccacggccucccaaagugcugggauuacaggcaugagccacugcgccuggccucucuggcauacuuaaaaacccacuucagaccuagguuauaaucuguaugaccuugaaugagaaaccuaauuuuucacugcccugauuuccuugacuacaaaaacacaugaauugggaaucucucuggaccuccucaauccaagcuguacugcuaggauuuuagucuuaaauuucuucccuauuaucaaaauaaauuguacuuacucauuuuaggaaaugaccaaaauauaaaaaggggaaaaaguuggcaaaaauggcccuaccaauuaaggacaaccacuguuagcauuuuggaguaugucuuuuuuuuuaaauuauccauuuuuaaaaaagcaguauacaaauaacacaaauacauccugaucauaaaagauccaaacacuuacaaaggguugugaguaaaaagaugaaaggugucugcuauugccguucuugucccuaaggcagcacccuuccuacugguugugauuuuccuguaugcuuuucuguccuuuuuagacaagugguggggucauuacaauuuucuuuuuuagcucaguugggauaauucuaggcuuauuguuuuauaacuuuuuaaaaacaguauuucuuggaguuuuuuuuuaauuaguacaucagcuagcuauuuauuuauuuauguauuuauuuagagucgaugucuugcucggucacccaggcuggagugcaacccccaccuuucauguuccagcaguucuccugccucagccuccugaguagcugggacuacagaugugcaacgccaugccuggcuuauuuuuguauuuuuaguagagacgggguuucacuguguuggccagcuggucucgaacucccgaccucaggugaucugccugccucagccuuccaaagugccaggauuacaguccugagccaccguguccagugcuuuauuauuuuuaauggcugauuaucuccucuaaaugaguguauaauaauguaacugugucuuuuugauggacauuuauguuguccccaaguauucaguauuucauaaauuacagcagugaucaaccuugaauauauauauuaccugcauggauauuucuagaggauaagcuucuaugaguauaauugcuggauccacagaaauaccuguuuuaaaucccauugccaaauuucccuccaugaaggccauuccaccaagagcauguucucuccaagaacacaggagaguaacucucccccauaccuuggucaauaccugguucaguuuuuuaaguuucccucuaaguuuguuuuuuuuaaaauaaaauuuuaauaauuauuuccauaauuuaaaaugauauggaacagcuuuucauguguuuuauuguauauauguuuuucuucuaugaaugauauauuccuagcccuugcccauuuccuuuccauccuuuuuccuuaggccucucagggaugaauuggaucguuugguuuuauuauugguuugagguguucuuuacgcauauugauacugacccuuuuuauaucugcugcacuguauuuucuccuaggccaucacuugucuucugcuugcuuuuaguguauuucacaaugccagaauuugaacuuuuaauauacuuuuuaaaucuguaguuuuuaaauguaguugcacuguuaaccauauauacaguuaccuuaauauuuauuacaugugcauuuuccuugauauuacucuguguaaaaaucuuuucccuuguaguauucugggugucaguggccuauaacuaguuauuugagccaugugugguggcucaugccuauaaucccagcacuuugggaggcugaggugaguggaucaccugagguuaggaguucgagaccagccugaccaacauggugaaaccccgucucuacuaauaauauaaaaauuagccagguguuguggugggcaccuguaauuccagcuacucgggaggcugaggcaggagaaucgcuugaaccugggaggcggagguugcagugagccgagaucacgccauugcauuccagccugggcgacagagcgcgacaucgucucaaaaacaaaacgaaacaacaacaacaacaacaacaaaaccuaaaaaaacaaaaacuaguuauuuguuauuauaaacagugauuacuuucuuuggguuaaagcuuuuguucucauuauuguucuccaguauagauuccuagaaguggaaccguuuggcuaaaaaguaaaaauauuuuauggcucuugcuacuggcuggcagaacccgggacgaugguguggccccuuaccgaggaguguucuccagugggcugguuuacuuaggugaacagcaaagcuugaguuccuccagcuagaacauuuccccuucuaggugcaggaagucggccucaggugguuaugugggcagggaucuuaaccgaggcagcucaggguacucucaccuguucagccugggccucguccacaaacagcaugggccucugagccaaacuucccuuccccugaaggaugugggggugccccugcugagguugcccugggauuuuauuucuuuucuccccggcugagccuucugcuaaggcagccuccccauacgguacauggaguauguuucuccaucaaaaccaugccuggucaugcacucaccaggagaauuacaaauggcuuucggggggaggaaaaugugguucacgcugaaacagccucuaaguggauugucucugcagguggugauaaauggaggcgccaccuccagcggugagcaggacaaugaggacacugagcucauggcgaucuacacuacggaaaacggcauugcagaaaagguaccccuuccgucaccccguguccccacucccaccgccauccccucccacaagugcugccccggaucuggauccggaucccuuucagacacuugcauguccuucgucuggggcuuggucucugacucccaaggggcuguguucucuucauaagggaaguaggaggagccauagggaauagaaguuacuaguuuuuuuuuuuuuuuuuuuuugauuguuuuaauggcauuuaaggugagaaccauagaggaggauccagguauuuaaaaaggccucagccaagauggcagagggaagugguuaagagcuugaggucuggcaucaggucugggugcaaauaugagucagacugaggaaauuauagaaguucucugggccucaguucccugucucuaaaaugggaauaaaaaugucaacaucugguuguuuuguggauugaaugaaaugauaugugaaguuauuagcaucgugccuguuacagauacaugugcaguaaauaagagaauaagggaaaucagcaagugguuuaugcagccuaugaaaaugccuuugaguuuugaccguagcaccuuuggcaccuuagugugccaauggaaauggcacacuaagguggggagaaucguguuugugguuuuuuuguuuauuuuuguuuugcucugugccucguuccaucuccuugaauggucagacuuugugaccauagaggucaggauaaaguugcccaaagcggcuccaaucugggcucaguggcucacaccuauaaucccaauacuuugggaggcugaggcgggaagauugcuugaggccaggaguuugagaccagccugggcaacguagcaagauccugucucuacaaaaaaaaaaaaaaagaaauaauuauccagguguggugaugugugccuauaguagcagcuacucaggggcaggagaauugcuugagccuaagaguuugaggcuacagugagcuaagaucaugcuucuguacuccaacugggaagacagaguaagacccugucucuaaaaaaaauaaauaaauaaauucauaaauaaaaauaaaauaaaguagguccagauaucccgauuucuuuuuuucuuuguaucugccaugaugucuaacauaugagaaguuagauaaucugauaucuccaaauuguaucgcagcucugaggcuuucauuugaguuuuacuugauagauuuuaaacacagguuuuauuuauacuaugaaaauuuacuaauuuucagcugacauaauaagaaacuaaacaauuuauguaaugagaaauucuauucuggaaccacuguauuauacuguagacaguguauacuauguauucuaauaacagaccacccagaaguugacacauacaaauauaguaccugaguuggguauuagcauggugaguucacaguguaaucacuaaagugauuaagaacaaauaaauuguauugaaauucugaaauaaccaaauuuuaugcccuuuuaaacaaaauuccagucugggauauggaaauuucauuuuugccucucaaccaauauuguuauuauuuuccugcugcuuggagcuauuauaaauuuuauggagguuaauuaaaguagauucaggcagagauacugaaauuccagaagugcgggguuccaagcugcuccccaaagguuagugcagugguguuuggcauguggauuggugccuguggucugcagcugaggcacaucccacacugccgggccgcagcuuucacacgguccaucuuguaacaaagggcuucuucacagacuuggugggccacauauaauccucuaugccaugauuccaggcugucauguuuucagacuuccuccuucucugucuggagaucgucuuuagaaauaaauagugaugagcauuaacacuuuggggcuuagcuuuaccuuuuacugaugggagggauccaguuguaggaaaaaugucucuagcacauuuaugcuagauguucauuuuccuguuugggugaacauuuuuucauugucuaaacauugauacauuuguauuuccuugaauaccaaugaaauggaguaucuuaauauuuuccuggccauuuuucuuacuuuaugaaaugaggagggcagugagaagagcugcuacauauuaaauagugcuaguugggcugggcgugguggcucaugccugcaaucacagcacuuugggaggccgagauggguggaucacuugaggucaggaguucaagaccagccuggccaacauggcgaaaccccgucucuacuaaagacacaaaaauuagccaggaggggugucacacgccugugguuggguugcagcuauuugggaggcugaggcaggagaaucaccugaacccaggaggcagagguugcagugagcugagauggcaccacugcccuccagccuguaugacagagugagacucugucucaaaaaaaguaaauaaauaaaaugcuagucauuaagccagacccucagcgggcuguuuuuuuuuuuuuuucuugagacagagucucacucugucacccaggcugaaguggaguggcccagucucugcucgcuacaaucucugccucccugguucaagcgauucuccuaccucagccuccugaguagcugggaccagaggcgcacgccaucauaccaggcuaauuuuuuuuuguauuuuuaguaaaguuggggauuuaccauguuggucaggcuggucucaaacuccugaccucaggugauuuauccgccuuggccucccaaagugcucagauuacaggcgugagccaccauacccggccaaaaguaguggaaggcucucaggaagccggauugccccagugugagcagaguggcauguaagcugguuauuaaagagccugcacuggaugugcugcccugugugccacugggccuuuugcugcccguuguuucaaaugcuuaguugcaauuaucauauuaaauacaagauaaaauaaacuugucuucuguaacuuugagaucuacuuuuuuuuguuagagaccuuuucugacuugguccagguggguggcucaugcauguaaugccagcacuuugggaggccaagguggguggauugccugagcucaggaguuugagacuagccugggcaacauggugaaaccccgucucuacuaaaaauacaaaaaaauuuagccgggcuucaugacauucgccuguaaucccagcuacuugggaggcugaggcaagagaauugcuugaauccaggaggcagagguuguagugagccaagauagcacuacugcacuccaaccugagugacaaagugagacugucucaaaacaaaagagaccuuuucugacuugaucccuguggauucucuuuaagcuaucuuuuguuaaaggacuaguuguuccaaaaaaaaaaugacauucauuuuaacaugauugucuaauaguaaacaguccaaaaaauggagaaaguugaaaaugugcccccuacguucuuuauauauucuacguaaccagcggcuggcaaccugauguagaguaaccguccuaaaacugagaucugaaaucugcaauguuccaauaucugaaauuuuuugagcaccgacaugaugcucaaaggaaaugcuugcucauuggagcauuuuggauuugaguuuugggauugugaugcgcaaccaguaaguauuucaaaaucccaaaaaaaucugaaauccaaaacauuuggguuccaagcauuuucaaccuguauguauauuccauaccacuuuccacauagguacacacaaacagaugccccagauguuaacauuuuacuguauuuucuucauccuucuuguaggcauauuauuauuuuugagcuguucaaaucucacagacauaaugccucuuuauuuagggaaaauacugcauguguauuuccuuaaaacaaagacauucucuuuguuuuauaacuucaguacaauguuuuuugagauagucuugcucugucauucaggcuggaaugcaguggcacaaucucagcucacugcaaccuccgccccccaguuucaagcaauucucauaccucagccugagccucccaaguagcugggaucacaggcgugcaccaccacaccuggcuaauuuuucuauuuuuaguagagacgggguuuugccauguugaccaggcuggccuggaacucuggcuucaaggaaucuaccugcuucggccucccaaagugcugggauuacaggcaugagccaccacacccggucccuacaguacaauucuuaacacugaugaauuaaauuauuagucauacaauaccuaauugauuuuauuacuuaaucccaauuuuaaaauauuuaauaucuacaagcuuuauucacauuuccucaguuguccaaauaauguucauuauuguaaaauaaauaaauaaguuaauuaauuuuaaaaguuuugguccaggaaucaaaucaggggcuguugaggcauuuacuuuuuagguauaucuuuagucuccuuuaaucuggaacaauuuuucguuguuaauguaacaugguacaagccaguuuacuuuguagaaucucucucagcuuagguucgucacuguaguuuuauccugauuuuucauuagugaggcugcaucucuuuacacaugcucaagacccauguguauauccuuuucugggccaguuuuuccuggcauuuucaauauuuagcuuugaggcugcuauuaucucaggaauuguaucuuuaaauauuaauuccagucuauucuuuugguuucugauuugggagcugcaauuaugcauguuuuguuuguucuuugccugccuccuccagcuaucaguucucuuuaaucuuuuuuuuccucuuagcacggagcuuuuucauucuagucucugacacuuacucuguuuugcagcuuaucuguucuuccuugugcuccucacacuuucauaguuuuuuguauuuuuuuuccuuuccaucuggccaaauuauguaaacucauguuuauuuccaguuucccuuaaaugucuguuugaauuuuaaggccuuccuuaguaagaaugauuguuuuauuuucaaaaugcauuuuuucauuaauccauugaauacuguaguauccuucuaauuuguuaacauguccuuuauuucuuaaauuuuucuuauuucuuugguuaauuucuauauucuuuuuuccuuguucugacauuuaacacuuaacucuuaccuauauuugucuuuuucuuauuuuugagagcuaccuuugacuuccagcccuucuguugaguuuuaaaaaacuauccugugcuuaauuucugagaccucuuuuauuguuuuuugguuuuguuuacugguuaaagucuuuaaaaagcauucuuugucucccacaauugaaguaacuuuauuuuucugaagauaguuuuuuuuuaagcuuuuuaaaaaauacuacauugauuauauuuucuguuucuuugccuucauuuuuuuagucuuucuucacuguuccaggauaggaggcaauaaaagauaggauugugaggucuuugugugugaugaaguuuaucuaaucgugggccugcccuugagugaccagguggaaagccguguugucucugugggaucuauagaugucacuaucuugucuuuggggcugaucaacuuucucuagaaaggaaucguguggucuccuguggguauaagucuggcuucugugaccugguuucuggcauucuggaagcagaugaguauccugcugcugcuguuuuccuugaucgcugugugguauuccucagccugagggcuuuccaauuuauauucuucaaaccauacauauuuguuucuugaaggaggaggauagcaguaguuaacacacugucugaccaguuugcggaguuaagaccuguccucuccccauugcuacucugucuagugcuuccaagcauagcacuuucugggguccugcuggucagccagcccaccucuucacagcauccuucuaugagcacccagcuugugcauuccuucccucucccaaauuggucacaaaucauccaaacaauuuccauauuaaaaaaaauauuaaucucuuuuucuugaucuccucuuugcuuuguccuuguugaugaguaucauauuuauuccuccuguuuuuaggacuuagaagaaaagacacauguggucaaucuaccaugcuuaacuagaacucaaaagcuggcuuguugaaaagaauaaugaaauugaucuuuuuggguuuuuuguuuuuugguuuuuuguuguuuuguuuuguuuuuuugagacagagugucacucugucacccaggcuggagugcaguggcacgaucuuggcucacugcagccucugccuccuggguugaagcgauucuccugccucagccucccaaguagcugggacuacagguguacgccaccacacccagccaauuuuuguauuuucaguagagacaggguuucaggguuucaccauguuggccaggcugaccucaagugauuggccugccuuggccucccaaagugcugggauuacagacgugagcuaccagccuguucuguuuuuuuugagacaagaucucuguugccuaggcuggagugcaguggcaugaucacagcucacugcagccgcaaccucucaggcucaagugaugcuccuaccucagacuccugagcgggugaucacuggcaugugccaccacacccagcuaauuuuuguuuguuuguuuuuggagacagggucucugucuguugcccagacuggucucgaacuccugagcucaagcagucugccgaccuuggucucccaaagugcuggaauuauagacaugagccaccaugccuggccaaaacugaucuguuguggcccugaucaagagaaaaaaaauagaaagcacacauauacauuaguauaguaaaaaggagaaauguacaagagaauaauacaugcuacuuuaugauaaucaguuugaaacgcuacagcggggguuggcaagccaaauuugguuuaauaucuguucuucucaguagaguuuugcuggaacacagccacauuucuuuguuuaccuauugccuaaggcugcauccaugcuacagugacagaaccauguggcucccaaagcuugaaauauuuacuguaugguccuuuauaaaaaauaugugcugacugugcugcagaagaaaugauuuccuagagaaagagacuacaaucgaccccaaaggugcuagacuagauaaauaaccgcagaggagauagcaaagguuauuaaaaauguuaagaaggcuccaggcagagaacagcguucugaguucacucuagucuuuggagcacaggcaguuuuuuuguucuuuagauuauuuuggaccauagaauaagauggaaagucuuuguaaagugacguaauuauuuauguagucaucuuuuacagaaaccuuauuagagguuuuuguuuuugcaguauuuaaaauagcucauaguuuacagugaucacugaguguggcgccacagugcguagagugcacaauggccagagugguccuucugucaucaggagggggggcacagcgucugccucacaguguugucugauccucuugaccacacagcccccuccuguaucauuuuaguaccaguuguggaccuuuacacuaguuuuguuucugaguuguagggcuacccucauuacuaagaaaagcuugugugugugcaugugcauacaugcgccuguguguacaucuuaaccucugccuggaugcgaaaagucuugcuuuuuuuuuuuuuuuuuuuuuugugacagaaucucucucuguugcccaggccagagugcaguggugugaucuuggcuuacugcaaccucugucuccuagguucaagcaauucuccugccucagccuccggaauagcugggauuacaggugcacgccaccacgcccagcuaauuuuuguauuuuuaguagagacaggguuucaccauguuggcuaggcuaaucuugaacuccugaccucaggugaucuaccugccuuggcaggugcuggaauuacagaugugagccacugcaccuagccaaaaagucuuuucaucugccuuauaauuaacacuagugguuuuggaauuguuagaaaaauguugcuuacauuacuguauaacagguuguacuagucuaugauaggguuauguauucugucuucagacauuucucuuuguuaugaaauacuuugucauguuacuuugugagcagcagcaccaccuguguggcuguagcugacgcggugcuguugagcugaccuuuguguagugagccccaggucuguaauuccaucacguuagcaaaauggugcccucaguucagaaguucccaaaucagguucugugauuuaugagaaagacucagagaauucagcagagcuguuuuacucacaguuaaggguuuuuuuuuuguuuguuuuuuucuucagagaaaggauacagauuaaaaucaacaauggaaaaaggcacauaggcagggucuaggagacaccaggcacaggcuugcagccauccucucccaguggagucaugcaggcaguguucaguuuucccagcagugauaugugauaacacccauucagccagggaagcucauccaagccuugguguccaggguuuuuaauuggggaucugucguauagguauggcugacugccuauguggcuaacuuuaauuacucaccagccccuccagaggucaagcugacacuguguggccaaguuucagguaaaaaaauauguauaaacuagagaagaggccucacuauguugcccaggcuguucuugaacccuggccucaagugauccucacaccuuagcaucccauggugcugggaccacaggugugagccacugcacugggccuaaaaagacauguuuaagaggcagaaaccccaagagcucagguuaucccccacguaccaggcaagacucaacccuuucuuugaaaugugcgggguuuggacaacccagaccugcugaguuaaucuuuauuguacaucacuacaugcuacaccccucagacacauacguacuuuuucuaccauuucucccaacaaguuuuuaaagacauccauaauccauuguaacaaauucaacacaauguaaauuugccaguaucccuuguuaggacggaagagaaaguuuuacccaaaaggucauauucaguuacauuuggauuagaugagaugucagcuuccaucagacauuuaccuucuggcugugaaaggugagggugaacugugucccuucuuuuguuuaaggguauugggccccaaaccccaaaccccuguugccuccauguggguggaacacauggaaucagcauuuuuccauguggauaucucuucauuuuguuuccuguuaaacacuuuguuugcuagguuauaaaacauuucuuaaaaugagauacauaucuuggauuccaagaaaugauuguagaaauuccaaggaaagauuauuugugugguguuugaaaccagagcaguuuugagguucuccuggggaacucggggcuaccuugaguuuucuguuuggcucagauacugcaugaguucagaacugaugcugggggugauuggaagaggcuggacucuaaccuaaagugacuggucuuuaugaugauuuuugcuuaaaaaaccaugccacacuuaauguuuuaaaauauuuuuuuuacuaguguuaggagaaaaagaagaaaaaaccugucaccuaaacuaugaauacauuuuuaauguuuuguuuuuuaaacagaauucaaaucaccguguuuauauacuuuagaauuacucuuuucaccuaacguuaucugagcaauaguguuuggauaggaggguguagaauuuuaaaguacaaagauccuuuuuacuugcagggaugaagugggcugggaggggcagaucagugugcugucucuuugaaagugguuaaaauuuucuaagauuuuuuucaucuggggucucacgcaaggacugcucgugccaagguaucauuuuguggucucaaccugggaacaucucuguccaugcaggaggauccccaggccuggggagaagcucugagcaaguuugguguucucagggaugagauguugcccaaggacgcugaccccccaaauucugaggauugaccaucccggugggcgacuguacuugagccaaagagaauacuuggcuucaaagauagccaaggcucaaaacugcaggaagauggcaaccacuugauaaaguuguuuuucuguaauaguggccuguacauggccgagcuaacacuggucuucacguuuaaugagcaccuucuuuucuccuucuggcucgcagagcucucucgcugagacccuggauagcacuggcagucuggacccccagcgaucagacaugauuuauaccauagaagauguuccucccugguaccuguguauauuucuggggcuacagguaagaugguuccuguaggauguguaacuaccagcagguguuugcauugucuaccaucuggaauuguuuaaaaauuccacuuugguuuuuguuuauugaagacuuuuauaaauuccucuuuuaagagugaugaguaggggcugagcacaguggcugaugccuguaauccuagcaguuuuggaggcugaggugggcagaucacuggagccuaggagcucaagaccagccuggguaacauggcaaaaguccaucucuacaaaaaauacaaaaauuagccaugugugguggugugugcccacagucccagcuacucaagaggcugaggcaggaggaucgcuugagguugagguugcagugagcugugaucacaccacuccacuucagccugguugacauagugagacccugucucaaaaaacaaaugaugaaugggaauuguugacaucacagcaggaggaagaaaagaacagguagaauggauuaccagggaaaagaaagaagauguucagggcacaagcaagagcagugacauaaaggaagggaaaggaaauagaguuauagaaagaaggaagaauagagaaaggagaaaaguugaagaauagagaaaagagaaauuaauuuucaucucccauuccuggccuaguuaacccacccacaaucaugguaaccucugccaugaaacaggagcuacccggaaaagugccauguuggccaggaccuaaaugguagguuuucagucuuauuuuuuaaaggaagggaaacuugccaugguagcagcagcuuugucugcugcagcuuccagugggaggggagggcagccgggcucagggacaagguggguggugacauagcugauggaggccuccggcgucuuugauacuucccuccucugucuucagcacccuuuucccuuucauaggaugaacgcgggacguuuuggagaaaggggacaacguggggagggucuuuucuuaaaugcacacuccuggacugaauaugcuuugguuuuaacuuggacucuguucugaggucggacuuagcauuuuucccuucucaaguuuguguggucaguucaaccuaagguaucucaggugccgagaaaauccaucucauuguccagagagguugauucacccugggguggggcugccaacagcuggguacuuugguugaguuuccaguugccccgcccuucccucaccccguuucagguaucacagcccaugguaaccccgacuggcaggugucuguugaguaggggaggagucagagcaaaaggagcugaguggccucggcaacuagucuaccuugggcugagcauucugaaccagauucaggaaggacacuuuuuggaauguuuaucuuauaaauguucccagcagucuucccuggucagauaggagugggaaacccugccugcaucaugcccuuccugacgauucagaguacauaaaguugugagcagcccugagacauccugaacaggaguauuucaccccaggaaacuccuuuacagucgggcuucaugggcugcauguggcauguuuggcuaacgugggcaggaaugggaagcugcuggaagaaaaguaggaaguuugcagaacagaaauaagaacuggucaacaggggaagggagggaagugagucgugagugcugggacuauccuaccagggcuacagguguggcgggggguuggggggacucccaaaggaaagugggaugggguucuuucuggaagauucccauggcuacuguacgcccuuaacccugcccugacuggaacagacgaauucuuuguuuucgaaaacaaugccagcucacagaaaaagacagaaaacacuccaugcguauguaacuuaugaagcuuauguaacuuuaauccccagacaugaaagaacuuuuuuaaagaaauagacuaauuaaccuagaaauguagaugcaaaauucuguauaaaauauuagcaaaucaaaucccagaagaaaaauacaguaugacuaacuaggguuuguuucaagcaugcaagaauaguucagcacaucacaauucaugauaacagauuagaggagaaaggccuuaugguuuuagcaauuuaugccagaaaagcauuuuggggaagaaacccaaauauuucuaauaagaauuacauaaguaaaauaucaccagugcugauauugacuguuuccuuugugaggcauggauucauccaaguaauaaguaauaaugacagugaauaguaagacaauaaaauguaaugaaaaggagaaaugcagcugggcgugguggcucacgccuguaaucccagcacuuuggagagggagaggcaggcggaucgcuugagcccagguguuugacaccagcuuugccaacacggugaaaacccaucgcuacaaaaaauacaaaaauaagcugggcgugguggugcgccccuguaaucccagcuauuugggagguugaagcaggagaauugcuugagccugggagguggaggucacagugagccaagaucgcaccauugcacuccgucgagggcaaugggagugaaacugucuuaacaacaaaggagaaauacugaaaaagaaggaaaaaaguauggcuuggucgaaaaaccaaggagauucuuuaugugggcuauuuuuuaacgacaauaagagagaagaauuaggaugaaaucaagaauaaaugaggaaggguuuacuguuucuccucugacccuuuuccugcccacagcacuaccugacaugcuucagcggcacgaucgcagugcccuuccuguuggccgaugccaugugugugggguacgaccagugggccaccagccagcucauugggaccauuuucuucugugugggaaucacuacuuugcuacagacaacguuuggaugcaggugagauugggguacuaaugggggaugccaaagcccccagaaggcauugagcgcagaaggcauugagcugcgccguuugccuagggcuguuggcaaggacagaauggaggcacgggaauguccuaguggccguugguccccaccccucaguguuccucccagucauuuccucucuuggugaauggcaccaccgccaccuuccccuacccaguuguccaagcuggaaacucagccucacucuccuuccccugcccccuuggcaagucaugcucgcuccccagcaccccucugugccccuauuccuuacguucagaccagagugucccaccaggcuccccguuggcuucccugccuccagggcacugcucuuggacucacuuugugccccacacccagugccaucuuucuacuuccacacccuccucagggugagccacacugcagcucuccucccuuuuuacacaccaggcugcacccagcauuuaggcuugcccuugcucucugccccacuuccaucuccagccaugccucugagcccugucuccugccuucccuggccucacucccaagggcccgcugucuaccuucuugugugucuucccucaacccgccuggcacacaacagcucauccuccaggcccagcuuguccugcccucccgacucuguggagcccuucauuguucucugaauucccaccuuguuuucauccuuccaguguggccuuuauuccaguuuguccuuuuuguuucuaugucuuuuucccacggugcuuccuccuugaugccagggcuuuggcuuguucacuucugcauuuccagccaccagcuuaaauggacguggagcuggcacaggaaggaagagaaacauccuuaucuaccuuccuaccuccuccugcaagcuugucuuuuccucuccuuuccugcuccucuccccucuucgcagugcagccucuugcuuuaccccagggcacugcucaggaaguggagccugcucuggcaggacuguccuaaguucacggccagcugucucuugcucugucagagacaggcugaguaaggccuggcccucccugcggugggaggugggugugagcugaagucagggacugcauucugaugagucagaauccuucgggaccucaggguugcccuaacgcggcacggggauaggggagccuuggagggcggugagccaugugcagguguucugguugccaggauaggccacacccugggaggguaggcugcaggucugcugauggaaagaagcuauguggacuaaaggcuuuggggcuggcaagcucugaugguucccagaucccagcccuugcuagucugcccacaaccaccaagcugggcugaagggaggagggucuccucaaaccccccagggggcagggcagggauaucacugaccgacuaggggaaggagauguggucugggccuuccaagaagggcucaaccugacuagcacccucuuucauucuuuggguacaguguucagggcucugugcuucaaguccagagugcacggcagagcuuuuuuuggcucacucaggauccuuaccuugcccauggagcacugguucucuggggagauguucuuuuucuaaaccgcugacuuauccguggauuuguaggcauaaucccucugugaauuuggucagugucucuagcugagcauuauugguugaccugaauaggggaugaaagcuguguuuauugcagugaaguguguaccgugugcagcucugccccagcucaugccaaggaggccaggccuggccagcagcugagccugaugggcaaaguugcuaaugggacacagaagggagggccugggggaacuugggguaaauacuuuuggucacagagggcaucaucuugcccacuguuggggcacaagaccuaaacagaacuaccugggucagcgugguucaccucccugcuggccugggaagcaguuugagcggaguaagaacaggagagggauuugacacccuacugggauggcucagggacccaaaaugcagagcuguggccuggaggagggugcgugucugugcgccccaugcccacaaggcugggugaaagcagccuuucuugcuguguuugugaggagucagagugagucccccaugaccuuuggcugugcaaggaauggcagccccaccccugcuuccauccuccccacaguguggccauuugcuuagucauaaaucagguggugcugacucuaaucacgucagcaacugugugcugcugggcaggugcaggugugcuggggacuuuggugggguguugggcuugugauagggguuuucuaugguugucgggguguggguggugcccguucucuuaaccugggcaaagagaaagaguacuggcucagcccugcagauauucagugacuggucuauguggcaggugcggggccuggccauuguggggcgcaauggugacaucgaagcacauggcuugcagcacgaagggcagcgccaucagggagacacagugcauccuccaggggacuuggugggagcccuggaggaggugguguuugagacaggcccugcaggcuccaagggcucugcccaggagggcugagggagcagcuuccaucccagcaggggcaggagcaaaggcaggaagucacagccuggcaugaucccccugcccaggcacacagaggccagagcuugggacuuaucaacaggcacagggagcauucaauggcuuuguuagcaggggacucgcccccggggcugugccuugaaggacguuacuugguuacuuaguauagggggugaggaccaucccaggggaucagugacauccaugagaaaggugaugggggccuaggcaagccucaggggugugggauaggaaggugacugugcuaggacugaacucauuccccagucucacucuuucucguccugggggucccuuccugcuuugaauccuuagcuggaaagagaagcagcacggaauggaaugugcuucauguguccugauuaaagaaucuuuccaguggagcggcuuagagagagccuuugggaugggggaggggagcgccccugccagcaccuugugggcagucugggccucccaggcugaggggggcuuuugcugugaaucugagccugcagugcuguguguugccugcaccccuugcuuccucuccgaccagcaggugggcagugagcuggggcuccggugggggcuccugcuccgcacggccucagacccugucugcagaccuucuuccguguggguccuuagcacacuugggggccugcugugcagggggcugcgugucugaggcagcgaaggggcacugaggcaacgagagaggccgcugguuccccccuugacuggccagucaccguggggggcacguuugcugcaccccauguucgugugucuccucuucucucaucccccccacgucucuccacccuccaucccuuccuguugggaugcagacuccuccacccuuccuguucccaucuuugcgcuaggccagacgaggccaggcuaccuugucagccgcaccaccucucacagccuugccucagguuuccugugggguuagugagggaagagcagaaauccccaaauggccaacuccuccgugagcauaugcgcuguucccauccagcagagcaagguuggcagccagaccucaguagggugaggcccccucugguacuuggacacccagaucucacucaggacagcaucuguucuaggggugcucaccaagaucaauacugccagagcuggacgcauggccauugcaagugaaagucagauuuugggauacuuuuauggaauucuaaccccuuggguaucaaaccuacauuucugaggauagagauauguuuacagcauguggcauuaugaccuuggacaagugaccccucgagccccguuuccuuugugaaaaugaaagaaggcuucucccucagguguccugggaaugauauauuucgccuaauuuuaaugaaucuauuguguuuuuguagauuauuauguuuccuaaaauacuuuuugggaguuuuugcauaugaaaaugugaacucauauuuuagacuuuuaguucugcuaguugcuuagauagauccaucauaggcugugaauuaucauuucuuuuagacuucuguguuuauuuucugcaguugggguagagagacugugagcagggagcaagguggagaggaaaggcagaugcagccgggcgugcaggccugacucccagcagcacugccggaaggauggcagauggccucugugggcuuuuuuggguuguguuuuugcuuuggagaagcucaccacucauuuccuuaggcuuagggcagcagaaggaaaaguuuuucguguccagcuuucgugauuucuaagacacagugucagacuucuccagcuccgaagugguuccccuguuguguuucgguucuguauccugcauugugcauuugacugccucuugcugaguacccaguauuucugucacgcuggauguugugggugaagggagccugaggacaaaccauggccugugcccuugaggggugggcccucuauugugcagaagugucuagauuacaggaaggaacaaggugcuguggucaagucgucccccucauuucacaugggcucuugaucugaguggaaugcuauccuggaaaccuguuucauucuauaaaaaugaucagaguugaugggaaacccaugaaggugaaacagaugugugucuuugcagaagacacagugaaacagaugugugucuuugcagaagacacagugaaacagaugugugucuuugcagacgaaagggagggccugggggaacuugggguaaauacuuuuggucacagagggcaucaccuugcccacuguugugucacaagaccuaaauagaacuacccaggucagcaggcagcaugguuccccucccugcuggcuugggaagcaguuugagcagaguaagaacaggaggccgauuguagaugccacagcauggggguacauuucccaaggcugacuggcugagaccacgugaagcaugucugaguugugcaggcugcagacccuucuuccuucacugcacaucucuccccuggcaugaaaguuuuccuuuucuuccaggggccguugucuuuuugcauuggagguugugggccuuagccccaguuguugaggacuuuaggaggcuuuggugcuuuccaagccuuugcuuagggaaaggcagcuuccucacggcccuuccucauggcauucccucucccucucccucuuccucccuaccuuuuccuccucccuccucuccuuugaccuugauccccugagcuuugugucaaggaggucuucauuaccgaguuuuccccugagcgagguuucaacaguucucauucugguuggucugugaugucaauuccagcuaacccuuguuccgggaauuaguacaaagccuuuaaaauccagagaaaucaggucaggguuuugagaguccccuagccagccugcagccgucauucuuuuguggcaccucugagcuucccagaguucccaccccugacccuuggugucucuagggcccuccaagacccugccccgccgucaccacacugacuuucccgcaggcuggugggaggagagucuuacggcaucuguggggccacccucagccuuucacuccaggccccucuuagaagcaucacucugaccucuccagcaaaaugaaagguaggaugcccccucugagagagcccuccuggccguucucaggccugcuguaggcacacagcauguucaugugcugagaaaagguaggguuuggccaagagagucauuguagcugguuuaggaaccuggccucuaaccagauugucugcccuaaggagagagaguuccucugucuucuauccugucagguuccuggggcccguaauggaaccuuguccaugauaugugcucauugaguacaagggguggcuccaggagacuugaaggucuuaaaucuggggacuucgaacucaugauuguuuauaaaacuuagaagcauggagggaugcggugaucagauuggggcaagggagagaccccacuucucuuucuguauauguauguugggguacaaguguaauuuuuuugauuuuugagccacuugaaaguaaaguugcaggcugagcaaggcgguucagggcuguaaucccagcacuuugggagucugaggcgggaggauugcuuaagcccaggaguuugagaccagccuggacaacauagugagaccuugucucuacaaauaauaaaaauaauuagcugggugugguggcgugcaccuguggucccagcuacuugagaggcugaagugggagggucgcuugagcccaggagaugaggcuucacugagccaugaucacgccacugcauuccagccugggagacagagcgagauccugucuaaaaaaaaaaaaaguaaaguugcagauagcaugauggcucaccccuacauacucuccuagcaaugacggugucucuuguguaucacaggagaccauuugucacaccuaagaacauuaacaaucauucuguuucaucaucucauaugcaguucguauuuaacuucccaguuguuccuaaaauaccuuuccccauuauucccucucuaaaccagucuccuucguguggugcauuuguuuguugugucucuuugcugucuccaccuuuuuccuccccacgucaucaucuuuuuaaaaagauuccagaccuggugucucgugucugauuuugucuugauugugucccugucauauuguuugauuugucccacaaucccucugauuuguugucaaccagaagauggggcuggaggcaugguugauuuaggguaaacauuguugccaaaauuacuguguaggugaugucaaauccuuuguauuuugucaugucaagcaggcacauaauggcagauuauaggguuuugugcccaaauaaaaaaauuuguuaccauccacuuaacuaaaaaggaauuuaaaaucauacauuaauaugggagaccaggcugggcacgguggcucaugccuguaaucccagcacuuugggaggcugaggcgggcggaucaccugaggucaggaguuggagaucagcuuggccaacauggugaaaccucaucucuacuaaaaguacagaaauuagcugggcaugguggugggugccuauaucccagguacucgggaggcugaggcaaggacaaucccuugaacccgagaggcagagguugcagugagccgagauaagguagaccagugagaacguggaggugaugaccuuggcuaagggucucugcccuguccccacugccagcugcacugaguccuuggaugcagaggcggcugggcucccuuuccaucauuuaauagucacgugacuuuggacaagcucucuccaagcccuguuuccucaaugguaaacuaaccauaagacuguuagugagcaggacaccauggcucaugccugcauucccagcacuuugggaggccaaagugggaggaucacuugagccccgaaguucaagaccagccugggcaacauaaggagaccuugucucuacaaaaacauaaaaaaaaauuagccaggugugguggugcacaccuguggucccagcuucucgggaggcugaggugggagaauugcuuaagcccaggaggucaaggcuacagugagcugugauuugcgccacuacacuccagccugagugacagagcgauacccugucucaaaagaaagauuguuagcgagcaucaggugagcugaugccugguaccuguccacacucaguggcugacucuguuuaucuuaguuuuccccacugggagggaaggaggcagguagugcagcgggugcacagcgagcaagggcuggacagccuuguguagcaacgcagaccugaugaguguagcagggcuugggguuggccacacugccaguguccccagccagggugggccccacugacccuggaaucuauggcagaggccaucagaaagcuguaagggcauuugauccagccccuccugaggccggagacccucuugccucagccaagcuuguucucuaaggcgggucuacucgcuuuuguuccugcaacucuagcuuuucuggguggucucccuucaguuacuccacccuuccucuguuagcugguauuugugauguuucaagggccugggagucugauugaguccucuuguuacaugaaaguuuaaugaauuugguuuucuacaaccuuucuucuucaacugucagguccuucuugccccaaacauuucccugggcucugaauugcucauccuccuccucauggccuucugcuuccccuaccuccccuccccuaacccccauucuuccuuuuuaggcaggugacugcccuggcaaaagcagcucuacacaggagugaacaguacuuaucaccaaauaaggauggaagcucuuuuccuguuuuaaauuuggggaguuuuuucaauauuuggcaugacucugguguuuuaaggaauguguugucaucucccugccucugcuacccccauccuccuaaguccccacucccugaaaacacuuguuagauugauagacauagguuuuuaaaaugucagcucugucgaggggcaauagauaugcagcagaauucacccuuaagcuguauaguuagaugagcuuauacccauguguacaaucacaucaccaucaccacgaauagauagaacagugcaggcugcuuuccaaaaguucagcaggucgauggauggauggauggauggauacaguaaaugauagaacaugucaucaauuaagaaaaaguuuucuuugacacauuaugucuuucuuuuuuuuuugagauggagucucgcucuguugcccagacuggagugcaguggugugaucuaggcucacuugcaaccuccaccuuccggguucaagagauuccucugccucagccucccaaguagcugggauauagguaccugccaccaugccuggcuaguuuuuguguuuuuaguagagaugggguuucuccauguuggccaggcuggucucgaacucaugaccucagguuauccuccugccuuggccucccgaaguacugggauuacaggcaugagccaccacgccuggccuugcuuuucuuuaaaaguaguugguacacacacuccuagugguagauucaauaaagaaccuauggcuccucaaagccaaaccuguuacaucucuuaaggauuauuuuucaaaaauuuuuccugcaguuuagacucuugaguguucauuugacaaugcaggguuuuguaccaacuuugguuguugucuugguagaugaaggaagccaggcacagaguauauaugcucuguguuggugaauuuuguuuuuguuuuauucauuuucauuaacaguuuaguucugggcagauacauuuuguaucuucaugguguuucccauaggaaccauuggcuuuuaaaguuucucugauggcaccagaggaggacugcaagccgcccggcaucuggaggcuuaucugguugaaucaugaaaacccaugcacauuucacccccaacucugaguacuuuuaaucuaaucaccacucucuuccaaaugugcagucaaaaccaacuugccacaaagacuuaaccucuuauuuuuaguuuaauagaaguccuuucugagaauauaaauagcuccuucauuucauuaaguauucauuggugcugaggauacauggugggucaagauggugggugaagccaguccacuuccuaguaucgggggaugcccgccucaagguugagaugggcaggacagcuuguggggagugcaccagcacagacagcagcagcccgaggaagggagcagauagaggcuggacacaggcggagaucugauucaggcuggcucgucaugugagcggaugccaaagggaauuaaaaagcaaagaugacacacagagccaugccacagccuauugggauguccucuguggcuugguuccuucaagacugagaauagcuucaggguuaaggucaccucucccaguucuccuacggugguccuuucagagcagguccuucacucauuucccucuugcugcaggaagaaugcggggcauuugucaucugguccccacugaccuucaucauaugagcucccugugcuuucgcucaaguggagaaucugcaguccucugaggguuccuggguccguccuguggcucuuguuuugcaccuccccucucucugcccggaauacccauaaucccccacacacguggcgaagcacuucucguucuuuaagacucgcucaagcgacugcaccugcagagucccacagcauuucacaccgucacaucacggccccuuauaugugaccaugauuagugucuucuucacgcagcagaaacagaagggcucaggaaguguuuuccaucgucguaucugcuuauaauugugcuggugucaagcagauauccaagaaucauuuaucaggugacaaaaugauaaaucccuuaaccuggcacagggguugucagucucagccaccucuagaaggcauuguugaaaaugcagauuuggugccacccaccccugaaucuggcuaaccaggacgagaugcagaaaucuccacauuuaaccagcacucccagagaauccugaagcagcuuccugguaacuugggaggugacuugcagaaaucuugacaaaaaguccuaaguuguaggggaacacauuacagauucaaaggagauccuggaauauuugcuggaggaggugauauuuucucugugccuuaaaugacaaaugaaagaugaacucguaugaaggagcuggugagagauaccaggcugggagugggguucagguuaccugggcaccaagcuggacauggggggccucuggcaggguuuugaauaaaguaaggacugugggaguuugcuuagguucuccugcuguccugaggcuggagcccgacaugggaucucgucaugucaaaguugcuggucugcucaggauuuuguuuuuuaaacuaaugucuagugaccacuauuaacugugagaauuucuagcugcagaaacccacugccucuucacauauuuaagauauauuuucccuguagacaggucagaaaaacuucuuuuguaaaaggccaacaguaaauagccuaggcuuugcgugucucuguuaaugcugcugagcuccaccgugauagcgugaaagcagccuuagaccgugaguaaauaaauggcuguccuuuguuccaguacaacuuuacuuacagaacagguagcaccccagguuuggcccacuggcugguuuggccgccccugguguaaagaaaagcacaguuuaauguauuuccuuuccagucuuuaguacaaaauaaaagagcaggcagucuucucggccuagggagacccaccugggugccugagguuuaccuggucacaugaguacgacaggggccgugccuugggugcagagagaagagcugagaauugaccgucuucacacugggcaagcaccuaaaaaagccacucucaucaccuucagccguuuucuuggaaaauuggcuuuguuaauugugaucuagggaagcucucguuuaacgugugcauaugcucuuguugcaacuuucccuaagaacguuucagucaagccagugacagagcccacacuuagugcuggcgucuuaacagcuugugucaggcgguguugccuggcuagacgugaacacauaaugcuggcaugagcagcccuuuccagaucaucucgggagacuuuuucuaucgucaucuauuucaggggaacucagggucccagcagcuugcaaaugagcaaguaucuuuacagcagcgcucucgggaccuuuaguccuaguuaagccaccaaaugcucacccugaaaggugcccaggucggaugccaaggucagguucaggcugaggucugacugaagaguggaagccagauccagucuuuccuuuugccauuuccaguggaucaccaacacagugugaugugugauggccacauuccuaaggauaaaaucucuaaacgcaauucaccauuuguauuccacugcccuaggaugcacugguugaagucugaaaccaugguaaaccagauggcauuuggaccauuccauacagcauccgucccuaauuacacgcuguccuuucaguacaguccugaaaauuugugcuuauggaauaccuagaagucaaacaguguuuucccuuugacguacauucccacuucagguguccuucacuuccgcuauccucugggccccucuggcagguaauuauaacuggaugguuguugaagggcaugccugugggaguggucaacagcaaugcaucugguuuguaugguguagccugcgucugugccuuaaagccagcacccuuccuacucuggauugaugucauugcaugauuaaacagccaggagagcaucuguaacaaggaagucuugaccucacuggcucagaauggugugugcugggcucuggacuugcaacgagacugcuuguccuuuagcuagagccaguuugauuucucaguccaguuccuguuucacuguggguaggacuugcugccagacagcucaaagggaaggaugcugggucccugucucgcuggccaggccacugacuaggcucucuggggcauuucaggauuuggaugugugagaguucccagcccugcaaacaggaggagucaguuuaauauuuuacccucaaaauuauauuaaaaauagugauuaaguucucaugcuaacccauaaagucacuuuaaugugacuuagcugaaaugcuguacauuuccauuaaaaaaugguagucuuuuugaauagcuaaaguguucaugaagucaauaugaaguaucuaaaauauaaucaaaucaugucauuugaggaucucugcauuuaguuugaggaugugggcagcaaauuuaauggagauucugcaaguuuucugggcccuuuaaaauauauuagaaugucuuuaaguauuuuuaugauuaagcagaauauuuauuuuaucugcugucacguuguaacuuacagcucuguagaucuagaucacuauuaugauuuaucuguaaucggugauuagggcaguuuuugauuuacaaaaugaaacaacggagggaaauuuguuccugugauaaccaauaagaauuuuaaagggaggaggagggagguaaaaaagcagaaauacacugauguuuaaaaaggaguuuauaagcucagcaggaaagagggaaccucaaaugcccgcagucucccgccugcaagaggaaagguggugauggcaggggccgguguugggguguuggcacugaccacggggcccacccuggagcugccugggugggaggagaguggcaauggggaggaugaagaagccacuggcuguggcugcauggcacaggaaaccuuugcaaacuggggcuuuuucuucuaggugugccugcauuuacucaugugcuguaugucuauggaaaagacuguuaagcugucaaauagugaacuaccucgguaguucccgaugccgugaucaugguuuuggucucguuucuuuuagguuaccccuguuucaggccagugcuuuugcauuuuuggccccugcucgagccauccugucuuuagauaaauggaaauguaacaccacagguaauugcaguuauuuccacauaugucauugggguccuuuaaugcagguguaaagggaggccuggacgugcugcccucagcagcgcuaaauccuuucaagaauuagggacaaagcacacaaacccacaaacagcuuagaaugcuccaucuguggaucgugucugucucucucuuucuguccacuuguucaucccuaacccuagagcaagaaaggaucagaauugaccucauuucucuauguuaaugaaauugacaaauaugggaacggaauagaaaaauauuugugcuauuuuucugccucucucuuucaguggauuuuaugacccaccaguaaucacucucuuugcugcgucagcaucccuucucugaaacaucuuugcuuuuuaaggaucuggcuacugugguuugcugcaaaugacuuucauuccccuucuuuagugauugcaaagauccuuaaggaacccgauaaggucaggaaaagauagggaauuuaagaaaauuagagucagaccuguacucucaaaaauacaauuacauuuugaccuucuaggagcaaaguuuuccagccuucauuuccuuccuugcuccuaggaguuacuuugugaccacugauuugaucugggaacuggaaaaggcccucuguuuuaucuaaguuuuucaaaccucaguccagcaaccuugcugucgggcauuucaaugagcugugugcaaagguugguuuuuuugugugaggcuggugcuaguaacguguaucaccacuucaguuagcuuuugacaauuuggggagcucuuagucgaugaauucauuugguuaaauuagcauuugaggauccaccuuucagugagauaagcuauacuguuggagguugaauuuuagggauggggauugaaacagauguaauaaaaacagggagaaaauucuucuuaaaagguaaaaugaauaugucaugugagacaucagugucacuccaagaaaaacuuuguuuuuguuuucaagauguuucaguugccaauggaacagcagagcuguugcacacagaacacaucugguauccccggauccgagagguaaaagacaagcguugucugcuuuuggcuucuucauguuucuucucagcuucaauguugguugacccaagaaauagcaguuacuuuuacugagcccuucuuuucuuuuucaauuacugauaguuuauuucucuuguuuaaguaaauguaguuaagcaauacucuaaaauaaagcauauggaaaugcucugggcaaccuuaaggaaugguuuccucccuccugcacacccacagaccuguccacucacacccgccagcacagcuagcugagguucguggcucacuggauggagcuacagaggcucaucaucgacagauagcagaauuguucgcucuggccucaguguuugccuguguucauugaaagaacuaaagauauuugucugccaaagugcaauugaacagaagcagacaugaaguacggcugacaguguauuaauauuuuccaaaacgugugagauaauucaccaucaguucagaaugagcacagauguggccauucugcacacuaaaaacaucccuuuagaauuucugucaacaacauugucuugucgauguccuggggggcucacucuuuaaagcugagagucuuuaugcugcaguguuccucuaaggcuggucuuuaaauguuguguuucuuaaaagggaauuauaaauuuuugccugcaucguuuaacagugaaaaaggcaugugggccguguguccaggaccuauuucuguaauacaccugcaucaugaaugcaggccccaguuagugcccccugaaguuucuugucggguccuggggaauuuucuagcuaucucucccaaguuagaugauguaauaacuuauugccuugcagaauuaucaguugugguuguaggugacauucugagugugcaguguacaagcagcucacucucaugucugugccaucucuuguugcagauccagggggccaucaucauguccucacugauagaaguagucaucggccuccucggccugccuggggcucuacugaaguacaucggucccuugaccauuacacccacgguggcccuaauuggccucucugguuuccaggcagcgggggagagagccgggaagcacuggggcauugccaugcuguaaguggaaacaucuccccucaucccaccacugcggggcagccuuuaggaacauucacacagacuucaggagauaauguuuuucaauaauaagaauggucugacaguuucaacuuuauuugcuucgugcuggggaauaguugaaggguuuuugacccagaguuugggaagugacauauaguugacguauuacaaagacagacuuagcagcaauaugaagaggguggauuguaaguuuuuaagcuuugguagugggguaagguaguggcgccauuuguuuuugacuuuugaggucuugccaagucucauguucaugaguugacauacugagaagccaaauuuuuauaucaugagacucaaaaauauuccagaguggcaggaaucuggaguauuuccagagaagucgugggaaaggucuguugccauugaugaugugacucuucuccccaggccacacugagcucugcacuccugacgggugggugguugggggagggacauaguuucugccaggguccugcuagucagugccuguccuuuuguacagaaugucacauccauuaaagaugucccuugcccuuuaaguaaaguuaacauuuuguguuaaugaagucacaggggaguuugauaauauuacugaugauuagagucacagaacucuuuguaacacagagcccacauucucuaugugucugcagagcauguuuaagaguugauuauguguagguauaugguuccauuacucuggaauuuaaccagccaguacaacuccuaaaacaaaauaagucaucacauaagagaauuuuucauuugcucuguuuugugaaauagucugcaguuauuuaauaacaggugguauuuauugaucuuuuacuaugcaucaguccuuuauauaacacuuguauauaguaucagauaaggcacauccuaguguuaucccauuuaacagcagaggacacugagcaccacgacguaaugugauuugcccagagucauacagugaauuaaguggccaccguggguuucaaaacccaggugguggacaugggcccgaacccaucauacucaauccuguucuguguauuagaacaugacguacaaauaaaagggaaccauagcagaauuguuaucuacacuuuacaaauuaaauuaaggugugugaaaauaucaaguuuuuuuuuuucuuuaaacaagguuugaaggagacacaucucacacaugagcaugaauacccaucaucaugcuuucccaaaauuguucuuuuuuugcaauggagucucgcucuguugcccaggcuggagugcaguggugcgaucuuggcucacugcaaccuccaccucccgaguuuaagcaauucuccugccucagccucccgaguagcugggauuacaagcacccaccaccacacccggcuaguuuuuguauuuuuaguagagacgguuucaccauguuggccaggcuggucucaaacuccugacuucaggugaucugcccaccuuggccucccgaaaugcugggauuacaggcaugagccaccgugcccagcccaaaauuguucuuacuauucucauuucaccaaagguuggucaaaacauucuucacaccagcagagaugggaagauggcaugugagaauagucuuucagcgaaauguaauuaaugccaaaauggauaaauuguagguauaguacaguaaaauuugaaaccaguaacaaaaggaugaacaaaacccacaaagcacuuacaagcuuaaaaaaaaaaguguuaaaaaucacucucagagaggaaauugaaacuuugcaauuaauuacugauaguuuaggaaaugauggcaagaacagcaccagucacacuuaguagccagagguguucucaagaaaauucacaaccuuuaaagcagauacagcacaugaagaauuucaguaacuaagaaaacaggacaaaaaaaugaaccuaguaaaagcagggggaacgaauuaauaaagauacagaaaaugugacacaaauagaagugguaaaucuaaaagcugaucucuugagggggaaacaaaacccaauguagacaaacuucuggcaaagcuaagcaggauaagaggaagccugugcacauagaucugccacagaucccgucagagggagcaaaacuguuaccuccccccaaauuaaaacaaaaaguaagaaaauagugguuuucagaaaacuuaaguaaccaaaauugacuccuccucacucuuaucucuaaguaugggggugccuccacacuugauccuggcccccuucucuccaugcacuucccccaaggaaaucgcauuucuuugaugguggauaguuccauggaaaccuguaguucagaccuguaaacucgauacuuacagauccagccccuauuuugccccuccacuuacuguuacacaagacaucuccaucuguaaaugaaaaagccccagacuuuugauuccuuuccugccccugaaaccaguuucuucugcuuuccuccuuucggugaauggcacaaccgugccccuaguugcuucagccagaaaugucuaucuguucuucagucuuccuuucgccucaucccccacacagcccauccugcccuuccuccuccggaacaaauucugaacccguucucuuuugcaggccuucacugccgccacccucugcgagccuugcucgcccuuggccauugauuccucacuguccccagcuucucccucaugucucccagggguccuccucucuccccuccuuuugaaacaucaguuagacacaagcuagaauucuggaagcuuugggguuuucuuacuguuccaaugucuggagccucacgugcugcccucggugggucugcuugcgucucuuggccuggauaccuggagccccuuugcucugagcacccaggcaugcagaggugggacaugaucuugaauuaucuagaugccuuccuccacuccacccuuacuugucucuuucuggaaccucuuccugaagccuccuggacucuuccuguuuccucuccuguuuucuaucucuuugucuuuuuucucuauucgugagaauucuccuuugcuuuaucucuuauuccuucugccaagauugucauuuaugcucugguguuuuuucaguuuccaagagcucuucuguauccuugggcugucagcucugugagagcagggccuacgcucugggugggucaccucugcacccccagcaccugccccucccguggcugagcuggugcucagugagcagguugugaacuaauaaaggaaggcucaggaagcccgguaaacccaugaccacaagagcagccgagauaguugcugaaggacucugauuccuaaaagaagcccugggcccagaugguuagacaaugagugcauucagucuucaaggaacagagacuauaugcacuaacuugcaaacuguuccagagcucugugaaaggagggaaacuccccagccaaucuuagcggcaaauucugacugaacuaauacaaaaggagaaccauggaccauuguuuucuuuccugggguuguguuaaaaaacaaacaaauccugagcugauggauguauugcggcacauucuaagcaacgagcccugaguucaaaugucuucagguagcgugcuaaaguucagcaucauucucuacuguaagacuccuuccaaucuuucaaaaugcaaaugcgcaaaagacucuauucaccuucagaaaagggccuuaguauccagcccuguccacccuuaauuuguuuuuuaaaugucacacaucuauaagcauaucuugacagacuauuccuuagaauguuguuugggaagaugcugcuacagauaacacaaugaaagaacaaggcauaaugcgucauuucaagaauucacagaugaucaaauauuagaaaauguguugaaaucgaucauggcuccaugguagguuuuuuuuuauuuguuaaauuuugagacaggaucccgcuccaucacccaggcuggagugcaguggcacaaucucagcucacuguggccucugacuccugaguucaggcgauucucauucgucagccucccaagaguaccugggacuacaggguagauuuuauuaauaaggucuuauugauaaaacuaugguaauagucccuuccccugaauuuuauuuuuaaaauucaaccuacauccuuguugcaaacuuagcaaugugagaauaggaggauuuuuuuuuuuuuuuuuuuuuuuuugagacagaguuuuacucugguugcccaggcuggagugcaguggggcaaucucgcuuacugcaaccaccaccucccggcugccagcaaugcuccugccucagccucccaagucgcugggauuacaggcauccgccaccacucccgacuaauuuuuuuguauuuuuaguagagacaggguuucaccauguuggccagacuggucucaaacuccugaccucaggugauccacccaccucagccucccaaagugcugggauuacaggcgugagccaccgugccuggcuguauagaaggaucuuuaugcguaagauaaacaugccuccuacuugaaugaugaaagacucaaaucaguccugccuuuugaagucaggaacuuaaauaagcuuguuuauuaucacggguaucauuuaaaguuauucuagaugugcuagucaauuuauaaaacaagaaaguaaaauaauguggacccauaccaaaaagaucagagaggagaggggauggugacuugccuguagaggaauuaaauacauuccacaacuucauaaauaauacugugguccugggacagggguagacauuggcagagcagaguaagaagaacagaaacagaaucaaagaaaaauaaauauuuaguauagauggcagucauauuugaaaccaguggggaauggacaaauuauguaggaaaaacuaauuauuuuugggaaaaaguuagacuccuaauuuauaucaaauuguauuucaguugaauuaaagacuuaaauauacaaaauaaccauaaaagugcuagaagaaaaccuaaauaaguuuuuaauccuaagggaggggagaucuuucuuaaagcagauauugaaaagagaaagagaaagauagauuuuacuauugacacauuuaaaacgucagaaaccacugaauuaaaaacaaaucugucguggcagcucacaccuguaaucucagcacuuuaggaggccaaggugggcagaucacuugagcucaggaguucucaaccagccuggccaacauggugaaacuccaucccuauuaaaaauacaaaauuagcuggguguaguggcgggcaccuguaaucucagcuacucaggaagcugaggcacaugaaucacuugaacccacgagguggagguugcaaugagcugagauugcaccacugcacuccagucugggcgacagaaugagacucugucucaaaaaaaaagcugggaaaauacucauaaaaaugucacaagaaaggcuaacaucccuaacucguaaagaguucuacugguuaauuuaaaagugagagaaucccaguggaguaauagaugaagggugugauaggaguagccauuuggcaaaaaagggacuacaccuagcucauuaaagugugaaaaagguuuauccucccaauuuauuaaaauguguauuaucuacaugauucuguuggaauugagagugaaugagguuguacaaacuaagucacucugauggagauggaguuuagagacggagucucagggaagguuagugcggccggucagugacugcucuuucuggcacagugcauacguccuugguaggaccuacauuuuaaaacuuauuuuuuuauugacuuuucuuauggaaaauuucaaaccuauucagaagugaagagaauaguuuaaugaacccccaugugucaauaccaggcacuccaaaacaguauacuuuuaucuauaucccacuguuuuucagcucccuccaauucaguuaaauucuagguauuugaaauuuaacaguaauuaagcucagaaaucuaaagcaaaauaauaguccccuccuacuccaucucucaaaaaaaucucaugauuguuaacuaguaaaaaauuuuguuuuuauccuuacauauuuuuauauuuuuaugcaaauaaguacaaacuaguauauauacauaauuuuauucauuuuuaccccaauaauuuguuggguuuacuucucugagacagcauguuuagaugaucucuuucuuucuaaagcugcacaguguuuaguaauguagucuauaauguauucagccauuucucagcugaugcucaugcauguagcuuaaauuuuugcugcuaccaaaaaaaaugcugaaauauauaccucaacgugaaaagacugaguauuagaagcaaugaugauacaguuuuucaauuaaagcuguuuauguugcuucugaugucauacaguaugggaauuuuuauuuauuuauuuauuuauuuauauuuuauuauacuuuaaguucuaggguacaugugcacaacaugcagguuuguuacauauguauacaugugccauguuggugugcugcacccauuaacucgucauuuacauuagguauaucuccuaaugcuaucccucccccguccccugguauguccauaaaacagaaugcuaagcagucacuaaggugcugcugcaaaucucugucugaugaggcggaaaagcaaauagauacugaggcaggucaggaagcugcguaaagcaugauuccaguuuggcuuagauaauaaccuguucaugucuggggacaaggaagaugacaaucugucuuccuccagcacccagcaaauauccagggagugaaaacuguucagaacagauagaccacgauauuacaugguuuuaucacucaagggggauuauggaugaucuucaggguuuuaucuuuuucuuucugcuuaucugucuuuuaaauuuuuuguacaauuuaguauguauuacuugcguaacauuuuaaaguaaaaguuagcaaagguaaacaugaggugggaagcacccaguggaguagacagcagcccauccugagagcuggggcuagaacgcuucaucccuuugcucaguuaagauguguggacaugggcgggucugcaccucuaagcugcugccucucugucacagggugccugcccccagguguauuugagaauaaaaauaaacucgaaguagagagguuuuagagcagaaagaaacagucauguucaucugcuaccuaaucugcuuucuaaauuugaguugccagauuugggccuaagaucugggugucccuccucaaauucuguguggucucaguccccucuuaaaugugcagguguguugccugaaauaaugaugacaaaacuagcaggccuggggcaucuuuggaucuccuaauauucacucugaaacaaauaaguagcauuuauuuuuuccagacaugaaaauugcauguaggucuaaguuuaaaauauuccaguuuuaguaucccuuguuaccauauuguuuuuuguuaaacuucacuaucccagaggaauugaaauaacgugggcacuguguguguuuucgaccuugaacugguacuggcagagaccccugauggaucaccaguucaccgaagcgccugaguaggcagggagacccguggagcaacacacgcauguucuccagccgggcugccauccacaccucauuaggaaugugacaguggagucacacuugaccggcugucgauggggcuaaugauuccaucucaacaauuggaacugugcccaggaacaauuaagcuuagcuuugacugagaaccuacucuuccugccagcucuaccucagguuguaagugaaagagcgagaccgcguggaggcuuagacgcauuguugggcacgaguuuuguuucggugaugaguaaaaauccaccugggggaugggaaguggccccacaccugccagccccgugggacaccagaccgaugucauggacuggugugucaggaagugccaugguccugccguggaggggucagcaccugccucccauagcacuuagugcaguucagucaggaccgugaggcucaaggagagggacuuacgcagcccagccuccuugcccugugaccaggguggcaaaaggaaagaguucaguucaagccauagagcuagauuccugguccccagugcuacaacccuagccgugugaucuuggaccucuggcuuugucucugugaaaaggagaccaucuuagaagccaccccguaagguugagaugcugcacaggaagacauuaguguaaugucuggcacacagaagccucccaggaauguuauuaauacugaauucuacuguaucuacuuuucuugagcagugaagcuuacuuuuugcucuuuuaaaaguaauuuaugcgugcuguaaguagauuggaaaauacagaaaagugggaaaaccaguugcaaaucauguaacuacucaaagcgaaucccugggagaauuuuggaucauguccuucuuaccuguuuguguguacgugcaguaguuucuugguuugcuuuguaguuaauucauaguuauaaucuuacaguuuauguuguaucuggcauccuuucccuuuacauagaguaagcguuucccaucaauguguacauucuuuggguuuucuuauucuauuuaggaaaagcuguccuaaggcauuuacaucagaauuucauuucaguaucaagaaaugcuaggcaaauuaguuguaacaucuucccccacaguaguauuuccaaaagauguacauuccaauagauauacuauuucucaaaugguaguucagaggacuagcagcuuucuagguaaaugaauugaacacuaugucaauuuugccauagaagcuucgaguguuauuuuauaacagagacauaacagcuuuugaccuaguuuguuuucuuucucuccucaggacaauauuccuaguauuacuguuuucucaauacgccagaaauguuaaauuuccucucccgauuuauaaauccaagaaaggauggacugcguacaaguuacagcuguucaaaauguucccugugaguagcugacuucuuccccugcugacauuuuugcccuugguuaauauguaagaugauuaagugaagggaggguuuuaagcaggcccuccuugggggaucauaucugugcagugagaccaggcuacuaaugaccacucagaucaucauagacuuaaacauucugauucugaaaugggagcacauccuuuuagcagugccgaaggaaggggacacuguccuugggacugaguaagauuugacuccacguggccucugcaggcacgauguccauucuuguuuuaccagccagacuuuggaauggguaagauaaguucaccugaaugaaacugcucucucagugagaguccauucaaggaaggucugcaaaguacugacuguggugggcucuggggugugauauuccgaccgcgggaagacguguuuuuugccaacaccugugagcccugcuggccugacagagcuuccccuugaccacuccagaucauccuggccauccugguauccuggcugcucugcuucaucuucacggugacagaugucuucccucccgacagcacaaaguauggcuucuaugcucgcacagaugccaggcaaggcgugcuucugguagccccgugguuuaagguuccauacccauguaaguauucugauggcuagaggggucaagagcccacgagggcccaacugagaggggugggaauuuggcagaacagccgucuuugucccagacugucuccugaaggccuugccauucuggucaggagaggauuagacagcaaguaagggaggcccuguccccagagggcagaaaccaacacacagagacugaccggcucccuucucacauuagcgagcugucucuuuuggaucugcuaggaugaaauccuggacaaggggucucuugccagguuuaagcucugguggccaggauuugagggcagcugcuuagauaggcaaguauagagcugcuuggucccagagcugccaaaguggaaagaugugagugggaacagccuggggauuagcaagcaaccugcucaagcaugauggaauuuauauaaucucuuaaugggcagccauaaucuuuuaaauuuggccacagcuguagagguaaguugauagucacuaauggccaaaagcugcaucuuaauuugaguguuguguaacuguugggggugugaauacauucccuagcuggggugucaccuggacucgcagcuggccccguguaggugaucccagugguuguuacacacuugguuccauugugaagacucuagucccggcgucuggguuuuuauuagaauuggagccugagcuuagucagguucagcccacuucuuucccuguguaaccaucuuauuuucauuuuuuauaaugacaaggagaaaaagagagaagccaagaauuuuaagguuggguuaaagaugacugcucugagcauguugaaugaugaguguuggcuguucuuuuuguucucaauacacuuaggaaagcuuuaaaaaguuucgucuuucaggccgggcgcggcgggacaugccuguaaccccagcacuuuggggaggccgaggcaggaggaucacccgaggucaggaguucaagaccagccuggccaacauggugaaaccccaucucuacaaaaauacaaaaaugagccaggccugaugacgggugucuguaauuccagcuacucgggaggcugaggcaggagaaucgcuuggaucugggaggcggagguugcagugagucgagauugcgccacugcacuucagccugggagacagagcaagacugucucaaaaaaaaaaguuucaucuuucuaaaauaacuuucucaucagauuguauggucuaagugugcauuuauacagaccuauucuuuuuccaagaaagaaugugcaugguucauaaacauaccuguagucugagauaaaaugaaauuacaauuaguuggugaggcagucagggugagggcgaggcggggguggcagguagguagaagcccccacagcguauacaagguggucuucugcuugugcaggcaacucccaaggugggcgccaguaggggcacaagcugggcuguccaggagaggcagcuguacaggugcuggggccagagggaguucacuaggacccauggggccacacacgagaaggcgaaacuuaguagacagagcgccugagguugugcuggccgugagcgagcacguagggcuccuggccugccgagggcuggugggguaccagagcuccauagcuagaaagccaccuccagggauauagucguacuacuguauacauauguaguacucuccagugcuuugucucaagccagagaggggcuuuugaauaccugagcagugcuuuucagucuuuaguacacuaggcauggucuggacugauuguuaauauaauacagauuucuggugcaaaaugucaacagugcugagguugaaaaacccugcugucaaguaacaaacuaaaugaaaguuucuugguaaaaggagauaugaaauaacagauucaagagagaaggcuggaagccaacaaggucuuuaagaaaaaaaaauauagauauagauauauagauauauaucugaaggaaaaaggaucaaaauaagaaucccccuucaaaaucaagacacuaaacuugaaugcuacaaccagaauucuugaaaccagaaugcuacaacaauaacaagauaacaguauaaaagauaauugagaaaaagcaaaauguuccuuggugaggaaggccucugaaugaggaaaauccauuccaaauuaaccuggagcugauacguugagcaggccucuugcugguggcauagggugugucgagccccauccaucaaccugcguaccuugcaccccugaccaagggccgccucugcauccccuggcugcucccacagaaugaacaagccugaggcaggagcaauucugcccuuaaccgcacuccaggcuuauucugcacgucugacuuuguauccuuucucuucccaauccagugguugcucuaggcuaccuacaacacaggccaaaccccucuagguggcuuagauggcuuuuggaacacuuccagaacuugccuccugcccugugcccugcaugagagcucugcguucaccagaacacccucaaaccccacccuccagacccucccgaucccuggaggggcaccuccguucccaccuccuccucagauccuucccuggccagggcccgacuucgccuuuuccugaccaccucacuggugcuucuugugacccagcucagcuugccuccauuugaaguugagcaauuucccucucccuggaucuuuuggaguguccuguguccccagcuacguuguuggcuccugcaugagagaccauguuuuagccaucguucuuuucccacugugcuuucugcucagugaguguauuauaacuaaugcuucaacggaagaagggcuacuccuuuaucaaaggagucuauucauucucacacgaaagagacccaugcuauuuuuguuaaguaagaccuauggcuuucaaguccaaauaaauauacuugugaagaaaaaaguaucuaaugagggauuaaguaaaugcggaacuuaaaaugaaguuucaguggggccucacuuugcuuucugaaaugaaacuauuuaauuucccauaacaugguuuaugauauaaaaauaagguucugguauuauaguagagaaggacuguccauaccuuauggaugcuuuacuguugggauuuaaguuuagcuggugauuucucacugccuuuucacuugauguccuccccuggggaaggccacugcugcuuuguacccugcucuguacagcagggcuauaaaucccucauacaaauuucccaacguggcagggcacuuucaguuguuauuuaguggauacugaguguggcuuggaagcaggaaagagaaguuacagccucuuccagcccaacaaugucuucuucuuuuucuucuuuuuuuuuuuugagauggagucucgcucuaucacccaggcuggagugcaguggcgcagucuuggcucacugcaaccuccgccuccuagguucaagugauucuccugccucagccucccgaguaguuggaauuacaggcacaugcccccacgccuggcuaauuuuuguauuuuuaguagagaugggguuucaccuuguuggccaggcuggucucgaacuccugaccucgugaucugccugccucggccucccaaagugcugggauuacaggcgugagccaccgcauccggcuacgauguuuucuuuuaauuaaagacacagugcacaucaguccucauuauggccgccuucaucugacuuagcaacugucccaggcaucuggugcuuaagauuuuaaaaugaacaguuuccaugagcuucagaauccaaguggaucuuguagagucuugcagcguucagaaugacuuuggguaacugguccuggucacuuucgccugccucucuaggagcauucaugguuguuuuccucccacaguucaguggggacugcccaccgugucugcggccggugucaucggcaugcucagugccguggucgccagcaucaucgagucuauuggugacuacuacgccugugcacggcuguccugugccccacccccccccauccacgcaauaaacagguacguuccugagaagacaaguuccugauuggucccagcaccuuguuacuuuguucuuagguuuacauuaccuugaagacaaaaccaagaguuucagcaggagcccagccaagcagcaggacucuagcgacuguuugaugcaucaccaccuuuguuuacuuucgacugucugauacaccacugccuuuguuuacuuucauuuuccucguccaugacguggaacggaauuccuacccuuccuuaauugcagugacaucaaauaacacacucucugcgaaaccacuguaagccuuaaauucaaaaaccacaugccaagcacugcacuuguucuuugcuuuuuuuggggugugugugugugugugugucauuuggagauuagauagauaaaaucaaaguagcucugucuauauauauauauagagagagagagagagauagagagcacuacuuugauuuucuguuaucuugccuuuccaacuguucuuuuuuuuuuuuuuuuuacacaaacugaaauuuuucuucccagcaaaacaagcucuucacugcuuacagguuuuuuuuguuuuuuuuuuguuuguuuguuuuuaauuuaaaaagacccagggucucaccguguugcccaggcuacagugcaguggcuauucagaggcacaaucguaaugcaccacacucuugaacuccugggcucaagcaauccucccaccucagcaccuugaguagcugagacugcaggugugcaccaccauacuuggcuauacagugcuauuucuacauugcaaaaauuaccuguuuuuuucccuguuuccccacccaaucuuggcugccacaaucggacagacagaaagcacaaggauaccguuugcucuccccuguaguggaaaccuuagcagcaggcaguaugccccaggucugucaauuagauacguuccaauuguccccaaggguaagcacuguguaaucuaugcacaguuacaguuuauauaaauagggacaggaauagcagaaaugaaugaaaucugugggaucuagggcuuaugaacuaugggguuuaugauuagcuuuuagaaguugucagaugauugccccugaggagucugcagagaaaagaaaacagcccagauccccuccuguucuccagccagcucuguaaccccagaagggacugugugugaugagauuaauggacugggccuuggcucugguaccugauguccccaucuuucucuaauggagcugcugcacaugauuaaauaccuguauaucaguauguuuaaaagugucaguacuuaugaaauuauaaaacauuuccuuccugaugaaacuggauuuuaagaguaaaggaucacaucaauguuuuauuuccauagacggcccauguuugucuuauaccccaacaaauggcuuuauuuucuggcuaaaauccuuugcuuucauuugcggugauuuaaaaacacucaaaucuaacgugugauuuagagaugugcuucucaaaauggaaugagcuuuggggguucuguuaaaaugcagauucuggccgggcacaguggcucacgccuguaaucccaacauuuugggaggcugaggcaggcggaucacccugaggucaggaauuccacaccagccuggccacauggugaaaccccgucucuacuaaaaauacaaaaauuagccaggcaugguggugcaaaccuguaaucccagcuacucgggaggcaggagaaucucuugaacccaggagguggagguugcagugagccaagaucgcgucacugcauuccagccuaggugacggagugagacacucucuaaaaaaaaaaaaaaaaaaaaaaaaaaugcagauucuuuucugcuucagcaggucugggguggggucugagauuguauuuuuaaucgcccucccagcucccaggagauguggaagcugcaggcucuggaccacauuuuuggauuguagauguguagaggcuauuucagagugaaugcauuaucccauugaaugauuuucuuuccuccauuccuuuacaucuuaggggaauuuucguggaaggccucuccuguguucuugauggcauauuugguacugggaauggcucuacuucauccagucccaacauuggaguuuugggaauuacaaagguacacagauuuuucuaauuaaaugauuggguuucuaagcauugguccauuucauugaucgaucuggccacugcaaguuccaaaugggcgggccucugguucuaaaaaauuacuucucuccuuuuuuuuuuuuuuuuuuuuuuuaaguguuuauaaugccuguuuggaagucucucuucucuugcugguccggguagggaggcacucagugcugucauuccaucaugcaguauagauauuuauaaagcacugacucugccaggccacuguucaaggcacuugggauacaucagugaauuaaaaaguggaguuuacauucuagcaaucaacaaucagcauacuaaguccauaaaugaugcauuaugucagccagugacaaguacugggggaaacaugggacaggaagcuuggggagagggugaucaggugaccugaacacagaccugaaggguggagggagggagccugcaaauaaccugggggagagcguuccaggccaggguguggccagggccgagcccuauccuggaaguggaaggucagcaaggaggccagugcgggucagggagucagagcagguggggucugccggguaacuggggagcagguuacacaggcaggcagguagguaggcagccacagacugccugaguggaagggagugcugcagggagcagcuuggucagauuuuuuuuuuuuuuuuuuuuuuuuuagggaucgcuuugacugcagugaugagaauagaccauggggggcugggcaaaagguagaaaugggaucccaacugggaggugucacuaguuuuaaauuaagagaugacccaccauuggccaugguauguugugaaacuaagaccaugaaaauugguucaccauccucgauggccuacgucucacaggucucccucacugaggacuuggggugagcccggaaaccuucuagaacugguugaccucugucaaauugggagggaggaguggauuucaaaagagcucuccuuugccauguaagauucuauaaucagauaaagagaaaccagauacuaaguuugauuaaccuugauugcaaauccaggugagagggagcugccaggcaggcacacacaugccugguuuguuuguugguuuccccagguuggcagggcccugccagagcucagccugaggugugccaauggccccaucugccuguugcucccuguaugggggaugugagggaagguugucugaggggcgcuuccucuagcgccauccuggagguccuuuugcuacccauggugagaagccagugcugagcacagggagaugagggaaggaucucaugggcacagaauggggccuaagccaugccacucuucagccaguuugcugccaugagcuugcaggcauauaacuaaucccaaaucucaaauaagauagccggcccucuguaucuguggguucuaccaacuucaauucaaaaauauuguuucugaacuaauauuguuuguuucuguacuguucugggugagcauguacaaacuuuuuguugucauuauucucugaacaaugcagucugacaacgauuuacagagcaauuacauuguauuaaggauuguaaguaaugucgagaugauuuaaaguauaugggaggauauuggcuggguacgguggcucacaccuguaaucccagcaguuugggaggccgaggugggcagaucaccugaggucaggaguucgagaccagccuggccaacauguugaaccccugucuccacuaaaaacacaaaaauuagccaggcuugguggcuggugcccauagucccagccacuugggaagcugaggcaggagagucacuugaacccaggacgcagagguugcagugagcugagaucaugccacugcacuccagccugggugacagagcgagacucugacuccaaaauaaaaaauaaaaaaaaauauauaaauaaaauaaaguauauuggaggauguguguaggcuacaugcaaauacuacaccauuuuauaucagggaguuaagcgucugugguuguugguaucugaggcggggagaguggcgguccuggaacuaauucaagguucccuagggacgacuguaggaguaaaauuguuguagaugaagggaaucuuaggggaagaugguguaacaagccuccuccuucugcaccccuuuaaaacacaucaucauauaauguggccaccaagguaguuugggaaaucauuccuuuuauuaaaauuugaauggugcuagcuuacucugacaaguuaccuugccagcacuuuuuaaugagcugauguaucccaagugccuagaacaguagccuggcagagcgggugcuucauaaauaucuauauugcaugaaggaaugauggcaccugagugccucccuaccuggaccagcaagguccaucauuaucguuauuaucauuauugcuauuuaccccuuaguuuauuucuaggaacagagcaaguacuaucucgcuggccgucagaucucuuuguugguguccagaggaaggucauuucuccuugcugcauucugcaccaccguugaagacuuuguaaauccagaaacccagggucuauuuuaccaagguccuagaggcagagccacaguucaggagggaggugccaaggagauuccagggaauggacccugugagaggggaagcaaagguccuggggaagcaccgggaaggcugggauuuuagggcucuaucucugguaguuagaauaaaacauaauagguacuuggucaauauucauugaacacaagaauggcuuaguugcugcauauauuguugacagcaucaaaggcagaucagucuucuggaugucacuuugcuaccagauuuaguuucagguaucccuggggccaguuuggcccuucauaccuaacaggccugcccgacccugccaggagucuuugcauaggcuguuuccucugccuggaugcucuuccacuagcgaacucuuacucaccccucaggaccaucuccaacaacccuccccaacucuucagauuuucucuucccugcugcugggcucccccaacagcagaacagcauagcagugagauuauuugaucaagcuugugacuuauucaucuuugcauucaccugucccagucuaacaagucacaagcuugaucaaauaauuacauaguuccucgaaaauguuugcugaagauagggccauuaguaaaugaaagccuuccuuauuccauaguaacagccaagcaugagucgcuuuugcuugauuugucaguuugagugaucuuuuccauugcuucccugccgucugugguguggggcaggcuagggacagugagacagugacugaguccagcugggcagccaucucucaugugcacagccucagaucaggcucugaugcguaacuggcugacccugguccuuugaggguucugugcaguggucaacaugucacacacagcugcaccagccacgugugccuggugggcacuugagauguggccgguguacgugaggaauugcguuuaaaauuuugucucauuuuacuuaauuaaaauugaagcaacccucuucuccucacuggggucauacauaaauccuuguggauacucccccaaacacucuggaaccuccuuuacccaguuuacauccuuaggguguuuuccugcaagaggcagcacagaguaggggcccauagugcaggauuccugagccugaugccagcaccaccucucacguguggugccgggaacccaggggauaggcaggggcaaaguguggccuuugcguugagacacagagggccaucccaacccaugacuggugacagcaggcuagacagaagcugcugggaggcagagaucaggaguagcagauaugcccuacauggugcuaugagagccuauaaugggggaauaguccuggaguugggaugcuuuucagaggagcauuugggugauguuuaaaaggaugcaucuaggaucuggcuaggagggaaccacagggaaggguguccagguagacaggcccaggccugccuggugugcuuggaaagagccugagaagugggcuuuauuucaugaguaccagaggaugcaagcaggggaccagccuccccaauuucauguguuagaaaggugaccccguggccccauggaaugggugcaggaaaggccaguggcagcaggcccaugugggcggcucucagauggcucagugcgugccagcuaccauucaggcaguuuuaugcaggucccguuuaauccucaaaacaaaaccacgaggcuugugugugacugagaugaagauccugagacucuagaggcuacgggucggcccgaccauacagucagacgugggccaggagaagagcccgcagucaggcuccagauguccucauccguagccccuucucuuuuccaccucucacgggaagcgugccgugaggagaggagguuccagacaugucuggggguuuggucugauuuccgguguggggaaguuggcauugaggcugaagcacuuugggggaaauugccuuggugacauguggugccgggaacccaggggauaggcaggggcaaaguguggccuuugcauuugagacacagacggccaucccaacccaugacugugccagggcaguagagcccugaggccugagugcagggagugucaccaaggcuuggagaugcagagggcggcccucaggguccccacaguggaggugagaagagugggcugaggaggaggugaagguagcgagccaggccauggguaucucugcuguguguucuuuaguaacuuacggugauuuugcauggagaugagucccuguuucccagucuccuguguguucugcaggucggcagccgccgcgugauacagugcggagcagcccucaugcucgcucugggcaugaucgggaaguucagcgcccucuuugcgucccuuccggauccugugcugggagcccuguucugcacgcucuuugguaagacuccccucucuggcuuuuuccuuuacuuuuccaaauuuuuaauaggggucaugguguuuuugcugacucccuucaguaagaagguaacgauaaauuucuauuuuaaaauacaaaggauaugccuucaaaaaaugaaaacuuuuaucacucucugaguugaauuuauauuaaauauggaaccaacaauaagauguaauugugcuaugaacauuucaauuaaauuuaaucucuuuaguauuucugaccaauuuaacucaaauaccaucccucugaaugggcuacuuaaaacugaccauuuugacagugggacucuggguuugaucucugcaccauuuagcuguaauaaccagagacaugcaccagauauuuagguaggucucccuguuuaaucaaaauguuuguguagagagagaaccaauguccuuaguuuucuauuugacaaacaaaaugccacaugguguuuaugcucccguaggagcccaaauagcgcguacgccgagggucauuuggcucagagcgcaggguggcuacagucugaccccacacgucccccuuccugucccugcacuggucucauugguuucuguuggacagagaaggggugccagggagccugcccucaccugccuugagcuguccccgcuguaguggugcuggagcuuguggucugguuuguuuuucuccaggaaugaucacagcuguuggccucucuaaccugcaguucauugauuuaaauucuucccggaaccucuuugugcuuggauuuucgaucuucuuugggcucguccuuccaaguuaccucagacagaacccucuggucacaggugaggaaaugggcuuuacaucuuggagugggagcuggaaccacagccgccaguccacacgcagcucuuugcccauuggagaggacuuugggccuccaggagcuguggugcagaugcgucuguggaucucucuugaaucucacuuuucaauacuuaccuggaagcgcugugggcuuccugcuggcguguacacauaacagucauggaugcuaaggucucuuuuucacugggacccucuccuuugggagaaugccucucucuaaaugcuuuugauuucauuagucuaucuuaauagacuaaugcuccauuaagauaauuuuuuuuugaaacucaacuucauagacuuugaacacguuauucuacuauuugaugucuauccuauuaacuccucagagcaaaaucacguggcuugugcauucaagauuaaccuuuuuaacuccuccuuuuguuuuaacacugcaauguccugaggaauguagaaaggaagaaccgucucaagacauagccauugcuacugguaauaucuuagccagugcagaauugaggaguguuuguuuauacauauauuuuuugugggugaaauucacauaacaaaauuaacuacuuuaagcaguucaauggcaucuaguacaguguugugcagccaucaccucuguccaguuuccaaaacauuucauuaccccaaaauaaaaccccaaacucauuaagcaguaaauccccaucaccgccugcucccacccgcuggcagccaccggugugcuuucuguuucuauggauucacggucuauucuagguauaaauagagucauaauauguggcuuuuuguaucuggcuuccuucacuuagcauguuuucaagauucauccauguuguagcauguagcaguacuucauuccuuuuuuugagauggagucuugcuuugucgcucaggcuggagugcaggccugggcaugaucucagcucacugcaaccuccgccuccuggguucaagcgauucuccugccucagccucccaaguagcugggauaauaggcacccaccaccacacccggucaauuuuuguauuuuuaguagagacgggguuucaccauguuggccaggcuagucuugaacuccugaccucaagugauccaccugcauuggccucccaaaguguugggauuacaggcgugagccacugugcccagccucauuccuuuuuuaugacuagauaauguuccuuuguguguauauaccauaaauuguuuaucgauucauccauugauggacauuuggguuguuuccgcccuuuggcuauugugaauauugaugugcaaguacaaucaguucucauuauucaugaaguuauguuucguagaguugccacaagcaguauuagcaaauacugaaccauugcuggggaaagacagucagcaaugccacagcucaugccuggauggaucuucuuuaacacacaccauagccgccuuauguguagaaacgucagggagcacuucacaccacuuggacauuuuaaacagugagaucaccaacggaaagcacacgguaugacagacauggcacuacauaguccgcaaaaaggacucuuguuuacaggaugaggccagaacaaggcagagcgucagcuuauuugacaucagucaggaauguauguggcguggcucagauuuuucacugcucuguauacccaugaaggcaccaaggguauucauuuuggguuuacaaauacauuuuaguguaugggcaauuucacaaacacguaauucaugaauaaucaaugugggccauauuugaguacuuguuuucauuucuccuggguauauaccuaagaguggaauaauugggucaugugguaauucuauuuuuaaccuuuugaggaacugccaaacuuuuucauggcggcugcaccauuuuacuaucccauuagccauguacgaggguuucuguuucuccacauccucaccagugccuaugauuuucuguugaggauuauucuaucuuccggauggaaaguguguggauaaaugagauucuugcuguuuuuuacauuuaauaugucauauucaugggaggacaucuuuauaaauccaguugccccugauuaaaagcagcuaagcacuaauugauaacccaggauacugaaaagucuucuaugacugcaggugccagaaauauuuuugucaucuuauuauucacuuuguaauuuuuucucagccuuaugacuaccauuuuuuuuuauuuagaauuuuuuuuauccaccgacuacaccccuguggcuucacaguucguuguagggugaacaccacucuuagauucaucuucuaugcaccacuguugggaauucuccuuauggagauaccuuuggauuauuguugaaaguauucaucguaguuuaaaacauuacuggcaaaaauucaucuacaugugcacaacuaagaaauguacacuuuccuuuccugcuuugauuggcggaguucugcccacaccauugccccuucccaagucaagggcaggcucaccgcugcuguggcacugaucguuuauggcuguguucucuuucuagggauaacaggaaucgaucaaguguugaacguccuucucacaacugcuauguuuguagggggcuguguggcuuuuauccuggauaacaccaucccagguacgugguauauaucaaacacacuuuuuuuuuuuuuauuuuuuaacauauguguuacuuuuuuugccaaauagaaauggaaaacgggaagaguaaaugaguucaaagccaucacugguuauaacuguuuucuaaaacaguugugauggcacucccagccuccauguaugaaucaguuuuuugcuacauaaacugauuaauuuuguuucucgugcugaaggacuuuugggagacagcagcugaguucgcugcguuuggugagauggcagugggaugggcacaggccaggcuccugucccccugcacagccugugccaaaggcccugcaguguggguuucaucugaucugagagaggugggcacagcccguggcacuucugcuuggggagacugucccuuaaaugaguuguuccuaaggugggcuuccagccaacuaagaccagaaggcaguagaagaccaugggcaaaggcugagaucagggguccaggaucauugacaagagaugccuggaggcagcugccucuccaauacccaugaucccuguuuauggauacauucugugcugagcuugggaugacagacuaggauguuauguggguccugccuuggcgguggcugcugugggccacuguaaagugcugccauggacauacuggcagauuucccugccuucaaggaagggugauacuuauucuuaggcucaaagguuuuguugagauuuuccccuuuaaacaacccaucuccaaaaaaaauaaaaaaccucaaucaagagauugcuggggaaaccaaggcagaaggaaucacacacacaaauagauggaaggcacuggauuuaagaguccauaacgacuacucucuuucucuccuaagccagagggaauugagagagggaugcaacagucaggcugauggaaauuaaagucagcuuuauuucugaaauacugaugagagagcagagcuuagauauaaaaaaaagucaugagcuuccuugcugagcccugugugcucagagcuuccucccugacccaucugucagggugcagaguggccaggaguguccaaccgguggauguucauccccgcagaagcacaacagguacaugaccugugugucccccauagcaccagacacgcuaaaauggagcaaagcagcaugaagugugggucugucuagaugggggggugaaugugcagugacugguugaugaaggcauugugugauacaauaaagauucagcccuguuuugcaaacucagauuugcauuuuaaagagguuuuuuuuugacucagauuuacauuuuacagaguuuguuuuguguguuuuguuguuuguuuuguuuuguuuuguuuuguuuuuaagacagagucuugcucuguugcccaggcuagagugcaauggcaugaucucagcucacugcagucucugccucucggguucaagcaauucuccugucucagccuccugaguaguuaagauuacaggcaugcaccaccacgcccagcuaauuuuuguauuuugaguggggacgggauuucaccauguuggcuaggcuggucucgaacuccugacuucaugugauccucucaccucggccucccaaagugcuuggauuacaggugugagccaccacaccuggccuagagagguaguuuuugagcagaccuggggcaggaggugaugagccagaagacuagguaaccagaugggagaccgauagaaugaaccaggaaagcaauaacauggccugagcugggcccuaacagugaaaauugagaauaugggucacauagaaggauagggaggucagaaggucauuaggugauugcuugaaugaggacauggagggguuagugcuucuuagacuucugguuugggcacuggauagcugagcaccuucaccuccucaaguauucuuugcuguuaucuaggcagguuugaucugugggaccauguguguguguguguguguguguguguguguguguguguguguguguguguguauguguuugacgacaguuucauuuucaguagagcugcuaaacgaagcauuccuuuguucuaucuugggaugugugacaggcacuccagaggaaagaggaauccggaaauggaagaagggugugggcaaagggaacaaaucacucgacggcauggagucguacaauuugccauuuggcaugaacauuauaaaaaaauacagaugcuucagcuacuuacccaucagcccaaccuuugugggcuacacauggaaaggccucaggaagagcgacaacagccggaguucagaugaagacucccaggccacgggauagccuuugcugugcccuguggccuggccgcagugaggcauguaucuguaguuccuugcugaguaacaagaaguaaaauacauguuuguauaucuacauuuacauucugcgccccagagcuaagacagacugcgaaucacuuuucugcugugagggugauggugccugaugcggugucucgccuaucuccuuauuuaagcccuuaacuccuugcccuuugagaguguccauugcuggccauggucacuaaauuugaaguuccaguccucccuuuggaguggacauuuaaaaucugcagccauuccuugcuucaguucccuuccaccacccagggcuggcuuuccuauaagccaccuccaggguccaggggcuuucucucucucuccgaagccccuggaccuguuuccuugucauuugacccucgucugugcccgcggagaccuccucugaccaaggggcacuaguaugccuugcgcuaucaugacugacuggcccaguaugauucuguugucgcugaucucccggaggaggaggcuguugaccugaaaacaguggcguggcuccccugugcccagaucuggccaugggugaggccugcacagauguugaaugaacaucuguuuggggcauuggagggaaaaggaaaggacccugaagccaauaucugauucucggcugcaccuucucuuggccacccuggcccugaccgggccagcacgugcacacuggccucuuuucauuucacuaguggccgagacacccucucuggcauuuaucacuguuggccggugugaugaguauagagugccacccaaggcaccagucacacaagcugaugggcgucuuggcucugccgucauguggauguuauugucgcgcgcgucuauaauuacaagguuuuauuccuauuuaauguuauugacuauagcagauuuuggaaaucaguguuuuccaugugacccucuuuccuugcaucccuauuccuugucccccacccacucuuccccccaucaagaaaagaaccagcauuuguaaagcuguggacaccaucagggaagcuuguuguaacggcuuuugaaggccaguaaccauuguugugguuguguuuuguauugcuugauaccaugaaaguguaaauacuguaaugccuaaucuauuuaucaaaacugacuacuggaccggagcccagaaaccaugggucaaguuacacgugaauuuguuuugugaagaagggaagcuggggcagguaacacgcagagccgccacguggaacggucuguccgccggucugucccgcuugccgggcuucuguugcaagucuuggcuuaaggagacuuccuguggguugccaugucgcacguccguuagaucuugauuuuacaggugagggugguugccaaaggugauaagaaaagcagccaacaggcucccucucacuuaagagaguucuaauuaauaacacuaaauucuuccugagaaaugacuccucuugguuugguuugaaguuuuucagugaaggaaaaggccugagauaggaagcagugcccucgcuucaugagguggcacaucuucgguggccguuggccuggucgagcuuuggucagcugcgugggugccugucuccugucuccagcggcagggcaugguucuuggcagccugguguccacacggugcauuccugucccccucggccccaggcuggcucagcucuccagugcugcggcgcugucuuugcagcauugccaugucaccguagcccccuucacucuuggaaguuuggggcuucaagguuuauucuggcaagaacaccucggagccacugcauuguuuugccaaaaacuuacugcagauuaaguaaagaacuuagaugcuaaauuacaucuaauuuuguauguuuuuuuaaaugugucuuugaugcauacuuuagaagcacacuggcucgcgguuuccaucccucuugccuugggacacucuugaggcuggcagcccuccugcaaugaguugcucucaguuccuucuguuuggauuuugcucaacaucuccaguuucucugcucugaaaaauggggaaaacugcuaaacaucccagagauuugcaaucuucuagcucuccaggugagcagaaagaccaaauauccaaauaaaagccugaaagccauuggugauccaggggcaccuucucuucagcuugacugggcgucuuccgcugcauaacacucaaggugucugcucuagucauccagaaacccacucccuucugaagccccuccuugggccggguuguaucaggaggauucaaccccgcuaacauguggggugcccucuguaggccuucacacagggaaggaagcccuacccuuucaacuccuguuggagugagaguuuccuguucugauuccacuguggccaacccaauaauucuguccgaggagggguaagggaauaggagguggggagcaaagagggcagccugacuagaugccccugcugaaucugguacuuucugcacagccuugagugauuggaguccccuaaugacuaauaaacuugaacauguaacacacacacacacacacacacacaccauuuuaggaagugguucuccuacuggaaaauaugcuacagaaugaaaguuuguaauugaaagaaaaagaauguauucaucugcuucuuggguuuaagcacacaccugaaggggagauauugggggacacgguggccacucgcggucugugucaugacacuucccauucacaucauuggccugcguugcuggggcuuugaaccaccaccccguacuuuguuuugccuguagaguguuguaaaauauuuuggaugugaauguccuugcaggccgguuagucuccaguuuccacagagaccaccuacccaccaccuucccaggucaccugccuggucccugaaagaaagcauuugugugggcaaucccaacaugaaauguagacagcgugaauacggacaggaggugaugccauauucacagugggggauggagggcccccaccccugcuucacagaauaaugggaagugacucuagucuuuguaagcaauuuucauucucauuaggaaguuaaauguagauucacagauacauuuacuuucagaauccucaagaggauuucaaaugcuaacuuuuaguuucuugggauugaucaaggcaagagaaguggcuuuaaccaugccagccagaaugaagcaucauggguccugaugguuucccguuuucaugguaacaaauucgcacagagguuuugcuuuaugcuguagaauaccgacuuucaugaugacaacuugguuuaugcaugaauauugcaguauuuccauauagcaaaauaacauuucuacccaggauaauagucacaguuuuccagggagggaaugauauaauuuucaugacaaugucaugugaugauagaauuucuccauugaugaaucucuaguauguguguauacuuuauuuacccauacguauauuuuaugaccaugagcuaaguuguuauuucuuucauucauaucccugcugaaauauugguacuagcaacuuaaaguuggcaagucucaucuucaguaauacggaugccaugggaguggccaggccagauugaaggugaauauggagcaguagcagaagccucauuccagaacccaucuggccagagaagcagcagcauccugggggauggccgugcaugggguguacacucgcuauaggcauaggcccggcauggcugucgcuggacgccagcugugcacacccagccacaccugcugcacgccgcguuagugugcggcuccgggccugagcauucgcaaagcucgcuucuccagggagccuccucuuggcuuuggaaaagagcccagggacuuaacgugcugccuguuguacucuguccccucaugacuuuuuagacacagggacuaggacaucgaccacccucugccccuccugcagucagaacccgaguagugcaagaacggccacccgguuuugccagcguucagcgucugcccauggacccauaaggcacauuagcguugggggucucuuuucagcagccucacagacauucccguccuuucugguugguguugacuguguuucagcaucacucuacccucccauguccuuagcauugcugugcguguuuccaggcacuuaggacacccuuccccacguugccaucuuacugacaguucaaaugacucuccuuuuuuguucguuaguaacaaucuucauuugacaccuuaauacauuucugacuguucuuaaaacaguggggaugccuauauuuuccuugaguuuuugugacugacuuuggcuauauauaccuuucugggguuuuguuuguuuuuuauuuuuauuuugauuaccgaggguauuuggggugggguuguuuuuugagauguguaauucuuuuauggaguuuuuaaaaagaauuuucauauuguuuuucuaacauggcuucauuaaacguuuaaguauuuuaaaaauauguaauauuuggaccagauguugugaauaauaguagagauaaagcuauuuuauucuguauuuuuaaaacuguuccguacaaauaaaagcucuccuggacacagu

SEQ ID NO: 191245 - RNA, 13250 nt, Homo sapiens
acuuccggcgcacugaucccgccuggggccggcugaguggcacuuaagcgggccaugccaugcaaccuugggcgcugccaaccgugggcgagcucugggugugcgggcggccuggcgcggcgcuccgguaaggcgugugugcggcagggcggggacagaaccguccucucgggcucugggcguguccgagaccgcgcuccccgccgaaaucaagcuccgagucauccguguggggcauucguccccccuggcacaguuggccucuuuccagaagcccguuuuguuuguuuuacgucuaaauucgcgucgguucuuauuucucucccuggcaaggucugaagacggguaggagaauaacguauguagaggcgcguaaugccaggcacugugugccaaacguuuuaugaugcuuuuagaacucucguaacauucaggugcugagggaguuuggggguagcggugagcugguaaaaagccuguuggcaacgaagacugauacuuugaaaaugcucguuuuuauuuuucccgucuuuuagaauccucuuugccaagaguaaacauucgucuccccucucccucacgccccugcgauguauuguuuugaugcggauguaugaacaguuaaugucaggggacguacuuuaaaaaaaagucuaauugcaaguuagaugugguuaaaugcccucaaaaaccacacauacugguaguuugaacuuuguuuuauagaauuaaaugcagccgggaucacaacacuaaaaaccuacuauuugacacaguuugauccaaucuuuuuugaaaaguauagagauuaacauuaugcuaauuuuuaaauacuugauuucuagaccaggauguaaucaauaaaaacggauauuaauauuuagcaccaauuauuuaauuaugcuaguuauuuuacauugacugcaagccacguaaaacaguuaggccgggcgcgcuggcucacgccuguaaucccagcacuuugggaggccgaggcggacggaucaaaaggucaggaguuugagaccagccuggccaauauggugaagcccgucucuacuaaaaauagaaaaauuagccgggcgugguagcaggcuccuguagucccagccacuugggaggcagaugcaggagaaucguuugaacccuggaggcggagguugcagugagcugagaucgggucccuaaacucuagccugggugacagagcgagacuccgucucaaaaaaaagaaaacaccaaaaaaaaagaaaaacaauuuguuauuuuuuggaauuagguauguacaaaguacuuagaacagcuggcaucuaacaaagacuagguaaguacuaaccaccauuauugugaugaugauaaugaugaauuuuaaaaaugccaucccagagaaaaacuaguccuuuuuuuauguugcccuuaugcccuuauugaaauacugaauuuuuuuuuuuuuuuuuuuuuuuuuuuuuuuuuuuuuuuuagauggagucuaguucugucgcccaggcuggagcccaguggugugaucucagcucacugcaaucuccaccuccuggcuucaagcgauucuucugcuucagccucccgaguaggugggacuacaggcacccaccaccaugcccggcuaauuuuuguauuucuaguagagacaggguuuccccauauuggccaggcuggucucgaacuccugaccuugugauccaucugccuuggccucccaaagugcuaggauuacaggugugagccacugcgccuggucaguuuugucuuuuuuaaagauauguuuuugaauuuagaauuuaaaaacccugacuaaaauauauuuacccauuuugaucauauagcuuuguuacuuuauggaggaaaaguggacaaauuaaaaaaaaaauuuucuuuuuuuuuuuuugacucagggucucauucugucgcccaggcuggagugcaguggugcagucucggcucacuguaaccuccgucucccaggcucaagcuauucucgugccucagccuuccaaauagcugggauuacaggugugugccacugcaccuggcuaauuuuuguaguuuuaguagaaaugggguuucaccauguuggccaagcuggucucgaauuccugaccucagguaacccacccaccucagccucccaaaguucugggauuacaggcgugagcuaucacgcccggccuauuaauacaaauggucuuaauuuaaauguuaugauuuuucaaacuuacccacugucucuuaaacuagugacauaauagccaugauuucauuacugcugucugcuuugaauauuuugaacaagaagccagguuguuauuccauuuuuuucuuucuuucuuuaaaauuuuuuguaagauauuauaccauauuccguuucuuaagguugguacagaaguaauuaggaaaaugaaaucacuacuuucagugcuugggaugggacagagaggugggcgcuucuggaggcacuaguauagccaggccuguauccaaauuuacaaggggcccggcacaguggccuguaaucccagcacuuuggaaggcugaguugggcagaacacuugaggucagaaguucgagaccagccuggccaacgugguaaaaccccaucucuacuaaaaaugcaaaaauuagccaggcgugguggcacacgccuguaaucccagcuacucaggaggcugaggcaggaggauugcuugaacccaggaggcagaggcagcagugaauggagauugcgccacugcacuccauccuggacagcaaagugagacuaucgcaaagaaaaaaaaaaaaacugaguucaagaccagcccggccaccauggugaaaaccaguucguuacuuaaaaaauacaaaaauuaacuaggcaugguggugcauggcuauaaucccaacuacucgggaggcugaggcaggagaaucguuugaaccugggaggcggugguuguagugagcugagaucaacccacugcacucuagccugugugacaaagcaagacaccgucuccaaaaaauacaaacaaacaacaacaacaaaaaaaccccacaaauuuacggcaagaaacuuuacagaucuuuugcauuaaaagguugaucucuaucaaggggaaauaggcaaaaugcugaugugaguguauuccauucucugcccucuucucccucccugucaaacaagagaaucauuugaguauaugcuccucuugcuuuuucuuaagagcgggagcaggggacaggcaaugcuguggugucagguggaccuagauuuaaguccccauuauucuaccuagucucuaugugacuuuggaaaaauuaaaagucagggaaucuugguggcaaaauaaacuggaaugugauucuuggugagugucuucacugucauucuacaaggacagaccagacuagauauuuaauacauagugagaaucuuuucacugugucagaggcauaucugguuuuccauaugcauaugccucugacacaaugaaaauuuagcagugaaguguaaauugcccauugcuagucugacauggcagcccagaacuccagugcacagcaucuaauaauccugaacucauuggcuauaaugcaccauugucaucuacagacaauaacggguuuuuuguuuuuaaacuguagcugugucagcguguuaugaugccgucccguaccaaccuggcuacuggaauccccaguaguaaagugaaauauucaaggcucuccagcacagacgauggcuacauugaccuucagguaaaugcagaagagaacugacaagacugacuggcuguguuucuguuaaguuagcaggaagaccuuccagauggagauuuugcuaacuguccuuggggauuagaaggagcaacaagaagaaaacucagcucugagacccuuucagccauaaucgcagaagagggccguggcaggguaguuucaaaccaauuccaguauuguccauuucuaagaauuuuuaguuguaaugcgagagccuuguaguuacagguuuuauuuacuuuauucagaaacuaaucagauuguguuuuguuaaguggaguuuuuuguuguuguuucuuuuuuuaaggaacuuuaaaauuuuuguuagguggaauuuuuuuuaucacuguuuauuuacacuuuagucaaagcccguucaccuuuuaagggagaaacuuauuacuaaagccagcagauugugggaaucuuccuucuuuccugaugucaugagauccaauuuauuaaagguauucuuugugauaaauaguaaguaaaacacaguauuuauuaaguuuguauccuacccuaaccauuuauaaacuagucaauacuacagcaucuccuuuugcacacuuccccuuacaauagaauguucuacguggaacuagggccaacgaggaaguagcaggaaaccauccuuuauaaauaaauaaauuacucuuuggacccacauuugaaggagagauaaaaauagaucuggaaagaucugggaagcuuccagccacuuaggucagauacaacgaugagccaaaccuuggaaaauuugucucugaaucuuaaccuugaauugaauuuguucauaaggcagguuuacuugcuauguggaacaaacaacuaaucauuuggaauaagcugaaauugccuucuuuuccuuuuuuuuuuuuuuuuuuggagacggaguuuuagucuuguuucccaggcuggagugcaguggcacaaccucggcucacugcaaccucugccucccagguucaagcgauucuccugccucagccucccaaguagcugggauuacgggcaugcgccaccacgcccagcuaauuuuguauuuuuaguagagacaguguuucuccauguuggucaggcuggucuugaacuccugaccucaggugaucauccugccucggccucgcaaagugcugggauuauaggcgugagccaccuugcccagccucuuguuuuguuuuguuuuguuuuuaagauguagucuugcucuguugcccaggcuggacugcaguggugcaauccuggcucacugcaaccucccccuccugguucaagugauucuuguaccucagccucccuaguagcugggggauuacaggcaugcaccaccaugccuggccaauuuucguauuuuuaguauagaugggguuucgccauguuggccaggcuggucucgaacucuuaaccuccagugauucacccacuucggccucccaaagcgcuggaauuacaggcgugagucaccgcgcccagccuuuuuuuuuuuuuuuugagacagggucuugcucuuuugcccaggcuuggguacaguggcacaaucaagacucacuguaaccuugaccuucugggcucaaguagucuuuucaccucagccuccugaauagcugggaccacaagcaugugccaccacacccagcuaauuuuaaaauuuuuuguagagacaggaucucuuaaauccccauaaguuaguacagccaucuaugugccaggcaguuaauaaauauauaucuaacaaaugaaugacuguaaagucauuucuguuuuuguuuuaaagaaaaguuucuuaugauacaaugaaugauuuauggaaugagauucgaacuagagugaaugacauuccucugagauuccuuugaguaacugugagagcaauaacuagagcuucaucucuugccagucccuuuuauuucucagagcugcacugggugguaggacauacuuaagacacauaaaguaucuaguuugguucuuaauuacccuccuguuuuugcuguuguuguauuugaaacaggcucuggcucugucacccaggcuggagugcaguggugcaaucucagcucgcugccucuucaccuccugggcucaagccauccucccagcuuagcgucccaaguagccgggacugcaggcacaugccaccacgcccggcuaauuuuuguauuuuuuguagagacgagguuucaccauguugcucaggcuggucucaaacuccugaacucaagugauccgccugccucagccucccacauugcugggauuacaggugcgagcucuccucccuguuuuaaaguguuugagacugggcuugauggcuuauaccuguaaucccagcacuuugggaggcagagguggaaggacucccuugagcccaggaguuggagaccacccugggcaacauagugagaccucgucucuacagaaaaauuuaaaaauuagcugggcauggugacguauacuuguagucccagcuacuugagaggaugaggcaagagaauugcuugagcccaggaguucgaggcugcaaugagcuguaauugcaccacugcacuccagccugggugauagagcaagacuccgucucuaaaaucauaaaaauuaggccgggcgcgguggcucacgccuguaaugccagcacuuugggaggccgaggcgggcggaucaccugaggucaggaguucaagcccagccaggucaacaaggugaaacccugucucuacuaaaaauaccaaaaaaauuagcuggguguaguggcgggcaccuguaaccccagcugcucaggaggcugagacaggagaaucacuugaauccaggaggcagagguugcagugagccaagaucacgccauugcucucuagccugggcaacaagaacgaaacuccaucucaaaacaaacaaacaaaaacauaaaaauuacaaauaauuaauuaaauguuugaacccagguauuugcauuaauguucuucguugucuuuuucaucucuauuucucuuccaguuuaagaaaaccccuccuaagaucccuuauaaggccaucgcacuugccacugugcuguuuuugauuggcgccuuucucauuauuauaggcucccuccugcugucaggcuacaucagcaaagggguaagcugacgggcaugugggaauaaguugugagauuuuuaaaauguuagccaaggcucuagugugcguguguguguguguguguguguguguguguguguguguguguuuguccgucccaguggucuguuuuuuuugagacagggucuugcucugucauccaagcuagagugcaguggcacaaccuuuaccucccugggcucaagcgauccucucaccucagccucccgaguagcugggacuacacgugugugccaccacacccagcuaauuuuauuuuuuauuuacuuauuuuuguuuguuuuauuuuguguagagacaggguuucacuauguugcccaggcugaucucuaacuccugaggucaagcagucugccugccucagccuuccaaagugcugggauugcaggugugaaccauugccccuggccaauuuuuuuuccaauuuuuauggguacauaguagguguauauacuuaggggauacaugagguauuuugauacagccaugcauucauaauaaucacaucaggcuaaaugggguauccauccccucaagcauucaucauuuguauuacauuccaauuauacuuuuauuuauuuauuuauuuugagacagagucaggcuggagugcaguggcauaauaucggcuaacugcaaccuccgccucccagguucaugcuauucuugugccucagccucccgaguagcuggaauuacagacgugcgccaccgcacccggcuaauguugguauuuuuaguagagaugggguuucgccauguugcccaggcuggccucccaaaguguugggauuacaggcaugaaccacugugccuggccuauuuuuaguuauauauauacauauacacauacauacauacauacauauauauauauuuuggagacagagucuuguucugucacccaggcuggagugcaguggcaggaucucagcucacugcaaacuccggcucguggguucaagugauucuccugccucagccuccugaguuagcugggacuaugguggcaagccagcacacuuggcuuauuuuuguauuuuuaguagagauggguuuuugccauguuggccaggcuggucaugaacuccugaccucaagcggccugcccgcgugggccuccuaaagugcugggauuacaggcgugagcuaccacguccagccuuaguuauuauauuuuuaaauguacaauaaauuauucucuagucacuuugugcuaucaaauacuagagcuuauucauucuauguaacuauauuuuguacccguuaaccuuccccauuccccccuaccuuucccagccuuugguaaccaucauucuacaauauccaugaguucaauuguuuuaauuuuuaguucccgcaaaugagugagaacauggaaagugugucuuucugugccuggcuuaauuucacuuaacauaacguucuccaguuucauccauguuguugcaagugacaggaucucauucuuuuuaguggcugaauaguacuccauugcauauauguaccauauuuucuuuauucacuugucuguugaagaacacuuugguugcuuccagaucuuggcuguugugaauagugcugucauaaauauggaagugcagauaccucuuugauaaacugauuuccuuucuuuuggguauauaccuagcugugauugcuggaucauaugguaguucuauuucauacuguucuccauaguggcuauacuaauuuacauucccaucaacauuguacgaggguucccuuuucuccacguccucgcuagcauucguuauugccguuuuuuuuggauaaaagccauuuuggcugggugcaguggcucacgccuguagucccagcacuuuuggaggccgaggcaggaggaucacuugagcccaggaguucgagaccagccugcgcaacauagcgagaccuugugucuauauuuuuuaaaaagccauuuuaacuaggaugagaugauaucucauuguagucuugauuugcauuucuuugaucaaugauguuaagcaccuuuucauauaccuauuugccauuuguaugucuucuuuugagaaaugcccauuuuugauuggauuauuagauuuuuuuuccuacagaguuugagcuccuuauauauucugguuauuaauuccuugucagauggauacuuugcauauauuuuuucccauucuguggguugucucuuccuuugcuguacagaagcuuuuuaaccggaugugaucucauuuaucuguuuuuguuuugguugcuugugcuuuugggggcauuacucaagaaaucuuugcccaguccagcauccuggagaguuucccccauguuuucuuauaguaguuucauaguuuuaggucuuacauuuaaguguuuaauccauucucauuugauuuuuguauaugucaagagauuugaggggucuaguuucauucuucagcauauggauauccaguuuuccuaauaccauuuauugaaaagacugguucuuuccccaguguauguuuuuuuguuuuuugguuuuuuuguuuguuuuuuuuuuuuugagacagaaucucacugugucauccaggcuggagugcaguggcaccaucucggcucacugcaaccucagccucccaaauaacugggaccacaggcaugugccaccacacuugguuaauuuuuuuuucauuuuuuguauagaugagguuuugccguguugcccaggcugaucucgaacuccuagacucaagcaguccaggaguacaguggugugaucacagcucucugcaaccucaaucuucagggcucagucgauccucccaccucagcuucccaaguagcuggaguuacaggugugagucaccauaccuagcuaauuuuuuuguuuguuugguagagaugagaucucauuauguugcccaggcuggucuuaaacuccuaggcucaagcaauccuccugccucagccucccaaagugcuggaauuacaggcuuuagccacugcaccccucugacuauguuucccguuguguguuaauuauggucagugugaggcccacccuagccucccaaaguacugggauuacaggcgugagccaccacacccgguggauguagaauuuuaucaaaugcuuuucuagcaucgauugaaauaaucauaugguuuuuguccuucauucugcugauacgauuuuaucacauugauugguuuguauaaguugaaccauccuugccucucugggauaaaucccacuugguccugaugaaugaucuuuuuaauguauuguugaauucaguuugcuaguauuauccuccuuauugaggauuuuugcaucaauguucaucagggauauuggccuauuuuuguuuuuucgaugugucuuugccuaguuuugguaucaggguaaaacuggccuaguagaaucaguuuggaaguauucucuccaugucuguucagaauaguuucaguaggauuaguauucuuuuuuuuuuuuuuuuuuuuugagacagggucucaucugucaugcagguguagugcaguggugcgaucucagcucacugcaaccuuugccuccccggcuuaugugauccugccaccucagccucacuagcaacugggaccacaggcauauaccaccaugcccaucuaauuuuuguauuuuuugucaagacaggauuuuaccauguugaccaggcuggucuugaaauccugagcucaagcgaucugccugccuuggccucccaaagugcugggauuacaggagugaaccaccaugcccagccaaguauuaauucuuuaacugguauaauucagcagcgaaaccaucuagucccaggcuucucucugcuaagagacuuuuuauuauggccuuaaucucauuacucuuugucuauucagguuuuagauuuuuuucauuguucaaucuuuguuuuuauauucaugucugguacagcagauuccagcagaaaaaccaaaaagauuuucuuuuacauuuuguucucuguuggcaaaacauguuuuucuuccuuugagcaacaguaaacuuccauaguuccuauaggggaggugguggcagguaggcaaacuuggccucugagauauuagacaguuugcccugucauaguuuggaacaacauggcugagccuggcauacaggaguccugauugguaaagggcuguagcuggagcagcaugcugucauuguagcugugcagugccauggacauacugucaguauuuggagagaaauagcaauucuguuauauguguggggucacugugccucguaagucaguuccuucuuacaguagguuugguuggaguuccuguugagcuucaauaugaaaccuuagaaaccuaaaguaguuggugguucuuucucaugggcuguccccacauacacaguguccaaguugucuugaaccaauucugacuauaauuaacacacaacagggaacacagccagccaggugcaguggcucaagccuauaauucuagcauuuugggaggcugaggcaggaggauugcuugagccccagaguucgagaccagccugggcaacauagcgagaccucaucucuaccaaacaaacaaauguacaaaaugagccagguauggugacugacaccuguaacuccagcuacuuggaggcugaggugggaggaucacuugagccugggaagucgagguugcagugagcuguaaucacaccacuguacuccagcccgagcaacagagcaagacucuuaccucaaaaaaaaagaaaaaagagaaagaaaagaaaaccugaaaggcugagaaaaacacagaguuuauuguagugguaucuguacaauuacaaaaggugaaaaacaaccaaaguguccagcagcuguauguggggcaguuagguaaaacuguaguauguccauuucgguggaauguuacacauccuuacaguuuaaauguaugaaaagguuuuaauaauauuggccacaggacacagaguaugguguguucacaacuaagagcuuuaaaaaaaggaaaagaagccaaaauaucuggaugagaaugggucauuuuuuucuuuauaauuguuaauauuuuguaguuugucuucaauuuauaaucaggaggaaaccuuuucccuuggugguauacaacucaaagaaaaaguacugaagaguauaaaauacugaucuaaggauuaggucugugacguuuuauuuuaaaauguguaacucuuacgguacuaauguguuugccuccuucugccaccagggggcagaccgggccguuccagugcugaucauuggcauucugguguuccuacccggauuuuaccaccugcgcaucgcuuacuaugcauccaaaggcuaccgugguuacuccuaugaugacauuccagacuuugaugacuagcacccaccccauagcugaggaggagucacaguggaacugucccagcuuuaagauaucuagcagaaacuauagcugaggacuaaggaauucugcagcuugcagauguuuaagaaaauaauggccagauuuuuuggguccuucccaaagauguuaagugaaccuacaguuagcuaauuaggacaagcucuauuuuucaucccugggcccugacaaguuuuuccacaggaauauguaucauggaagaauagagguuauucuguaauggaaaaguguugccugccaccacccucuguagagcugagcauuucuuuuaaauagucuucauugccaauuuguucuuguagcaaauggaacaaugugguauggcuaauuucuuauuauuaaguaauuuauuuuaaaaauaucugaguauauuauccuguacacuuaucccuaccuucauguuccaguggaagaccuuaguaaaaucaaagaucagugaguucaucuguaauauuuuuuuuacuugcuuucuuacugacagcaaccaggaauuuuuuuauccugcagagcaaguuuucaaaauguaaauacuuccucuguuuaacaguccuuggaccauucugauccaguucaccaguagguuggacagcauauaauuugcaucauuuugucccuuguaaaucaagauguucugcagauuauuccuuuaacggccggacuuuuggcuguuuccuaaugaaacauguagugguuauuauuuagaguuuauagccguauugcuagcaccuuguaguaugucaucauucugcucaugauuccaaggaucagccuggaugccuagaggacuagaucaccuuaguuugauucuauuuuuuagcuugcaaaaagugacuuauauuccaaagaaauuaaaauguugaaauccaaauccuagaaauaaaaugaguuaacuucaaacauuucagaaaaca

SEQ ID NO: 191246 - RNA, 70564 nt, Homo sapiens
gcggacggugaguggggauggacuggaguugaagagcucgagaugaagggcuugagggcguguguguguguggcgcggggaaaaaacuagucucuaacaggaucucuuucggaucugcgagggguuuugccccuuccuccugagccuuuuucggucucauucuucagucuucaucgauccuuuucagggucgcuucucgaaucagucuguuagcugccccccugcgguacaggagguggaaaggagacccuaguucaggggccagcccuguguucuccgaauuagagagcgggcagaaggggagggugggcuacggggaugcgggcgcgugucgggagugagguccggucgccuuccccucucucggauuaucugacauauaaugagugcuuuccuucuaaacauuuacaauacaugcaguacuucuccugguugaggugguaccuaccucguaagauugcucagagaguuaagugcuguaauacaucgaaaaauguguaaaugcaccagcgauagcuuccuuuuuuuuccuaguuaguguaauuaaaaggacuugauuuuuaaauaagaaauauugcccuuuuaaucauuuuggggggggguugcuuaauaaucaacgacuuuuggcucuuugcaaaauucccauccagagaugcuaaaccauuggagacuuuucacaagggaacaauauuaauuuauacacacauauguauauguucuaguauguuuugggggaaugagcucacuugggccuucaucacugguagaaucagauauuauagaaagaagugauauuuauuaacuggugugagacuuuaccuggagacucaaauuuacuuuuuauuuuuaaacuuuuuauuacuuuugaaggaugaucgaauuuaaaaaggaaacuuucuuagcuaaaccugaguugauuuuggucuguuuaguuagaaugcuagucuuacagaacuaaaggcuguuuguuggcaguagccggagauaaggaguaagcagaaugagaccagaaugugaagaaacaaaugaggccaacggaggcuagggaaucuuucuuucuuacuuuuuuuugguagacagggucucacucuguugccccagcuggugugcuguagugccguuaggcucacucuagccaagaccucccggguggaagugauccucuugccuuagccuccaaaguagcugggacuacaggcgcgcgccaccaugccgggcucauuuuuguauuucuuguggggauucaccauguuacccaggcugguccugaacuccugggcucaagugauccgcccgccuuggccuccgaaagugcuggugagccaccgcacucggccuagggaaucuuaacuacauuugccuucaauuaguaacacauacugguauacaaauagaaauucuaagugagagcaauggaugaauaaacauuuguuccccuccauaaagcccugggauucugcuuugucuaccuuaaguuuauuucucuaaaugaucugucauggaaagaggauauuuugguauguuucugcuuuuuugcaugugacccagaauacguuggagagaugaaauuagacuuguuaccucuauuuuauguacacuuaacuuagaauauauuaacuuagaauauauugugaauguguuuuaaaacauuuaauuauuguacuaaccauuauuaccauuaaaacauuuguuuuauuuuucaguauuuguuuucuucaagcauuuggucgagauuaagaauuaaaaaugucauccaaacaagaaauaaugagugaccagcgguuuagacggguugcaaaggacccgagauuuugggaaaugccagaaaaggaucgaaaagucaaaauugacaagagauuucgagccauguuucaugacaagaaguucaaguugaacuaugccguggauaaaagagggcgccccauuagccauagcacuacagaggauuugaagcguuuuuacgaccuuucagauucugauuccaaucucucuggugaagauagcaaagcauugagucaaaagaaaauaaagaagaaaaaaacccagacuaaaaaagaaaucgauucaaaaaaucuaguugagaaaaagaaagaaaccaagaaggcuaaucacaaggguucugaaaauaaaacugauuuagauaauucuauaggaauuaaaaaaaugaaaaccucauguaaauuuaagauagauucaaacauaaguccgaagaaggauagcaaagaauuuacacaaaaaaauaagaaagagaaaaaaaacauuguucaacauacuacagacucuucucucgaagaaaaacaaaggacauuagacucaggcaccucugaaauugugaaaucucccagaaucgaguguucuaagacaagaagagaaaugcaaucagguagguuggaaaaaauuagagauucuuggguguuacauuauuuauuuuuauacugaucuuucaaaaauguaaacacauuaauaaguauuuucauaguauuauggaauggucaaaugcuuaucuggaaauacaaagcuauaaaagaaauaugcagugauuauuaauuuuugauguggugcuagaagacagacaugaaaauuugaaucuugaaguuaaacagugauuuugauuaguggugagcccuaaugagaacuauauucucuaaccagauaaaguguuauaugucaucacaugauaagaagagaugugucuaaagaggguaaguaggccggacaugguggcucacgccuguaaucccagcacuuuggcaggccaaggcgggcagaucacuugaggucaggaguucaagaccagccuggccaacauggugaaaccccaucucuacuaaaaauaaaaaaaaauagccaggcaugguggcgcacaccuguagucccagcuauucgggaggcugaggcaggagaauugcuugaaccugggagguggagguugcaauaagcugagauugcaccacugcacuccagacuggcugacagagcgagacucugucucaaaaguaaaauaaaauaaauaggguaaguaggacuccgucucaaaaauaaaauaagaggguaaguagaguugaguacucauucauuaauuuguucaguugcuuugccacuaguauguggcaggcagaauaugaguaaggcgucgucacccaucucagggcugucgcuagcuuauaugaugccuuuaugcaaauuagaaaaaggcaugcucucuggacacacagagcucccaggggucacacuuuggugaagagauggcgccuuugaagcaacagauuuuuugccccugagcagacacagcccccuccagagugcauggcuuggugaguguaggauggccuugauuuuagcccuucuuguccuuuuauaaaugccccugugcggauaacagccugcuaaacuuugugcaguggccccugucuaaagcaacauugucuaguagaaauacauaauuuuggauuuucuaguaaccacauuaaaaaguaagaugaaacagguaaaauuauuuuaaauaauauauuuuauguaacccaauauaucaaaauuauuucaauauguaaucaauauaaaagucaauguauauuuuacaucccauuuucuacucauuucauacuaauacuauuuucauauuaaugucaaguuagacaaaacgcauuucaagugcuccguuaccacaugugacuacuggcuaccauauuggacaauauagaucuaaaguagaagaaagucagaaccauaauacaaaaugcaauaauaguaagugccguaaaagauguuuagcagaaagccauggaaaucuggaggaagaagucacucaagaugugguaaucagaaaaauucauaggggacgcacuacuuugggguguggaaaaauuuaaguuugaggaccagagugugcuacauggaaagaacuuuuugagcaaagaugugauugggcauguucagaagaggucaguagucccguuugauuagauaauaaggucuugaagggccaaaaugaguagcagcgagaaaugauuguuuggaacuaggugagagacagcuggcucuaguuugcauuacguguuuacuaauuaaaauuuuuugucaccuccagcagcaagcaauuuugaguguugauguugcugauaguugaagauguaacugaaaaccaguaguaguucacaugagccagaccugugauuacaggauccaaggaggggucuugauaggccgagaggucuugauaggccaagaggucuugauagcccaagaguucuugauaggccaagagguuuugauaggccaagaggucuugauaagcagagaucacacugugaggguagaagguaucaggcaguggagugaauucuggauagcaaggacuagggagucaguggugguaucccauuuuacauuuguaguggaaccaggcagcagaccucuugaggugugggaagaaaggauaggaauccgguuacuaaaauugaagaauaagauuggagugggaccggcagcaaaguugauuugacacugaauuagugagguaaguuagucuagcauccacuucauuuggggcacugaauuaauauaacauagcuauauaauccuuuagauugauuuuacagacuuuuuuacauaucuuuucucauuuaauuuucuuaguuaccuugagcaauaagacuguaucagcgaacaagauuaaagugacuuauguaaggacaugcagaccuggaacugcaacucaagucuucugacuccuucuaccccaccacauugcuugcaguaauuuuguugguuccacagucuaggaaaggcauuacucauaaauaaggauuacacggcuccauauauaaucuucuguucauuauccauucaucaguuauuacagcaauuacugugugcaagggccuuuuuaagugcugugaaguaaaggugaugugaggacuugcagugugauauuugucaucaugaaauguucaugcccagcacuugcacuccucagaaucuauuuuacauaaauaauuggaugugugcaaagaaugugcauugcagcauuauuuuuaaaauaaaacgguaacuggcugggcacaguggcucaccuuuauaaucccagcacuuugggagaccgaggcggguggauugcuugaggucaggaguuugagaccagccuagccaacauggcaaaacccggucucuacuaaaaauacaaaaauuagcugggcauaguggugcacaccuguaaucccagcuacuugggaggcugaggcacgagaaucacuugaacccaggagguagagguugcagugagccaagaucgugccacugcacuccagccugggcaacagagcaagaccuugucucaaaaaaugaaaauagaaauuaaaaugguaacaaaucauuaagagauuaauuaaauauaugcaaacaucugugaucuaugaaguuuuaaaaauagguuccaaaauaacgauaugaccaguuauuuuaaacaaauuaguauuuaaauuaaagaaaagaaauuuagggauaugguuguauacuaaaauaaccaguuaucuuugaaugaaaaauuacugcuagucaccuuuguuuuauuuauuaaccauauuuuccuaacuuuuuuugguuuguaaugaucauucauuauguuuauaauugggggaaaaugguaaagcaguuuuuuugguuuuuuuuuguuuuuuguuugaaguagcuggauaaguaguaauguuuacagucacuacuagagcaauacugucuaggaauagagacauuuauauuuguguaaccccacauuaucuugcacaaggcuguguacauugugggcucuaagcagauacuuuuugggguuuuuuauuuuuauuuuuggagacagggucucgcucugcugcccaggcuggagugcaguggugcaaucacagcucacugcagccgcaacuuccugggcccaggugauucucccaccucagccuuccgagucacugggaccacaggugcaccccaccaugccuagcuaauuuuuguauuuuuguagagacaaagaguuuugccauguugcccaggcuugucucaaacuccugggcucaagauccucccaucuuggccuccuaauaugaugggauuacaggcgugagcagcugugcucggcugcagauacuuauugaaugaauaaauacucugaaugcaguugauauuguuaaaaacauugaaauggaagaccucuuuaagucucuuaugcaacacuuuauuauuauauaacccaaagugugguauguguaccauugucauaagugagaagauuuuugaugauacucaaacuucuaaaauauuaauaguuauguacugugucaacaucuuagaaaacaauguaauuacccuaucacuucugugacuuuaggaauauuguuuagagcaaaacuaacuuuuaaaaaauucaauuuaauaaaaaaaugauauucaaaaaucaugaaaaugguauaaugacugacaguugagaaauauugcaauacuagauagacugggucuguaagauguuauuucuaagcuuguugcuuaaaaguaaauucugcuuaccucauaguaacuuucaauguuguguuuuucagaucucauauauagaaccugugacaaugcuuucauuuuggcgcuuuucacuucuauuggcuaguuauuuuuauuaaucccugcuucguuguggugguaacauaaaagcccauuuccugcuuuuccuucuaacaagaugccuuuucauucaguuagucucaagucaaguuguaucuuugugaagccuuuuuauaaauaccucucugcaggcaaauuuagaugucucucacuguauggugauugagaacauagauuuauaaaucaguaaaugguuaccuuuuauuuaugaauccaucaagagcaugagaucguguuacaaaucuucucucuuuucccuuauccuagcucaauucuuuguauguaguagauacucaguaaauauuuggucagugaauaacuauuauaagauuauaggaccaagagaaaauuaguuccaauuucauucuaaaucuugaacuuuuaaauuugcuuuuaauuuuccaaacuuagagccuguaagcagaaaauaagcuccaacuuaaagaugaguaaaacacguaagauauaucuacacaccaaguagauagaagccugugauugcuuuagaaguaggaaaugagcccuuucagaguugugaggacuaaaauuuccaucuuaagcaaaaacagucuuucaaucuugguguauugcuaaucaugacaguugauuacaaaguucaagaccuggcagaaaaaguauaaauauuauuucucugucuuuauaggugaucucauccacaucacagcuucuguugucaacugcguaugaaugagucacugaucuccaacccagacuucucugagcuguacacucuuauuauugauacuuucuuuuagaugacugaguggcacuucguauucaacauauucaaaacugaacucaugauuucccuccaccaaacaaacuaguucauuuccaguguucccuuuucaucuuuccaucuucuuagcuaacuagcucugaaagcuaagaagcuaugacucaucuuugacacuuccaaaacucccaguccccgugucaaaucuccagucgguaauuauugguuucacuuccugacugacucugaaauccauguacaucucugcauacauacugccacccaacuuagugcuaccuucauuucuugcuuuuuguacuguacuaccuuuacuauauucacaucuguucuuuacuuucccaagucaguuuucuacaguauagucaaggugaucuccucaauaugcaagucugaggaugacaauauccaaaagaagaugacauccucuuuuuugaaaacagcagugucuucccauugcuuuuaugaaaaaguccaagcucucuauaugguuuuuugauagcuuggccucuacuuaacucuucauuuccauuuguuacuugauucugugcuaucugugaucuggacaugaugguuggcuuuuuccuauuggcagauuuuuacagguaccuuccuugcucuuucaaacaaauuuccaucuauuagucuaacuuugacuauuuaacuccuguucauccuucaaguaacagcucaguuaucacucacuuagggaccccauuaaauccccuuagaaaacauucuuucugggauaucuuaguugugauuuuaacuuuuccuauauauugauuuuauuugauauccauguauucuuuucacucagcuagaaguuucacugagagcacuguuugcuucucuuuuaccaacuguuguauauugagcacuuagcacguagcaggcacacuguuaaguauugaaugaaugucuggaucuacuugcgugaugugagcauguguuaggauuuccauuaaauaacuugguuaaguguauuuuccuuuacucuguuucauagaaguuaugguuaggauuucuaucauaaaaauugacuaagcauuuacugaauauauauuugucuuuacuguguuucauagaaauuauauuuuuacuggaguugaugucaagauaauuuggauucaguuuaauucagcauauaucuuuucuuaauuucuuuccccuuuaacauuuugcagugguucaacucauaaugacaagagacagugaugguuaugaaaacucaacagauggugaaaugugugacaaagaugcucuggaggaagauucagaaagcguuagugaaauaggaagugaugaggaaucugaaaaugaaauuacaaguguugguagagcuucaggugaugacgauggaagugaagaugaugaagaggaggaugaagaugaagaggaggaugaagaugaggauagugaggaugaugauaaaagugacaguggcccugaucuugcaagggguaaaggaaauauagaaacuaguucugaagaugaagaugauacggcagauuuguuuccagaagaaucugguuuugagcaugcuuggagagaauuagauaaagaugcuccucgugcugaugagguaaccuuuugaauaaacaagauuauuugugaaaaacacaguacaagcagcuuuuauggcugguagaacugaugucauuaagugggaaaagcuuauugguaauaguauucuuuaugauucugauuaaaauuugauauggaauauaauuauaugaacuagaagacguccaagcagauaagaagaggcucuacauaaauaauuaaaaguugcaugaaauuuuuaauacuuguuuuagcuaguaguuuguauuucuguuuguacggcacccaaaagaaauguugcaggguaacauacucaacuuccuuacucaugcaugcauggcaaaauagcugaacaaacuuggugguuaaaaaaucagcucaugaucauguucugauuuaagaauuaagaaccaaguaagagaaaguacuuaccuguuaugguuuuacuauuguuuggcucauuugaaguucucuuuuauauacugaauuacgcuuagauaacuccuguacuauuaauuucagagcauaggggacagaaggcauuacauuuuuagaaucuuuauuuuucaaguauugagaaugauauggauuauguacuauuuaauucuucucauuucucagauuacacgucgauuagcaguuuguaacauggacugggauagauuaaaggcaaaagauuugcuggcucuguucaauucauuuaaacccaaaggagguguaauauuuuccgucaaggugagaauugauuucauuuugaaauaaauauuucuaggcauuuuaaguuaaaucugauuuuuuuuuuuuuuuuuggccauaguuuuccuuuuuaggaaaauacuguggaaguuguccaauccaauugagugugaaacuuauguaacagguauaaauguuagaaaggaagaggugaaauuauuauuauugauagguuauaugauuguuuacacauuaaaaauccaaagaaauaaaagcucaguaaagggacagcauauaagaaguguuuuuaacaauaaauugcauuccuuauugcuaacacuggccaauuaaggaaaaaaucuaauuauacuagaaacaaaaccacauaaaguucuuggaaauuaccuuaauaaacacaaaugaccuaugugaaguaaacuguaacacuugauaaauuugaaaaacuuacauaaauuuugaggauaccauauuucaagccaaccuaauaauuaagaauccaggcuuugcauuauugcagaccuggguucaaaucuugauucucguaaguguuaugugauccuggacacuuaauuaaucucucaaguauguuuacaucuuuccaauauauccaaauggauauaacaauaguauuggugauuguaaggauuaaguauaaaggagcuugaacuaaguauuuagugcagugccugaaauagcccugcccucaaucauuauuagagauugagucucccuuauccaaaaugcuugggaucagaaguguuuagaauuucagauuuugaaauaaaauugcauuauauauacuuacuggaugagcaucgcaauuccaaaaucugaaaugcgccaaugagcguuuccuuugaaccucacguugacagucaaaaaguuuggaauuuuggauuugggauuugggaugcucaaccuguauuauucuguuuaaauauuuaaagauguuaugucuacuguucuaggguaauuuugaucaaaaucccaguucaagucaaaguuaagaaaaaggauaccaauaaucaucuaaaagaauaaacaaauuaagaguagcuaauaaacuauuuuuuuuuuuuugagauggagucucgcucugucgcccaggcuggagugcaguggcgcaaucucggcucacugcaagcuccgccucccggguucacgccauucuccugccucagccuccugaguagcugggacuacaggcgcccaccaccacgcccggcuaauuuuuuguauuuuuaguagagacggguuuucacuguguuagccaggauggucucgaucuccugaccucaugauccgcccgccucggccucccaaagugcugggauuacaggugugagccaccgcgccuggccuagacuagcuaauaaacuuuugagaaaucaugcuaauauaaaaacucacccugucgcuucucggccuuuuggcuaagaucaaguguaaaaacucacccuacaaguuacaauaucuaaacauuucaugaugcuauggggguugacagguuuggguaaaaaugggacaaauugguagaacagaauagauagaaagaguucauaugauaacuuagaucaaaauaggcugcuugaauauuuggacaaaugaacaggucauuggauagagaacuugguucagaucuucaccuccuaauagcuccagcgaaauucuagaugaagcaaaggaaaaaaaaauuaaaagucaagccaaagaaacaauuuaaaaacccuguguuuuaggcaauagugagaauuucuagacuuagaaaagaggaaaaaaaagaaucaaaagaugugacuacauauauauuauaaacuuacauauuaaaccuauuguguauauacuauucaaguuaguaagaaaaacuuggaucaucuuguugauaaauugcauauuucagacaguuuaaaaaagcauguguucauuaacaaauguauauuaagccuaguaguaucaaaacaaugucauuaauacaauuauuucuugacucuuaaaguaggcaagauuuuagaagauaccacaccuggugagagugaauucuuuuucuuauaucgagacuauaccuaaucuguauaagguugucgucaguucuguucuauuucuuuaaaagaaagcacuggauaaaugguaugacagagauaaguugguuauuacaaaauugaucuucauuauauguuuauuuuucuguauuucauguaaacuaauucagucauuuuucauguguguguuuuuauucacauuuccuugagcuuagcaucuuguuuugcuuuuaauuuuucguuuggaucucggaaccaucuugucccaggugguauguggaggagauacucuuauuuuuguuuccaagccucguaucuuguuagucucuagccaaagugaucuauuuuuaaauaaaauuucucaagaugcucuagcuuccuauaguggauuuggaagugagucacccuuacuguuuucauugagucaaguugugacuuuuagaguuccugacuucgacaggucuagauauuuguguaaaggaauguacaaauuacauugauccuauuuuuuucuguuuagauauauccuucagaauuuggaaaggagaggaugaaggaagagcaaguucaaggaccaguagagcuauuaaguauuccugaagaugccccagaaaaagacugguauuaaaucacuauagaacauaaaacuaaaccucauaaauucaugucauuaguucagaauucuggucaccuuaauaguuaaaacuaaaguuuauacuugugccauucgugguuaaaacagguugcaaaacagauuuaaagucuguuaaaagugguacauuauuccaagaagauuuuuguucguguauauuucuauuucuguauucaugaaaguaauuauugcaguuuuugaaaaacauuucaugauuaaacugauuuggaguucuuuugaauucuuucagccucguugcucugaauuaguacguuuugcuuuuuuuuuugagacaucauugaagcucuguuugccuucaaauuauauaauuuuuucuuauuugagaaucaaauagaaaagugaaagaaugauaaaacuuuuuuuuuuaucaucauggugcaauauagaaaauaauuuaagauaguuuuuaagccacuagguggagcuauauuugcacuuaauaaaaaugaggguuaaauagauuagugacaggagagagcagaugaagaccuucaaagaaagaguuguaucagugcuuuguguggaaccuuaaaaaaaaaaaaaaaaaaaagaauguguuguaguuaagcaaaaucaaacuuauagacucuuaagcaaacauuuugcaagaucaggaaugucuuuuagcuaaugguuuucuagcauauuuuauaauagaauuaucuuuauugguuuuacuugagaaggcaguguguaauagcaaaguaacuauucugugaguuaaauuauagauaaacacacgaauucccacacacuccuuuccuagauaccaaauuccaauccaaauaucuguaccuugugagaauaauaaguugagcuuaaguauuuaauguuuauaaaggcaaagucaugaaggaaagaugguuugguaugaaggccagcuuguaauauguuuuucuugaaagaauuacauuuauuuuuuaaagggaaauuuuuguguuucuguauaaguaugcuuaauaaguuuuucccacuuuaggacgucuagagaaaaauugagagauuaucaauucaaacgacugaaguacuauuaugcaguaguagacugugauucuccggaaacagcuaguaaaauuuaugaggauugugauggccuggaauuugaaaguaguuguucuuucauagaucuaagguaauccaguguauguauuaccaauuuaaucuuuuaguacaacaugauuauaagaaguaaaauauuugaacugguagugaucucuguuuuauauucuaaaaugauuuuuuugcuuuucgguuaacucuaucccauggaacaucacuccuaagaaagaaaacaaacaagacagugcuaaaguauuauguaugaaucauccccacaucuuuguccuuucagacauauuggcucuguuuuuaagaugguguaccuuacacaauaauauuuccuugcaacugcuuuuagagcuaggaaccagaugaaguuaacuuuuaaaaaugcauggaggaaggggcagaggaauuugaaaacagauuguuaucucuagauccaugcuauccaguauaguagccacuagucauauuugguuauuuuaguuaaaauuuauaagucaguugcguagucauauuucaaauaauuguuccauuuuggacagagcagauauagaacauugcccuugucacagaaaguucuguuggacaacacugcucuaaauguaaauggcuaaauguacaauuaggaaauuguaagacucaaccuuaagcuuucccuuguuuucagugacaccucauguauaugauacuuuguauucacaaugcuuacccauuaauaauuauauuugaucuucaaaauacaauauagccagcugggcauaguagcucacgccuauaaucccagcacuuugggaggccuaggcaggaagaucgcuugaacccaggaguucaagaccagccugggcaacauagugagacccugucucuacaaaaaauuuuaaaaguaaaaauuagccaggcauguuggcgcacaccuguagaggaucgcuugagcccaggccguugagacuucagugagccaugauuaugccauggaccuccaaccugggugauggagcaagacccucucuguaaaaacaacaacaaaaucauguagucaaugacugcacuaucagaagucuggaucuuuuugaaacgugagggacccacaugugcuugcaccugacucauuaacugacuccuaaugcacgauuucuaucuauacagcauucuuuuaaauuuaguggaauuacagaguuauagcuuaugaauuucagaaauuuauacaaagaugaauucauucagaaauauacaaagguuaugucuaacauugucucuuaaacgugugucuuuuagaaaguuuguguauguauaaacuacaacuaauuagaugagaaucuaaacugugguuaucacugcagcguauuuuaaauaaauuuuuuuucuuuacuucuuagguuuauaccagaugauauuacuuuugaugaugagccuaaggauguagccucagaagugaauuuaacagcauauaaaccaaaauauuucacuucugcugcaaugggaacaucaacgguauuucuuuacuuuaaaaaauauguagcuggacucuauugcuuuaugaagagauuuuguauauuacuuauagcaucuuuaaaaauggaaaguauuaauuuuuuguuauuauuuuuucuugagacagagucucgcucucucacccaggcuggagugcagugguaugaucucaguucacuguaaccucugccucacagguugaagcgauucucgugccucagcugcccaaguagcugggauuacagguguguaccacuacaccuggcuaauuuuuguauuuuuacuagggacaguguuucgcuauguugaccaggcuggucuugaacuccugaccucaagugaggccgccuuggcuucccaaagugcugggauuacagguuucgugagccacugcucccagccucaaaguauucaaaauuuuuaaugcauggguacagagagaaaugagacacaagcgugucugccucuaccauaucugugaaccuguuuucagauucuuguuacgcauuuaagccugugucaguuaucugcugauguuucuuuuuucucuucugucuuuccuguacacucuucugucucuccuauacacucuucugucuuuccuauacacucuaauaaaucaguuauuaauauccuaaggaauaaggggaaguggauaauaaauuaccuccccgcacaguuaaaugaaacuagggaaaauuuaaaauaagaguaucuccuauacacucuaauacaucaguuauuaauauccuagggaauaaggggaaguggauaaugaauuaccucccagcacaguuaaacaaaacuagugaaaauuuaaaauaggaguaccuuuuucugcagaugauucaaaacuguaaaaagaauugauauggaauaauuaagguauaauagaugucacauuaaugcuuaguaacaaauagccaaaagguuuuugucuauugaaauaguuuauuacuuaggugacuaccuucucccuuuuccuuucuuucuuuuuuuuuuuuuuuugagacuagagucuugcucugucgcccaggcuggagugcaguggcgcgaucucugcucacugcaaccucugccuucuggguucaagugauucuucugccacagccuccccgguagcugggauuacaggugugugccaccacacccagcuaauuuuuguauuuuuaguagagacuggguuucaccauguuggccaggcuggucuugaacuccugagcucagaugauccgccccccucugccucccaaagugcugguauuauaggugugagccacugcgccuggccccuucucccuuuucuuuuuuuuugcuuuuuuuggagacugagucucacucugucgccuaggcuggaguacgguggugcaauccuggcucacugcaaccucugccucccagguucaagugauucuccugccucagccuccugaguagcugggauuacaggggcacgccaccaugcccagcuaauuuuguauauuuaguacagacgggguuucaccauguuagucaggccgaucucgaacucccaaccucuggugauccacccgccuuggccucccuucuccuuuuucuuucucccaauaaccuuucuguccacagcuguacucugcaguagccacacuagcuucccucugcuuuuccugugugauaaaucaccgugcuucucugaggagggacugguagcagagagaguagcuguaucugccaccugcuaugccguggugggcacuguauggcauugauuaguuacuggguguaguaaaacucuaccauuacauaguaagcaaagucuaaaaaauucagucacaugaaauuaaagucauguuauuuucagaaccaacauaaugaucagggccagccuguccagccagccagucuaaaguuccuggguccuggcuguaucaucaacaucuguccuaguuccaacaguguuuuggugguuaucagcucaggcuuaauugucagaauagggaucauuucugaauccucugacuagcuggaauuucugagacagguggcagugauuuuaaggaucucuuaaaauggauguggaucuacccuaugaugaagauaaaauaucuggcagggccuuauaugagaauaggggcuauguacagggcaggagccagucaucaccacaucagucaugucauagaugaauucauguaucauggagguuuaaacuacuuccaacuaauagaugcuuuucucaucagugguucuuaaucuuuuuuuaaaauggaccccacugagauugucuuguuuuagcaacagauuucauauaguuugcagauuuccugaaaucuuagaacuccaggugaaaaaacauguuuucacugauucauaauguuaacuuuuuuuuuuuuuuuugagauagaguuuugcucuuguugcccaggcuggagugcaauggcaugaucucagcaaccucugccuccugaguagcugggauuacaggccuccugauucugcugccucagccucccaaguagcugggguuacaggcaccugcuaccacgcccagcuaauuuuucauguagagaugggguuuuaccauguuggccaggcuggucuugaacuccugaccucaggugauccacccgccuuggccucccaaaguguugggauuacaagugugagccaccaugccuggcccauaauguuaacucuuuuaccaguacauuuucuuaguuuuuuugcaccguaauuaauuuagacacugguuaauuuuuacugucagugauggaguauccuguagauagcagagaauugggaggagguacaaguuaauagaaaugguuccauuuucacaaauaggauacuauuuauuaaucauaucauucauguauuuguuuuaaugugucuuaacuuuuaacuuacuguuaaacauccagguuaauaguauauauucuuuaacaaguuugagcugacauuuccauuuucguguguuauuuuuucuuauuuguuggugaaagguggaaaucacuugggaugagacugaucaugaaagaauuacaaugcucaacaggaaguuuaaaaaggaagagcuuuuggacauggauuuucaagccuacuuagcuuccucuagugaagaugaagaggagauagaagaggagcuacaagguauuguuaaucuuucagugaccauuaauggacauaggucuuuggcaguagcuuuacagggaaagccaaauucugucugcagauaugcucacaugcacaguauuauauauaccuguagauagugauugauuuuuuuaaaaaaaaauuuucuuugccugaauuucuuuaacuauaaauauuuuguuuaaaacccugaccuaaccaagcauggccuucuagacuuguccuaaugcauauggucacucaguuucuuaguaaaccaguaaaacaaucuuuuaggcaucuccccucauuugccuuuuuaaaaaauaagagcaucauuuagauugauuaaauauuuuuacguuccauuuuuucaacuaguuaaaaaguagacucccuguuucuguaauuauuccuuugacugcuuuuagaguuuucuguuucuuuuugucuuucugcaguuuuacuaugguaaguauaagaguagauuucuuuuuguuuguggagcuugagguuuguuguuggguuccauuuauuuguggagugguaucuuucaucaguuuuggaauauucuuagccauuauguuuucagauguuuuuucuuuauccuuuuaggacaucagcuaaauacauguuagaucucgucauuauaucuugccuaucucuacucuuaaauuuuuaaucuguugucucuguacugcauucuggauauuuucuucugaccuaucuuccagaucacuaauugucuuuucagcaguguuaaaucugcugauagaccucuccauucagucuuaaucuugguuauuauauuuuuuacuuauggagguuguauuuggcuauuucucaagucagaaauaccacuuuuuauauuuuuuacucauagucucuguuuuaauauuucauguauuuucagguuggugucuuauuuuacaagguauuucucucuuguuuauuugugugccuaguuaauuuuguguguuacuuugacauuugaaguuaggguaucuuugaucagagaagacuuuaauuuacuuugguugguuuagaaccacauuucuccaaauguuaaggcuuagguucccuggcuucugcagaugauuaaagucugcaugagggcugguuuacuucagauugaccauuucccugggaguauaucccucuggguggcugcuuaaugucaggguacuaauugaaauucccucuuuuuuuuggucuuuaacuuuugucuucuugguccugaaagccugcuaaaaccacaauugacuuucauagcucuuuguucuguggaucaggaaacaggaaaugaucucagagcaaaacaggucuuuacccuggagucaucccucuaauauucccuucuugguuuugaaauaguaagucuucucuaacuugacaguucuuugaaacuuuucuuucuuuucuuaaccucuuugaagcuuuauaaaauaauauuuaauccaacuuaauuccaacuuaauaucuucagugaaaggguuagucugaaguaccuagcuugcuguuaagaaguuccucaaauuaucuuuaucuuuauucaaguuguuuuuguuuuuugagauggaguacugcucugucacccaggcuggaguguagugguacaaucugggcucacuguaaccucuuccuccuggguucaaacgauucucauggcucagccucccaaguagcugggacugcgggugcccaccaccaugcccggguaauuuuuguguuuuuaguagagaugggguuucaccauguuggccaggcuggucucgaacuccugaccucaagugauccaccugccucagcuucccagagugcugggauuauaggcgugagccucugugccuggccuuuguuuuuguuuuuuuuuuuuuaauguuugaaaugauuaacggcguacaguugacucuugaugacucuugaacaacacggguuugaacugugugaggucacuuauacauggguuuucuucugcguuugccaccccugaaacuauaaggccaaccccucuuccugcuccuccucagccuacccagugugaugaugacaaugaggauggagaccuuuacagugauccacuuccauguaaugcgugggaaauauauuuaucuuccuugugauuuucuuaguaacguuuuauuuucucuaguuuauuauaagaauacaguguauaauacauauaacauacaaaauauguguuaacugacuguauuauuuguaaggcuuccacugcacaguagacuauuaguuaaguuuugggagaaucgagauacguguggauuuucgacugugccuaggguuggugccucuaaccuccauguuguugaagaaucagcuguacuuuuaaauguauaugcucuuugcuuaaaauagcucacuuuguagacauaaagccccaaaacccuuuuucccuguauuugaucugucucuguuuggaaacugguugccggguuguaauuucaugucaacuuuugguugauacugucugccuaauaccuucacaucuucauucuucuuaucuaauagaauugccaaucaugaaaaauuaugaguaagagauuuaaugcugacagaaagugaagaacccauaaauguuaaacauagauaaaaguauuuuaaauuagcaagaaugaauauucuuuaauuuguagcuuaacauuuuucauagcuuuguuuucuuuuuguauauguauuauuuuuauagccuaaaugucaaauuaauuaaauccuaaaaugcuucuuuaguaugaccauaaugccauuuaacuuuugaguuuucgagaucccaugauuggccuaucauuguuucuuuuagacuccugaagacacugcuucauuuuucuaagcuuuucauaaaauacuacuccuuaacaguauggaaaaucauguuuaaucauucugguuucuuuguucagacaucucauauuaauacaaccacauaauugcuuaaguauuuaauacucuuugaaaauguguauuugcaaugggaguuaaguugggugcaaagggccucacauuuuuuuaaaggccuuaguggcugaugcuuguuaauucuuuuggcauuccaaauaacuagaugaccauuuuauuuuuuauuguucacagaacagcugaguccuuuuuucaauuuuccucuaucugugucuuuuccccucacacauguggagaaagacguaaugauuuaucaguauuucuuuuuuauuuguaugccuauaugggcauuuagaacuuuucugaaaauucuggauaguguuucuucacuaucagcuguaagauaaaggaaaaaagauaacuuuuuauguacacuugugaagauuggauacaaguuguucaaauagauuucuguuuugggagaacugaacuaaauuuuaaaaugacauuuuuuggcauuaggguagcuaauauugugaauaaauaagcauuaauuuguuaauacauucuuguuaagagcuugggcucugcuaguuucaaauccuaacuucaccauacauagauuagguuuacuaaacccccuauaucuuucuuccauagcugugaaaugaggaucuaauaauaccaggcuuaugguuggaaauacugaaaugauguaccuuguaucuuguauuuuuauuucuuaaaacuuuaauaaauaggccgggcacggcagcucacgccuguaaucccagcacuuugggaggcugaggcaggcagaucaugaggucgggagaucaagaccauccuggcuaacacggugaaaccccgucucuacuaaaaacacaaaaaaauuagccgggcguaguggcgggcgccuguagucccagcuacucuggaggcugaggcaggagaauggcaugaacccgggaggcagagcuugcagugagccgagaucgugccacugcacuccagccugggcaacagagugagacucugucucaaaaaaaaaaaaaaaaaaaaaaaacuuuaauaaauaaugacuuuuuguuugagauacaccaaguuuuuuuaaagcguauauuuuucuuccacauuuuaauugauuacaaauuuacuauaaucuaauuuaguaccucucauagauacaucagcauauucaaaugccuuaaagcuacugaauauuucugguuauuguuuauaagagagcauagcaggguggcuuacuguuagaauuauuauucuuucacuccuuauauaguauuaaggguuucacaaacuaguguccuugaauugggaaaaaacagagcuacaugacuuaucccacauuuuagagcuucagauuguaaaauuucaguacuggaaaaaaucaguuuaaaguaagccaucagagacuuaccacuaaaauuucaaccuggaaggagcuugcuucuaauuauguuuucagaaguaagcuuuuaauagaaagaaauacuuugccauuuguuaauguguuccugauguuuuauccauugaauuacgggauacaugacagaauuccauccaacauuauuauuguggcacaaagcacaaacaggaaaaaaaugaauuucagcuguuugaaugaaaauaaaagugugauaggauggaaagaauguccuggaccauuuuuuauuuauuuuaagaaaacaauauauacauauagaaauauuuacuuaaccaguuuuuuuccauaucacuuuuuuaagauauaaggacauugaugauauaaggacuugcugaaaaaagaaaaaauaaaugaauuuuaaaaauuaaaaaagauacaaggacaaaaugaauuuuaaaaacuaaaaaagauacaaggacaaucuguuaacacugauguuucccagcuaaaugcuuaauaaugucagacauuuuuggugagcaguuagccauagguuauagaggagagggacuucauuauccugcuaguagaguuuccuuuacuugagacagucaauucaauaagucuguauguuuugcauuaaaacccagguuucugauuuguuuuugauuuggagacuugcaguggaaauguagaacaaacuuuuugguguauuaguuuucuuggguauuuguugccugugaauuuuauaauguuucuuuguauuuuaauuauuuuugcagaacuaggaaaugcagaugugaauguuuuuccacacagugaaauuaauugaaguaacuccuaauucauuuuuauucuuaauauauuaaugagaucguuggaguaagcaugcuugcucaaaaauggaaagguuccaguauucuuagguuuggauuauaaacaacugccuuuaucucuucucuucaggcugaauagcugcaaaccgaauucaucccaacaauauucagccuacauuuauucagcauaacauuuuaaagccacugugcuggauaguggaggacauaaagagggauaaaaugccaucuucuuuuuuuuuuuuuuuaauuuuuuguauuuuuauuuuauuuauuuuuuuuuaauugaucauucuuggguguuucucgcagagggggauuuggcagggucauaggacaauaguggagggaaggucagcagauaaacaagugaacaaagaucucugguuuuccuaggcagaggacccugcggccuuccgcaguguuugugucccuggguacuugagauuagggaguggugaugacucuuaaugagcauguugccuucaagcaucuguuuaacaaagcacaucuuacaccgccuuuaauccauuuaacccugaguggacacagcacauguuucagagagcacaggguuggggguaaggucauagaucaacaggaucccaaggcagaagaauuuuucuuaguacagaacaaaaugaaaagucucccaugucuacuucuuucuacacagacacagcaaccauccgauuucucagucuuuuccccaccuuucccccuuuucuauuccacaaaaccgccauugucaucauggcccauucucaaugagcuguuggguacaccucccagacggggugguggccggggaagaggggcuccucacuucccaguaggggcggccgggcagaggcaccccucaccucccagacgggguggcuggccgggcgggggcugacccccccaccucccucccggacggggcggcuggccggugggggcugaccccccgccucccucccagacggggcggcuggccuggcaggggcugaccccccgccucccucccggacagggcggcugccgggcggagacgcuccucacuucccagacgggguggcugccgggcggaggggcuccucacuucccagauggggcggcugccgggcggaggggcuccucacuucucagacgggguggcugccggguggagggucuccucacuucucagauggggcggccgggcagagacgcuccucaccucccagacggggucgcggccgggcagaggcgcuccucacaccccagacggggcggcagggcagaggcgcuccccacaucucagacgaugggcggccgggcagagaugcuccucacuuccuagaugggauggcggccgggaagaggcgcuccucacuuccuagauaggaugacggccgggcagagacgcuccucacuuuccagacugggcagccaggcagaggggcuccucacaucccagacgaugggcggccaggcagagacgcuccucacuucccagagagggugaaaaugccaucuucauuaucuugcagcuuauaggaaaaagaagcccaaagauguuauguaacugcagaauuauuauccaauauaaauuuuaauaaaaaggggcauucccaagcauacugcuaugacagugcaaauuuauauugcaacugauuuuuauucuacaugagacccuaagucuuucauuuaauauucagaaauuuaagucugauuuugauauccuguggucuaacagcaucuuuuaaaagagagugaccauaagaucugaacacgaguuagaaaugaauuguuucuguguauuaagugaauuuuuuuuucauuaggugaugauggagucaauguagaagaagaugggaaaacaaagaaaagucagaaggaugaugaagaacaaauugcuaaauacaggcagcucuugcagguuauucaagaaaaagaaaagaaaggcaaagaaaaugauauggaaauggaaauuaaauggguuccagguaagaauuagauacuaaauguuuucucuuuuucgaauuucagcauguugaguaccuuuuaaauaugaaggagccggaaauguuuuggugaggaccuuaacaucauauuugcauacaccauuuaacuaacuuaaugacuagcauuuuagacucuuaccaacuuauuuuuaauugguuucuuugauuuacuaacuauaaauuuuuccuguccauuuaucagaguagcuuuuccuagguuugagccuguauucucaagauauagaaacuugaauccaggcaccacguguucuaaaguuauuacacuucuuuugaauguuuaauucuuaagugaccuuuucuuccauaacccccacuaguccuuaauucaugagguuucacuaacacaaaauauguauuacauagucuucgauuuucaaucuugcugcgaauagucaaagaaauauagcauaguagaguaaaauaguacuaguacaaaacuaauuaaaaucaugucaaagcuaaacaaagauaaaagcugggauaaaugggaucauucuguaguaaacagcaguugccccuuuuucaugguuucacuuucugcaguuuguuacccaguauaguacaauaagauacuuugaaagagaaagaggaagagagauuauauucauauaacuuuuauuacaguguaauuauucuguuuuauuguugguguuguuaaucucuuacugugccuaauuuauaaguuaaacuuuaucauagcuguagauguauaggaaaaaacauacuagcuauaggauucaguacuauccaugauuucagacauucacuguggguccuggaauguauccuccucagauaaugggggacuacuguacacauuuuuuucaacauuguugggcaaaucaucagggacuucugcagucaauacuguuuuuauagauuacugcuguuuauauuauauauguguauaacuuuuaaaaccagauauauuuuuggauaaggguucaguucuuuagccuauauuagucacuaggagaaagaguacuaaccaguuguaggaauaccauugcuuaaaacuuaaagguguucuguuaccaauuccauuuuuauaaguagcgugcuuuuguauugggaauaaaacauauguuugcguggguuuuuauuugggaaaaaaauaggguauuuugauauuugaggauugacuggcuauuguaguaaauuugcuaggauggacacuggcuauuguaguaaauuugcuaggauggucugcugcauauuccuacaggaaugaagugcuguguugcaacccauuuguuuuaaauguuuggcuuuugcaggaaguggugguaagaacgaaugaaguuuacugguguaucauaugacaagugguugggagaacucaauugauuuggccuggagaggaaaagucuaaaaagugauuuuaacagcuauuuuuaaauacuugcagaauauguaaaugaagacuuaaucucuuuuauuaccucacagguuagcaguacugccaguggauaaaaguugaaggaagguagauuuuaacguaauaauauaaagaggaauucucuauauuauuagaauugucucgcagaagaacugaaggcugcuuuaagggguugagcucucugugucaguaaaucuccaccauaaggcuacauaauuaugcuacucagagaugucuguuaagaaauauuuuacuugagucccuugacuuuaugauucuaagaaauguugaauucugucuuuuaaguugaauauauuguaguuuaauucuaaucuuagaaugagcuuauugaauauauuuuaauaugaacauuuuuaaauugaaguguucaguugucugagaaagcagaucuaaaauaaacuggauugagguguuuuauagcaaauauuucagaaauauauaaugccaguuguaagguacagauauaugauacagguucccacacuaaguggaccacaucuagauugugucuuuauuaacauaauuaugaaaccgggcacaggggcucacaccuguaaucccaacacuuucagaggccaagguggguggauuacuugagccucagauguucgagaccagcccgaguagcauggcaaaacuguuccaucucuacaaaaaaauacaaaaauuagcugggcaugguggcacacgccuguagucccagcuacuggggaggcugaggugguaggaucaccugagcucaaggagguugaggcugcaguuagcugugaucaugccacugcacuccagccuaggcaacagaaugagacccugucucaaacaaacaaacaaacaaaacauaguaauguagggcaaauaccuaaaagugguauuuacaccuguuaucuguaacuggaaguuauaagcauugcuuauauuuccucagauaaaccccaccuuggucaugguaccuuaucuuuuuauauauucccagcuuaauuuaguaauauuuuauuaaaaauauuuguacuuguggcaaagaggaauaugaucuguaguuuucauuccucguauugguuuuugguauuaggguaauguugaccuuaugaagugaaaauguaaaaugaaagauuaucaucuguaauuccacuauccuaauucaaccacugguuaagaagauuacaguuuaauuuaccauuucucuguuguugaauaugcaaucagauuucuaaucuuucacuacaguggacuuauaacauugaaaaaaaaauaggacagaucucaaacccacaaauaacaagcuuuucuuaaauuucuucauuuucaugagcagccaaguaauuggcuugccuuuuuagggccuuuuaauuuuaaaaacuuuuaaaacagagguguguuuuucaucucucccagccuagaaauguuuccaagcaugucaggacuaguagagaacaaccaggccacaaugagaagcugaugccuagcauucaggcuuaacucacuaguuaguuacgugacuuccuugcucacacagcaacucuacaugugcuguagaucaaccugugguucucucacaagcuguuaaaacuaccagugucaaaaccucaaauguuaaaucccagaugccaaguaucugggauguuauaaauaaccuauagcuuuuuccauauuuugaauuauuuucauaggauaguuucccagaaauagaguuacuaagaaagggcaugaauacuuuuugugucuugaaguuauugccaaauugcuuucuggaaguguuguaccagcuuauaauaccuucaacaaucaguaagagugucaguuucacggaauuaucgucaacauuggguauauauuuuuuacuuuuaauugaauaggggaaaauugauauuuuaauguaugaguuucaaaggucuuaaacuguaauauuuugaaggccccuaaugagguauuguuaucugugaauccuuauguacaugcacgcaugcacaugcaaguguaaaggguuuuucugugugcuauacauauaagaucauugagcaaucuuucuguaccucaguuuauucauauggaaauuggaacuaauaauaccacuuucuugcuuagagauacuuacaaacguuauaaacuacaaaguacuuucaugacguguauuucagugaauuuaugucuuaagaaauguguguuuucuguaacaguuacccugaaccucaggacuuuuuugauguuaugcuucaguaaaccacggagggucaguaugagauuauaccguaucauucauugguucuguggcuugacucuccaaaauauuaaccucuucaggaaaauaaguacucuuaaucacuaacauuuauugugguuugguuugauuuuucagaagaaauucuaguuuagacuauuuaaacguucuaccuuuuuacauuggguuauacaguauaguaacaugaggaguuuaauuucuuaaggguaaguauuaagggaacugauaacagguuugugggcauaacaacuggaaugagcuacucuuucuaucaauauuuuaguuccuauggaaauguaauaauacaauuuuauuaauuaggauuauaaauaaguaaaaauguugaauuauaaaauuuuuaaagaaaguuauacuuaauuauuuugauguaugugaaguuguauuuccuaucucaaugcguugcuaaagguauccugccaacuuacuaaggaguagauaaggugaugcauauaauuagccaguugggccuucaucaagaaauguaccucguugaggaauuucuaauacacguauaaaugaaguguaaucaguuuuaacucuuuauauaacuuccccuguauuaauaguccaguuaaucuacauaauauuuuuuguagauaaugcaagcugaauauaaacaauauauaugaaauuccauccagaaauaaauaauggcauguuuguuuauaaucuuaaauuuuugauuaugguaaaaguccuguuuuucuuagcuaucucuggccuaauagauauuagugaaauggauagcuggucuuuuuucuacucagcacucuacagaaccccaacuucucuuccuuacuccaucaaauacuuacugaauaccuacucugugccgggaauuauucuauacacugugugaacaaaacauaaaaaucccugaacucacagaucuuauacuccggugaaggagaaacuaaacagaugacagauauauaagaaacauauuugaccaggaacuaaagaaaguagaggucagggagugagccuggcccaggaagacugugugagcagaggaaguagcauaggaguauccuugaagcuauacuuugucucuuguguuugaggaauccaaggagaacaguaugacuacaguggaggacagaaguaacugagaucagagagguaguuuggggccagacaugaaagccuuguaggccauuauaaagacaugaauuucugugacugagaugagaaaccacuggagaguuuugagcucaggagcagucaaaucugacuuuuauauuuaacaggaucauucuugcugcuauagauaaguagauuaaaguggggggcaaggaccaaauuggggagaucaaucaaauggcuguuggaguaauuuucagauaaugaagcuuguggauggaacauguuugcaagggagcaucaagaauuuuuuuuuucauacauuaaguucaagaugcccauugauaccuaaauagacaugccaaggaaucaguugguuauacaguuaagaguacagggcugguagagauauaaauuagagaaucuucauuguauaaaucucugaaagugaauaagaacaacaagguagugaauauagguaaaaaagaaagguucaaaagcugauccuuggagcacucuaacaucuagagguagaggacaugagccuggaccauuccgagcagcuggagaggcuaucagagaagcaggaggaaauucagaauugcgggguauucagccugccaauaaagaaggcauuucagugagaauaugggucaauaaaauacaggcugagaaugaccauuggauuuagcagugugaagcucacuggugauauugaaugguuuuugugggaugaugggggaugaaaguaguaugguuugaaggaagaaugggaagagaagaauuagagacaguaaguagaggcaacucuuuuucuaaaauauuugauagaaaguugcaagcaccaugacacguaaaaaaaagcacuucaaaauguaacuuccaaaaacuaagacaugcuuccauuauaagcacguugccacuuucacaccaagggaauuguuagucucagacuacuagagagauuaacuuaugccuagugguccauuauuggaaugcuaagcauguggaaguuauuuauauccuacugcucaaaguuugauugcaaaaauucaaaaaauugcaaccucaggcauaaauggguuaaaaugaaaagauugcagcuggugguagaagaguaggaugcuuggaaaguaagauuguggugggauugcaacuuuggguaaucacaugaccuguuuacaauccuggcagugaauuucugagaugggauagaguguagaaccauaggagaggaggucagugaacugugaggccaaagguacguucagaggaucaucuguguggauacugaagucaccaagaauuaugacaggaguauuggaaagaguggcagugagcuaaaauuaaaaugagaagagcaucuguggucauuagauaucuacaucagguucuggaagaauuugcuuacaaaaaagauaucuacaauaaggaagaguguagucuaucuaguauagccugaaaauaugauauucagaguggaggcacuggggaggagggccagccaguggaugggaauuggcagugagucgcagggacagugggagagaaaaauucaccugcuaaaagagauagaggggaagcaguguccucagaagagagcuaaguuuuagugaaacuccacuuagcagauaaauggguaagggggcuuuuguuaaugacuaauaacugacuagugaguagaacggcuuuagucauugaggauguucggcauuguuuugggagaaggaaugauuuggaaauuguaaacuucaugugguggcagauuuaaguaugaauaaagggauuuugagauuaguuuugaucgucuuaaagcuuucauagugguagggaugugaaugucauugggauaucuuggcaggagcacacagaguucuagaauacuuacucuugggaaggagacauggaaaccagaaaacuagaggugccccuuacugucucacgcuggcaaggacuucucuuacugucucacacagcaagaggagucccuuuuugacuccuauuccuugggcauggaguagggguguagcucuuccuuuguucugcuuuuuccuccuccacucuucacaguuguaauuucauuuuuauucugguaucuguucuuuauccuucguccuccccugccacauuuauuuuaucuccauuucucuguucaguuguuccacugaguagcuuaaacagagacaucagugacaugcauauguggccauuguauuauucauucuuuuuauuuagaaguaaaaauguuuuugaauuaguugggcauucauuuuguuaggcagcccaguuucaagcauuuuaauuuuuagaugucucaaaaccuguucacuguuuaguuuuggcuccauuuucauuuauugccaaugugcucauuauuugaaauauauucagaaaaauuuuuuuuggccagaacuuuuaaaauaaccagauguuuaaaauuuugaaucgaguauagaagagggcauuaaauggaaaaccugaacuuaaaaauaagcuaaaagaauuuguaguuugccucagauuuuggugguggggaggaaaccaggucacagugcacucuuguaacuuguacgaagucacacagcugguaaguggcuaaaauuuuaaaaccuaagcgugagcuccuuccuugaaucauccaguuaacagguugacuaugaggcguuuguaagguaauaagcuauaacuucauacugugcaaaaagauuggagucauguuugaaauguguaauaaaaaugagaagcacuuaagaguuaucuaaaaaugaugcuaauacauuuccuccaugugauugcugguaauuuucucagugcuucuugaauuauuugauagacuguuuucucucuuaauaauauugauuuauuguuauuuuuauuuuuauuuuauuuuauuuauuuauuuugagacauucuucugucgccugggcuggagugcaguggugcuaucuuggcucacugcaaccuccgccucguagguucaagugguucuccugccucagccuccugaguagcugggacuacaggcgugggccacuacgcccagcuaauuuuuguauuuuuuguagagacaggguuucaccauguuggcuggccgaucucuugaccuugugauccacccaccucagccucccaaagugcugggauuacaggcaugagccaccacgcccagccgauuuaauuuuuaaaaagagacuuuccaagaagcuuuuuaaaaagauuuaacucaaaaagcaaggauauuuuucuacuaguaguuucagaaagugcuaaaauugcaaugccuuaugaaguuucagguuaauugaucugguucccccccacaucccugcacaggauuccaguuaaaauauguaaaucagcaagauccucugguugcaaagaucuagaaugauucuguuaauacaguccuucccgcuguuugcauguguagccaccguuucuagacuauacuguuaauaccuuuuuuuucuuuuuauaacuaugccuuaaacuugcaaucugccacaagugagcucaagaaaagaaaacuugucacauguauuguuuucccauagcccacagcuaugcugauuuguuugaaguugugaauucuuuggucuggaaagcaaaacuuucgcuauucuauuugugguuguccuucauuauucuaucuguauucuaacugucuggcuaguaagcugucacuuuucguugcacauguuccguguguuauuuugacagaacucauucauacuacuugcuuucaucaguuucauuauugcaaaauugaaaaguugggcccugauguuaugcuguagguucuucauaaaguuuugcuaaauggauaacauaauaaccuuuuauuacauuuucucacagauacguuuuugaguauagcaucuucgugucucuucucagguguuauuuauuuauuuaucuuuuuaagagacaaggucuuguucuguugcccaggcugaaaugcagugguucgaucaugacucauucaugggcucaagcgauccuccugccucagccucccaggcaucuagggccacaggugugugccacuaugucuaccuaguucauuuuuuauuguuuguagagccaggcucuuacuacauugcucaggcuggcuucaaaauccuggccucaagcuguccucccuccuuggccucccaaagcgcuggaauugcaggcaugagccaccaugcccugcuuuuugaaaggauuguauuaauuuguugugccaacuggagaacuuuuuauuguuuagcuuuugaaagcucagaaauacugauaaaauuauacacaaaauauaaucugauuccuaccauagguucagguuuuggagccaaguaaaggauaggguguaaguacuuuacuuuuuuguuuguuucuuucuuucuuucgagagggagucucgcucuuucgcccaggcuggagugcaguggggcugucuuggcucacugcaaccgcugccucccgcguucaagcaauucuccugccucagccucccgaguagcugggacuacaggcacacgucaccacacccaacuaauuuuuauauuuuuuguagagaugggguuucaccauguuagccaggcuggucucgaacuccugacuucaggcgauccacccaccucggccuuccagagugcugggauuacaggcgugagccacugggcccagccuggauagggcauaaguacuucucuguagaucuuugguuugauacaaaauuuaaucucacucugggaccauauugccauuuucuguccucugaaagauuugcagccuuucucaaugucuuuucaguuagacuguuguagacaguugcucacuguaugcaauaugcaaugguaauuuucggaauugaggucuguggugaagccaguaaaaacuccuauggcuuuaacugguggcugugcaaacugaaucugcugguuuugugugggagugagaggguacuuuccuuccucaauuuaaucuuuacugaggguggguggugggauagcuguaaucaaaugagcuaucaaaagauauacccggccgggcaugguggcucaugccuguaaucccaccacuuugggaggacaaggugggcagaucaccugaggucagaaguuagagaccagacuggccaacauggugaaaccccgucucuacuaaaaauacaaaaaauuagccaggcaugguggcucgugccuguaguccgagcuacuugggaggcugaggcaggagaaucucuugaacccggcaaguggagguugcagugagccgagaucaugccacuauacuccagccugggugacagagcaagacuccaucucaaaaaaauuaaaaaauaaaaaagacauauccuugcucaaucuacccauucagugauguggaaaacuuuuaucuguaaaauuauuuagcaugaccuugaaaaccugacccuguguaugcccaaagauaaguaaccacugaguucccguugguauuuggaaugaugugcuuuaguaguaaauugaagcauacacuuugaagguauaugcuuuccuaauaauuggaagucugggccaggugcgguggcccacgccuguaaucccagugcuuugggaggccaagguggguggaucacaacauggugaaacccuguugcuacaaaaauacaaaaaaaaaaaaaaaaaaaaaaaaaauuagccgggcaugauggcaggugccuguaauccaagcuacucgggagacugaggugggagaaucgguugaacccaggagguggagguugcagugagcugagaucaugccguugcacuccaaccugggcaacagagcaagacuccaucucaaaaaaaaauaauaauaauuggaagucugucucuguaggacuuaaucagacuuuuccuaagcauugucagcuuagagcaucauaaaauauauuuuauuuuaggaucccauugcuguaaacaggggaauuuuaaaaauuuaauucuuagaugcauaauuuugauccagaagaauuacauuuuaaaauagccuuugaggggcugggcaugguggcucacgccuuuaaucccagcacuuugggaggcugaggugggcggaucacgaggucaggagaucgagaccauccuggcuaacacgugaaacccugucucuacuaaaaaauacaaaaaaaauuagccggccuaguggcgggugccuguagucccagcuacucaggaggcugaggcagcagaauggcgugaaccucggaguggagguugcagugagccaagaucgcgccacugcacuccagccuggggaacagagcaacacuccaucucaaaaaaaaaaaaauauauauauauauauauacacacacacauauauauauauauauacacacacauauauauguguauauauauauguguauauauauguguauauauguauauauauguguauauguguauauauguguauauauguauauauauguauauauguguauauauauguguauauguauauauauguguauauauauccuuugagggaggaaggggaaguuugcacuuauuggaugcuugugcuguaucaggaacuauucuagaugcuucacacacaauacuacauuaaguucuucaaggugguuaguaccccauuugcaggagagaaaaacugaagcauagacuugcuuaagaucacaaaacuaggagacagaagaacugucacagauuuuuuguagauucugucaucagagaacugacaagaauagaaauagagcuuuauaaggcaagcuauggaaaaugcagucauacccuguauaacgacauuucagucaacaguggacugcauacacaacaguggucccauaagaguuauagugcagcugaaaaguucuuaucaacuagugcugucauauuuuugcacaacacauugccuuuuuuauguuuagauacacaaauacuacuauuguguuacaauugccuacagcauucaguauaguaacaugcuguacagguuuguagccuaggagcaauaggucauaccauguaaccuagguguguaauaagcuauaacaucuagguuuguauaaguauacucuauuacgauguucacacaaugauaaaaaggucuuaacauuagccuaggugugugguaagcuacacaccaucuagguuuauguaaguauacucuauuuuaauguuugcacaacaauaaaaugccuacacauuucucagaaaguguuccaucauuagcugacaugugacuauugaaguccuaaauguuaauauuauuuugauucucuauuacccucauucuauauuuucucucucuuuuuuuuuuuuucgagacugagucucgcucugucggcaggcugcagugcaguggugccaucucggcaggcugcagugcaguggugccaucucggcucacugcaaccuccaccucccggguucaagcaguucuccugccucugccucugccucacgaguagcugggacuacaggugugcaccaccacgcccagcuaauuuuuguauuuuuaguagagacgggguuucaccguguuggccaggguggucucuaucucuugaccucgugauccgccugccucagccucucaaaaugcuaggauuacagacauaagccaccaugcccagcccuguuuuuuuuuuuuuuaauauacaacucauuuuucucugguauacucuuucaaauacugcauaaaggacacugccaaugaaguagccaguuaauuacaaauacaaaaguugaaagaguaaaccuuaaaggauuacucuguuucaaggauucccaaccagcguaccaccaguggaugacaaauuagccacaaucuugaucccuuucauccuuaggcccaccagagccccuaggcuguuuucuucucugguugcuuccuccguuuucucuaucuugcuguacaaacauugucauugugucuaccauguaggaaaaugguugggaagguacugcuuucuuaguaguuauuuggaaagucuuuuuaaaaguagaggaauuaugguuaacuuauauaaacucacccuaauaaauauggaagaaaauauuuagauugcaagaagaaaaaucaaguuugaauuuaguugugacuguuauaaauguuuuuaaauauuggaaugcuagggaaguugaaauguuuaugauuucuguuuuuuauaacaaagaaguguuugaaauugacuuagaaaugcuguuuagguuguaccccagccucaguauauccuucuauauucauagcuucuguggacaggaaacucuuccagggaagaaaaugauuaggcacccuugaaugucaagccaccaguuuacagguggauuuuucaaaugcagucuguagggccugcuuauaaugaaauuugggauagcauuaacaguuuauugugauuacagaaagagcauagaggccucaaagucagaaaauuuagguuuaaguuaucauuuugauggggaguaacugacaaagaggcaggugaaagcuguuuagcacacaguugucaaagggugaacauucuuuuacugucuuuuaaaaaaugcuuauacuucauuguggggaaaaagucauagauuaaagaaauacuauguguguauauauuuauauauuaaaguguguauuuacaguuuaaagaaaaauaaaaugggcugggcaugguggcucacaacuguaaucccaacacuuugggaggccaagacaggcagaucacuugaggccaagaguucaagaccagccuggccaauauggugaaaccccaucucuaauaaaaauacagaaguuagccaggcaugguggcacacaccuauaaucccagcuacuuggguggcugaggcuugagaaucucuugagcccaggagguggagguugcagugaucugagaucacaugcuacuacauuccagucugggugacagagcgagacucugugucaaauaauaaaaauaaaaugaacacauacagccacagacauuaccagugucugcaguccucugugugacuucccaguuauguauuagucauucuuuuucuuuucuauauaguuuuaccgcagauacaucuauuccuaauagucuauuuuguaguuuuguuaauuuugaacuuuauaaaagcauccucuguguauucuugucauuugccuuuuuaaaaaguaaacauucugggccaggcaugguagcucaugccuguaaucccagcacuuugggaggcugaggugggcagaucaccugaggucaggaguuugagaccauccuggccaacauggugaaacuccgucuuuacuaaaaaaauacaaguuagcugggugugguggcaggugccuauaaucccagcuacuuggaaggcugaggcaggagaaccgcuugaacccgggaaggggagguugcagugagccaaaaucuuaccguuacacucuagccugggccacagagcgagacuccaucucuaaaaaguaaaaaauaaaauuaaacauucuauuuuugagaguuagccauauccauauauguguauaugguucauucauuuucauggcuacagagaauuccauuguauaacuuaucacaauguaucuguucuauugcucauuauuauacuuuauuucuguuaugaaacagugccuuugugaauauucuuggauguaucacgaagauacgcauggaauuucuuggauacauguagaauuucuugguuguaacaugcucguaauuaccucuacuaggucauguguuuucccaaaugcuugugccaucuuauacucucaccaguagugugaguucccauagcucuuuaucguuaccuuuaacugauauuaucaggcuuuuucauuuuugccauuugaguacauaaguaauggugucucaugguuuuaguauguguauucccagauauugagaguuccuacuguauaccagacucuguucuugucauagaguauugaacagaauagacaaagguccaggccuucaaugggcucugcagucuauuguguguggccuggggagggagagaaguuaguaaacaaauaggcaaaauauaugcaaucucagguggugauuaaagcuuguggaaacaaaagccuaaagccuacauggggaauaggaaguuuaugguugggaaugaguagcaauuuaaacuggauagucagggaaggcuucacugcuacagugacacuucagcaaagaccuaauggaaaugacaguagucaccauguguuauccuaggaaagagcauuucagggagaggaaacaacaaaugcaaacgcccugagggggaaacauuacugauguguccaagaauaauaaggaggccaguguggcuggaacacaguuagccaggguauggaaagcagaagaugaggucagagaggcagccaaaucacaaaggguuuucuacaucucuggguggacuuuagcuuucacccugugugagaugggaaauggagaugaugucaccugacuucaguuuuuaaagaaauacuuaggcauuucccugguuacuaaugaggaggaacaguuuguuuuuccucauauguagaaugucuauucauguauucuuugucuuauugauucugauuccuaggaguucuucauauauucugggcuggucuuuuaucaguaauguguuuuacaggugucucuuccugguuugugauuuuacuuucuuuauagugucuuuugaagaacagaagugugauauggucaaauucauuaaacuuaaccucuuuauuuuuaaguaucucugguguacauaauuggaguaaucauaaucuauagauuaagacagucucucaucaaugguccggcaugggccucuuuuuauugauugguuuguuuguuuguuauaaugaauaagugaacccaccacccacuacgaaagcuagaaccuugcaauaacuuauauuuaccuguuugauccuccccugccacuccauacuugaggaaaccauuauccagauuucaguauuuauucauuuacuuuccauuguauauaguuuuuuaaaaauauuuaauugacaaagauugaauauauuuaagcuauacagugugaugauuuaauauacauauucauuguguaaugauuacuacgugauauuaacacauccaucaccacccauucuguacgcuagaucccagaacuuauucaucuugugacugaacauuccuauuuuuugaccaucucccuauuuuccccacccuaaagcccuuggcaaccauuguuuuacucuuugcuucugaguuugacuuuuuuagauuccacauauaaaugaacucuacuagguauuuaucuuucugugucugccuucaccgaacauaauauguucucuaggaucaucuguguugucacaaauggcaggauuuucuuuuuuguggcugaauaauauuuuguuguauauauguaccacuauuucuuuauuaauucaucugcugauggacacuuagguuguuucccuaucuugguuauugcgaauaaugcugcaaugaacauagggguucagaugucucuucaagauacugauuucauuuccuuuggauauauacccagaagugggauugcuggaucuuaugguaguucuguuuguaaguuuuugaggaaccuccaugcuguuuuccauaauagcuguaccaauuuauaaucccaccaaccguguacacacccucaccagcauuuguuaucucuugucauuuuuaaaauacccauccuagcaagugugagguaauaccucaucaugguuuugauuugcaucucugauacucgugauguugagcaccuuuucauauaccuguuggccauuuguaugucuucuuuggaacauuguauauaguuuuauauaacuuauaaauauucuuaagagauaauggguacauaaaaaggaaugaagugcugauacaugcuacaacauagaugaaccuugaaaauacuacgcuaagugaaagaagauggucaacaagaccacauauuuuaucaaaaguauccagaacagggaaaucuauagagacagaaaguaggcuagugguugccacaggagggagggcgggaacaggguuucuuuuugaagagaugaaaauguucuaaaauuguggugguauuugcacauaucugugauauuaaaguuguuaacuuuguuaaugugggaggaaguguggguguguuugggauacuuuuaaaucauuuugggacugauuuuuuuuucacuuaauauuauauugcuaagauuuauuuuguguagcugcaggucauccauuuaacuucuauacuauaguuuguauauucauacuccugucacauuucaguuguucuuagguguuacuaugaugaaucaugccauuaggaacauuucuaugcauguccccuaguacacguuuaaguuuuucuggguauuuguguuaggaguauaauugcugagucauaagguauaugaauguugaacuuuuuuuuuuucuuuuugagacagagucucacucuguugcccaggcuggagugcaauggcgugaucucagcacugcaaccuccaucuccuggguucaagcaauucuccugccucagccucccaaguagcugggauuacagucacucacuaccacacccagcuaguuuuuuuguauuuuuaguagagacgggguuuugccauguuggccagacuggucucaaacucccaaguagcugggauuacaggcguccaccaccacacccggcuaauuuuuuguauuuuuaguagagacaggguuucgucacauuggccacgcuggucucgaacuccugaccucagguaauccacccguauuggccucccaaagugcugggauuauaggcaugagucaccacaccugaccaugaauguugaacuuuauaaggguggugauauuacuugacauuuccaccagcaguacuugauuugcauuucucuugucaccaaugagauugaacauguguuuccuucucugugaaauacuaauagauguuuuuuggccauuuuucuguuguacuguuugugcuuuuccuguuggcuuuuagcagcucuuuauuuacuucugauacugauccuuugucuuguauaagacagcuaauaucuucuaauuuguaauuccucucuucucccacuuucuucugucaucuaaugaacaagaauacuugauuuuaauauugucagauuuaucuuuuauaguuaauauuugcuguuuuaucuaagaaacucuuuuuuguccagaugagaagaauguucccuuugauuuuuuacuaaaagauguaagguuugggacauuuaaguccuugaguuguuuuuuuuaauaugagguagggaccugauuuuaucuugugccauauagaaaaucuuuuuuaucuuguuccauuuguugaauaaucucuccuuuccucuaguaaugugacaugucaccucucauguaccagaguuucagaacuguggguuuguugcuuggcucuguguuuuacuggucaguucgucugccuaucccuagaccaguaccacacuucagaaaacuggaugaagaacauuaacgaccaccacaucuagcccaccuguaggccagcuuguauggggguucugugaagaaaaugaacuaaaaugcaaaccaaaagcaacaauugaaaggacuguaguaugugguauccuugguggagagccagguuucaguuagaacaagauaaagaaaaugcucagagauauaaugagauucugcugaugauguacugugaguuccacagaauuuagugauagagaguuggcagggaauggggcagaagaauugauguauuguuaccuucuggggaugagaacaugggauauuagggggacaagaugauuaggggcuuuuugcagugaccaaaaugaauagggagaaaaggcauaaauagauuauuccuggugggaugauuccugggggcagauugugauagugaggcugugaauauugaggauuagggagggaaggguauuggcuauuaucuuggaugcaccaagccaguccccgucuuagccucuuucugggaaggggcaauuuuacugugagcucacaagacuuccucuugacuccugugcaagucaggaagccagugugacuaaagaacaaguauuuuaauaccucagggcccacuuuugaauccugucaggagagauguggucuugcucuacaguguugucuuggguaccuggcuuuuaacauauuuuagguguucuagaguugcacucugauguaggucauuuuuugcuuguuagcuuuaaucuugcuuggaauuaaauacccaaaauacugaagauuaucaucuuuuguuaguucugaaaacuuuuccaccauuuucucuuagaauauuacauuuucccaaucuucucuguuuucuccuucuggaaauccuguuuaauauguguaguacauucuaacucugaaucugauaacucauauuuuccaucccuuugaaucucuacaacgugcuggguaauuucuucacuuuuguuuuucaguucauuaauucuuucuuuaccucugucuagugugcuguuuauuuuuuuucuagucuuauccuuuuguuagucugaucuuuuaauuucuucuuuuguuuuuuaaaagugcugauauauauuuuguaucugauaauuccaauauucauagucuuuaugguucuuauaguuuguuucugugaaguuugauugugaucucauuguucuugaaucuuucuuuaccuaagggaauugcagaagccugugucaaaaguacuucuuuuaaaaaauauuugccagaugccugagggcacuuccaauccaacaccaauugaagcugaguuuuuggauuggauuauuuugggccacacaaguagugugaauuccagccacaaacccagggguuugugguuauaaaucuaugggggaaaaauguauuuuuacuucccucuuucugcccauaaccaaagcccaaacaggcauguguucucucugauuugugggggaagggacaucacccacugagagcacccuuaagcaucuuggcuuaauguaguggucucugcugggaccucccaccgugaucaggcuucaaacucugugugcuggcuucuuggccagcaacccauuacaaccaaagauccauauaagaccauagcagaucaguguuuguccccaaggaaaacuccuugcuucuaaucuaguuugauauuuccguuugagcuuucuuuuuuuuuuuuuuuugaacuuucuuacugugacuggauuccaagaaauuccuuuuguuuucuuacaucuaaaaguuuucauuuauuuuugaccuuguccauaaacauguauaaaaauaacaauagaacaaguaguucuucagucuucuuugccguaaacuaauuagcagaaugacuucaccagacuuggccagaauuuuaguuuaucaguacuaggauagcuugauauuguguacauugugauuacaaacuacuugaaagacaaagaaaacauacaaauaaaguacaggcaaauacaggaaacaauagcucccuaaugaggcccaaauguuguuuuguauuugaaguuagcuuuuaagaauauuugauucuaagaagcaggggcagcuugauuuacaguaaacuaaauaugauuguaaguggaagacaucauuucaagggagaguaaaaggcgauuuggaagaagaguaugauaagcucaaauucaagacaaauguaaagcaauuucuacccaguuaaauagcuuuuagacaaucagcaacaaaaaaaaacguguucauugaucacauacuuugggcauauuuucuauggaugcuucacugaauguuuuggaagauauagaauugaggguuauauaagaagcaauugccuaucuaagcagcuuccuguacccucauccuuauuauccuuaugacuguguuucuguauaacacuauucucauaguguuaagugcacccaaagaguauuuguuggcucugccugauuggucauuuuugcuauuuacuauuguucacaaggcuaguuauuuuacuuuuuaauuuuaagcauuguuguuccuagucuguaagguugggaacaaauuugacucauuuuuuucuuuuauuugcuucuuuauucagcagacauuuauaaggugcgugcuguaugucacaccuuucacuggccgcuagaguuaccagcaagagaaaaacaggcuaugaccuuugcccucauggagcuugcaaccuguuaagagagauacccauuaauaauaauuuuuacaauuccacaaaugaauauauaauuccaacugugacaaaugcuagagaauaaaagaccauaguacuguaagaguuuaggagaggcugggcacgguggcucaugaccguaaucccagcacuuugggaggcugaagcaggaggaucauuugagcccaggaguucaagacuagccugggcaacauagugagacuuacgucucuauaaaaaguaaaauaaauuagcuggguauggugaugcacaccuguggucccacuacucaggaggcugaggugggaagauugcuugagccugggacaucuaggcugcagugagcugugauugcacuacugcacuccagccugggcaacacagcaagacccugucucaaaaaaaaaaaaaaguuuaggagagagggauuuacagaaguucauacaagaaauuguaagauccugaaccaaguucaaaacccuucagaucuucauauguuuuauuugaaagauugaucacuuggcuuauccaauaugcuuuaaggauauccuaugcacauagucacccuacuuuaccaaggaggaaaaaauggcccuggcaaagaucccguuuacuuaucuggaccaaauauccugugaccccuguuaugugagugaauguguccuuccuucucccuacaccauugggguggagaguuugaaggagugucuuugaugacacuguuccucagggcauggccagugguuuuccucuaaaaauccuuauacucuguucggccaagugugguggcucaugccuguaauccuagcacuuugggaagccgaggugggcggaucaccugaggucaggaguucaagaccagccuggccaacauggcgaacccugucucuacuaaaaauacagaaaaaauuagucuggcaugguggcgugcgccuguaauccuagcuacuagggaggcugaggcaggaaaaucgcuugcaucugggaggcggagguugcagugagcagagauugcaccauugcacuccagccugggugacagagcaagacucugucucaaaaaaaaagccuuauacucagaguggauuccaaauuugaaguuuugguggcaguggugguggcugguuagauuuuaaaagcuacuuuuggaauugaguguuacagagucagguuuaaauaaagagugcugguuucagccuauaucagaaauguuuaaauauacauuuuguuuuuauaaccaaagccgauuauaguaccuaguggaguuauuuuaaguuguucaucuccugcccuuugaagacuuuucagauauuucaaaugaauaagguaggcagaauguauacucuuauuuuuguguguuuugcaaggauauuuaaaaauauuuuuauauguaugcaaacugccagaauaauucugaauggauugugcuuaaauuauuauugucauaauugagucaucuauguuugugguuggcugugaaagauguuuuugccccuuauuuguaggauuauugauguuauuuuuaacuaauucagaaguccuuggauaugcacuuaaaauuuuuuaaacaaauuugugcaaaacuaaaagcaguuacaaugaaguuguuuuucagucacauaguggcugcucucagaggcuaaaacugucucugaagaauguucucguacuuaugccaagaggcuucugggaugggcauauuuuuaagaacuuagaacauaaacagcugugaucuguggcaagagauuuaaaugaccucaugaugacaacaagaacaaagcauuuuuuaaguuaucaugguggugugugaauucauugcaauguguuucuuaugcugcuauuuggguguauuaagugagagccaggcaaaaaaaaauuacagacuguauuaaacugaagauacuguuucuuuauuguuguaaacaaaguaccagaaaaauauuauuuccuaagaauaaacauuucacgaauuauuuuagaguuauagguccuuuucuuuuuuguuuuuaaccacaugaaccacuugaggaucaaggccauuuauuucgauccuaaaguuuugauucauuuucuguuagagagaauauguuccaaacaugaaagaucaaacagauggcuugaaauaagaaucccuccuuuaagacagaucaauuaaguguuuauuaaguauuuacuaugugucuggcacuaugcuaaauauuaugaaauacuaaagaaggugacuuuaagcugcuuuuggucuaguuagaagaaaggacugcucagaugaaacuuauaaauugggaagacauauaaucaagcaccaaguaaaauaccaucacuuaugugguucaaauauugacauagcccuuuuuuuuagaaaugauuuuuaaugauugucuagaacagugauucuuagcuagagguaauuuugccccccaagaggauauuuggcaaugucuggagacauuuuuuauuauuacaccuggaguuacuagcaucuaguggauaaccagagauauugcugaauaacuuccagugcacaggauagcccgucacaacaaagaauuaucugguccaaaauaacaauaauacugaaauugagaaaaccugauguagaaccuacaaaugucaaugcuguuaagcuucaaaguuacaggaauggacuuucaucuucccccaggcuagaccucuucagcuccuauaaauguucuuuaccuuaagcucuuggaucauuacacagagaugaucuuuggauagucauaaaccuccugaacauuggaugcaaguuuuuccaguacaguguuagaguccauaacuuuuaucaaaaucucaugcuauccaucccuccaaaaaagguugagacacaucaacccaguccucuagucaccuaagagacaacaacauagaacccuccuuagcaucauggugauucagaaguagagcuuggaucaaaaucagaaaauaacuuuuuuggugaaaaaauuucuauauuaguuuaguauuuugaaguaauacaaucuuaaugcaugaggaaauuauaguagaauacuucaaagaguauuauuuaaacaucauguaauaauacaacacuguacauuuaaaauuuuagacugaacugauugugugcugaccuaugggcagaauacauaaauuauuuuguucuuugaaaucaacuuguuuuaucagaauuugcugcuuucucucaaaugaacaucccaguuuacauuucuuaggugcuguuuaucuguugaaucagagaucuaaacaugguuuuauauuacacauuucuccugaaaacuguuuacuaaaugaauuauguuuuucucauaagaaacauuuuugaauugagaauuguguucugauuuggcauccuguaaguuagagauccuaacagcaguaugucauaaaaacaaaucuguguuaccuugagugugcauauagguuaacauuaauacuuuucuaagcuauagaaauuuggagauuaauucuuggguuaaaaaccaaggaaggucuuagagaucuguuucagcuguuucaaacuguugguugaagcucaaggcccaaaagcaguguuuuuaguuguuuuauauauuuuuacuuuuaccaaauguuuugagggggggaaaucagugcacgugggaggaaaggguugcauacuucugaucuaaaccauucauuuugcagauaaggaaccagaggcccaaaguuuuagauuuuauucuugggccauauauuucuucauucuguaggucaaacuagcauuuuagauguaucugauaauagaagagaggaugaccaggaauucaaaauuuagcugugcagcuuccuaccuccauguucuuagacaaauugcuaaauguucucagucuguauauacucaucaacaaaagagaacuguauuuaguaucguuucuacuuucuuagaauuuagaauguaucugagaagaugaucugguuugaugaugucucuuuuuuuaaugaauuuugugucaucuaaauauuuaaagauccacccaacuauguccucuaaacacuacuacaaaauaaaaaacaucuuuauuaucaaaggggacagcacaguauuuacauuuccuuuacuuuggcaauaaugagggucuuuguaaauggauagaucagccuuagggcuuuuucucccaccuuguuacccccucuaguuauugcauaagauaccuagaaacgugaaucgggaacagcagacuauaggaagaaagaccuuuugagaugaaauauaagagcaaauagcagcauugaaagagcuaaaccauaugaugaaauggaaucugaacuuggugguccuucugaucuuuucuaugaggccucacagaaugcuugagaaaagauugagaauccuuugcucaugggauauuucaacagggauuccuuacuaaacaauuuuuguucaaaaccuguaguuugcagagaacauaggcuuucacuuggaugacagaagcaaguggggauaauuaaagacaagaaaagccacuugucuuuugcuacaaaaauuaauuaguauccugagaagaauuaguucagaaguuuucuuagcaucucaaaacagaaaaguuuagagaaaugaaggcugagccuaaauacaguauuuuucuuuaguggcuugaccauguaucaaguugcuagguuuguuuguugguuuguuuugauuuuguuugguuagguuauuguuguuuguuauuaggaaauaacuuuuauagaaguugguccuaugucacuguaugauauugggguauuacagauauuuaccauugcauguuaucuuuguuacucuauuaaauaugcauaaauuauauuugucuuuauaaauuauauguuuaagugauugccagacaauaagacauuuuaagcuaaacuauuuggauuuuuccucaggucuuaaagaaagugcagaagagauggucaaaaacaaauuggaaggaaaggauaaacugaccccuugggaacaauuuuuagagaagaagaaagagaaaaaaagacugaaaaggaaacagaagguaucauugauaauuaugaccaaauguuuguugaauaccaaccauauaucagaugguaccaggugcuuggaauccauuaucucaaaauguaaccacucacugaaguaggccuuguuaucaucccaauuuuaagaaagaggaaagugagaaugcagaaaguuuuuucaucauggccacauaaugguguacaaagccuggucacaguccagagccacuucaacugcugcauucugacauuuuacauuuacaugccaccuacguaaaacacauaguuaauaucuagauauaagcaguaugauucuguucuguguuucugagcaaaagagguacauacagacauuuuuccuugaggauauaugcacauagagguuuuuaacaugagugaaauuaugccauacuuuccaucugucaaccugcauuuucaccuuacaguauuaucuuauggcucaucugucaccuuauugucauuaaauuccuuuaucaagaguauuuccuggcugggugugguggcuuaugccuguaauccgugcacuuugggaggccaaggcagguggaucaccugaggucaggaauucaagaccagcuuggccaacauggcgaaacccugccucuacuaaaaaugcaaaaauuagguggaugugguggcgcgcaccuguaaucccagcuacuugggaggcugaauuaggagaaucgcuugaacccaggaggcagagguacagugagucaagaucgugccacugcacuccagccugggcgacagggcaagacucugucucaauaaauaaauaaauaaauaaauaaauaaauaaauaaauaagaguauuuccucuguguuaaugugguuucuguggacaauaugauuugacucauguuguucagggaauagcaucuuuuccagaguuuuccagaguccucaguaauaguacagaucacuuagguuuuugccacuaaaagugcucuugugacugaaaugcagcauucuggaaguggugugccuuagagcguuauuacugauaaugacaaaauuuugcagcuuggggaaucuuaaaauuauuaauucuaguccagcccuguuuuauaguuguaaaaaaaauuagcugauuagucugagguuacauagcauaccaguggccaagcugagaccagaauccacaguuacucagaccaguguucuuucuucuguuccccacuauacuguuucuauacuguguguucuuauaaugcuuuugguauagcuuugacuuuuagugcugugacggguagagagaugcaaagcugaaugaugcaguggaguaauuuuuauacuucuauuguagucaguguuuguggaaauggauaguaaaauggagaaauuggguguuuugggaaaaacucuuucugacuuuguuuuuccucugcugucacacuacaacuaucaacacagaagaagacuucugugaccaaauggguagggaguuuucuccacacacuaaccaguggacaccggcugggugaccuccaauuccaacacuaccuggagauagugucagaucccauagauugggggcucgguccccaagacugccuccacccuuucagacaccagucugaagucuggacauccagaacuucugauugacuggcuucaaguugggguucccacgacccccucuuuagguucaauuaauuugcuggaguggccacagaccuuagggaaacauuuacacacauuugcugguuuaucauaaaggauauuacaaaggauacagaggaaauaggguaagguaugggggaagggcuguggagcuuccaugccucccugggcgcuccacccuccaggaaccuccauguguccagcuauccagaagcucugugaacucguuucucggguuuuuauggaagcuucaugaugccagcauuccuuccccacaacuacagggcaggacccucucuggggaaggucuuaagaugcacaauuagaaaggugagggaagaguacaguccugcccuuaagaccgaacacaaaagacuauagcaagggcuaaggaacuuaugagccagaaaccauguaugaaaauaauauauauguaacaccacgugggguaagagcccugcucccauugaugugcuaacuaacucucuucuucccuagaacuccuuuucaaacucaguaggcaguaaaauaucuuuuuuuuuuuuuuuuuuuuuuugagaccgagucucgcucugucgcccaggcuggaguccaguggccugaucucggcucacugcaagcuccaccucccggguucacaccauucuccugccucagccucccgaguagcugggacuacaggcgcccgccaccacacccggcuaauuuuguuguauuuuuaguagaggcgggguuucaccauguuagccaggauagucucaaucuccugaccucaugauccucccgccucggccucccaaagugaguaaaauaucuuauaaaugaaauaacuccacaaguguuaagcuaucaguuuauuggagaugucucaagugggcccucauggggucaauaaaguagucauucugagaauuguagcagcuauucaguuugauuuucauuugcugggagcuucgaguuugugcuuuuacuuuuuccauucauuugggcuaagucuggacucguuggucagcagcauucaaaauacauuguugaguguccaggguguucuagacccuacaguacucaguaccggccuugacuccaacagauccuuuccaacuccacagguucuuuguauauagaagaguuucaagaauuuucuucaaguuaaaaauauuuuugcccauuuguuccucagugguuucaauuuugauacugaaaaauuauuacugaagaaaugaauaccugauauaugccguguuaucuaguauuuugaucuagcuguuguugagaucuauaaagcaguuaaagaaauguguugaguagguacauagcaaauauucuuuguuaaaaguauguuacugcugaauccauaaaauaguuugguaaaaaaaaaaaaaaauucuuagaagcgcuuguucuggcugggugcgguggcucaugcuuguaaacccaguacuuugggaggccgaggcgggcggaucacaaggucaggagaucaagaccauccuggcuaacacagugaaaccccgucucuacugaaaauacaaaaaaauuagcugggcgugguggcgggcaccuguggucccagcuacuugggaggcugagacaggagaauggcaugaauccgggagguggagcgugcagugagccgagaucgugccauugcacuccagccugggcaacagagugagacuccgucucaaaaaaaaaaaaaaaagcacuuguucuuggccaggcguguugguucacgccuguaaucccagcacuuugggaggcugaggcaggcggaucaccuaaaguuaggaguucaagaccagccugcccaacauggugaaaccccaucucuacuaaaaauacaaaaaauuagccaggugugguggcaggcgccuguaaucccagcuacuugggaggcugagguaggcgaaucgcuugaaccugggagucagagguugcagugaacugaggucacgccacugcaagccagccugggcaacaagagcaaaacucuugucucaaaaaaaaaagccagaagcacuuguucuuaaaaggacauuaaugucaaaauaaauauucuuuagggcuuuagugauucuuuuugcaugcaggauguuuaacaauaauggcauucuaaauauuuuuguuuaaaugacuugagauguuuuagauugcuagagauaaauucagucugguuagccugaucuuaguucacauguguucuauuuauuguauagauuugauugcuuuauuuaaauuugcuaauuuaguaaaaagucuguucaaauuagauuaggaaaaauuuaaccaacagacuuacuuaaaaauagccugacaguuuuuagggguggcuuauagauaaaacaagauaauuguuaaaauugggcgaugagaacagaggguucauuacauuguccuacuuuuguguauguuuuagauuuucauaauaaaaauucuuuucuuuaaccaacaaauaaauuguuguaacuaauaauuuaagagauaauucacagugcacuacuucaaguaauucagucacuaucauuuuucaguuuuaugagagaaaaugccaccucccaucacugaucacccaucuaaaaguauucuucuccuucagaucuucuccuucaaaugucugcaucacuuugucccuccuaacccuuccuaucuugaauuauuuuuauuuauguauuugucuauuuauguguuuaugugucugauuuccuuuaauagaugguaaaauuuuugagggcagaaaccauguaucugauaacuuccauuucucccaaaaggccuacaugguuuccugcauuuauuaaguauucuauauuuuuuguuuguuuguuuguuuugagacggagucucgcucugucgccagacuggagugcaguugcgccaucuuggcucacugcaaccuccgucuccuggguucaagcgauucuccugccucgccugccaaguagcugggauuagaggugcccaccaccaugccuggcuaacuuuuguauuuuuaguagagaugggguuucacccuguuggccaggcuggucucaaacuccugaucucaagugaucugcucaccucagcuucucaaagugcugggauuacagacaugagucacugcacccagccucuauaauuauuuguugaacaaacagaauaacuuaggugggaguuguuuuauaaacugguccauuuaaaaacugguuuacuuuuuuuuucuuuuaauuauuuuuuuuuuugagauggagucucgcucuguugcucaggcuggagugcaguggcacgaucucggcucaccacaaccucuuccuccuggguucaagugauucuccugccucagccucacgaggagcugggacuacaggcaugcaccaccaugcccagcgaauuuuuuuguauuuuuagaagaaaugggguuucacuguguuggccaggcuggucucaaacuccugaccucgugauccacccgccuuggccucccaaagugcucagauuacaggcgugagccaccacgcuuggccacugauuuacuuuuagauugaacuacuugguuuaaaagaaaugcauaguuuuucuugguauacauuuauuauaauucuuguaauaaugaaauuuuguauuuuuauauucaacuuuuaaggcucuugcugaagaggccagugaagaggaacuucccucugauguugauuugaaugacccauacuuugcugaagaaguuaaacaaauagguaagccagcucauaucuguaguuuucaacuggaaucuaaagaaaaaggugagguacauggaagcaauauaaacuaaucauucuuuuaaaauugcuaguauuuguguagcucccuuagugacauaagcaagucuguccuguggcauacagucauuaaucugauugggaagggucaacuugucccuucuacauacaagggauaauuuuaauauaggagacuuuugauaaugugguuaauaguuuacuggggauuccuuucugggaaauauccuuagugccagucagaucgacucuauaaaagaaugagaggaaauagaaagaggaauaaauauuuucuuguguacuuucacugauuuuuaauagcguauccauucuaggucccucucagcaaagucuaucaagaauuaaaaguaugaaacaaauuuguuuuuaugugcauguugauauguguauaauuuuuuuaaauuuaugcaugaaauuucauauaaaagcuuuuucugcugaaacauacaaaagcaucuauguuucauuuuaucccuuuuguacucauuaugcuuaauuauagcuagaaagccagcuuuccuuacuccucuuuuuccuugaaucccuaaauuaucugguaucugauuuccuauauccagggagccuuguuuccaccucauaugcacuacucauucuuucuuuccuccauuauguggaggaaaugcguauguguaaauguguuugguaagguucaggccauacuugguaagucaguacagaaaucacuguaaggauuuaccauuuguucucaugcauuuugccuuccccgaucauuauaccacacacaagaaccccaaaaggcuugcuccuggagcaacuccacgcuggcauuguaaagagaaggaguuuaugaaguuucccuguuuuuuucccuugugacuagugggccagaauaguucucaacaggaaagucagaauugcucaaaauuacuuccugauuguuacagcuuuuuaguacugacauuuuauugaugagaaggagauuaagauaaauaaagucuauuauagaaugugagauucuugggaauuggacagagaaguggaaacuuagcauauucugcuuuuuaucauaccugaguggucauuucuagaagaugauggauuuuagccuuauccucugguuucaggaaaccaacuuuauaauggagaaaugcuaagcauuauaguuuccuuguucucuauccaaaauguuuccuuuggcaugugaagucuggucaaauugcagaacucagaauaggauucaaagaauaaguuaaaugguuugauggcuugggguagccaguuuuuuggaaucaacacauuuaaauugagaguaagcuuucuguaaaguuauuaucagaaguuccaaagaaaaaagguauagauaaaauuugcuugcuuauaauuuacuuuugauuucagaguguucccagaggguaauuguuucuaucugggcuuuucuguuuuuguguguguguuuugcaguggguuuuguuuuguuuuguuuuguuuuguuuuguuuugaaaaagcaaaacagcaaggccagaauuuuuuacauaaaauuuaggacaaaaagcuagugucuugccauguuuguuuauucauucuguaauaacuguuuugauugccuaccaggugcugagcucucugcuaggcuagagauacaguagugauaauacaaacaggauugcaucccucauggagucugguuuaaagaaagacauguuagacagauaaauaguaugaggguaugguaaauguuuucaaggaaagaaauagaagauauaacuggauagaaguaggagauaugggaguuuacauuggguaggcaaagaaggcuucucugagaugauggcauuagagcugagaccuguggaaugaggagucaggcaugaagagcugggggaagagcauugcaaaugaggggagaguggguagaaagacuccaaggugagaaugcacugugugguguuaagaauugaaagacaucaguguggcuggagcauugucggagagggaauugguaugaggacaggcuggagacucaguggaaacuaccccuguagggcuuuguuguccugacaacaaauuuagauuuuacuuuacugauaguggaaagcccaaacagucuuuaagcaaagaugagacauaaucugguauagauuaacauauuacucuggugccugugaagagaacaguuugaggacuggugagggcuggaagaccagacuuuugccgagcucuagaccaaagauaaugguuguuuaccuggcaugccgcucguggaauuggauggagaagagaauggaacucuagauauacuuuggaaguauacuugcuaaaucaggaagaaauuuagcauaacuucuguuuuugguuugagucuauggaagaauguucuuccauuuacugaggaagaaauguggaaacaauaaguuugagugggaagcaaaguaaauacguccauuugugguauaaucacuuugagaugucaauuagauauacaaauggagguguuugguugauauugagauauaagucugagagaugagcagagaaaucagaguacaaauauagaguuaaggaucaguagcauguaaauaguacuucaaaccauggcagugcgaguagagagcagugauaagagaagaggaugcaggaugggcccuaaggucaggugaaguccacaugaggcacuguuaaucugucauacuggaggaagugcuaccugaaaggaugggaaaagcuuaagaagcugagaagcggcggcugggaaauaggaggaacaguauuaauguaguggcucacagacacuuggugaggugguagagguuucaguagauuaguguggguuaaaguuugaggugaaagguaaggaaguagagaccaagaauguagaucuuuuuucagaaguuucacugugaaggggagcaaagacguggagcaguaccugaauguagguaaggagaagguauuuuuuuaaagauaugagcuuuuagggcauguuuucuuucccuugggauuguuccaacagaaaagaaguuacuaagauacagaaaaugggggaaauaaaaguaaauacaaaugcagauaaauuuguauauuugguggcagaaggaugagggauuuaccugauugguuuauggauuuauacuguuuguucauucacuugcagaagcacagauaaucugcaugagcagauaggguagggacguagaaacaggucacuggagggggcagggugcaggagguuacugccuaaggcgguugauucaauuaauugucaauuuuaaggagaguguucaggucuggauggcugaaaauggagaaagauggggcguauaaauuugaaggccaggccagauacaaaaccauagaacauguggcaagagcagcgguaugggaggccuaggcagagaaagagagaaccagcugagccacaaaaggagcaugucccuuuuaaaucaugcuggacauggcuuuucaaaggcacauuacaaagcugugugcccccauucauguacgugguuauucagucaacaauuauugagugucagaaucacccaguccucccauaugacuuucagcauguuacaaaauauuuaaauauaugagaaugauacaguuuucccauacuuuacauuuuaaucugacuuccuaugguauaacuggacuuuuaaaauauguguuagauauauaucauguauaugcucaaauagauggauuuaaugagaaguuuuuacucaauucugaaccuuuuccuccccagcaaaaacuaaauuugugcuuaacaguauccagaagacauaaggaagaauauauugaauguuaacauuuuguacucaugauccaggaggaugguuuuaaggauagguggaagcaugcuuauaaccucagggaaauggauucccauagggagucaggaagaaguuggaaguuuuuugugugccuuccagauauaaggaucuguaguagguacucuuaaagagaguuggacuuugguucaaaauuuaccaguuuguaauuuuuauuuuauuuuuauuuuauuuauuuauuuuuuugagacggagucucacugugucgcccaggcuggagugcaguggcguaguaucugcucaccacagccucugccuccuggguucaagcgauucuccugccucagccucccaaguagcugggacuacaggugugugccacugugcccagcuaauuuuuguauuuuuaguagagacaggguuucaccauguuggccaggcuggucuugaacuccugacuucaggugauccgcgcgccucggccucccagaagugcugggauuacaggcgugagccaccacacccagccaguuuguaauuuuuaaaauguagaaauaaaauaacucagaugaccuacauugguauauuaauuuauuacuacaguguugccuucauuauuaguuugucaaaauaauuuuagauuuuaguaccugguggaaguaaaauauagucauuaucuaaggauauagaccuugcuuuucaaaaauauuuaagauauaaugaauuuggcacacuaguguuuucaguguacaguucaaguucuguaguuaaacaggacaaaaacauuguaaaccagaugacuuggguacauuuauaacauuuuugcucuaggcaaucccauagagcuaaacuuaugugccuucaaaauguggaggaaaugaguucauugaugccagaccuggcguuuggcucagauuaggugccagggugaauguuagagaucuuuuauaauuuuuucuucuaucuuuuauaauuuuuucuuugauuuccuucuaaauugcaaacuuggugucaaaugagaguuuuaaaaauaucaucuaggaugagcacauuaaugagcugaaaaugaaaugaaauauuagaaaaaucugcuaauuuuccagugguagcugguagaaucugaguccuagugggcuucccuuuauuuuuuguaauuuuacaacauuguaaagcagcaccagaaugugguagccuagagggagauuaacccuagagggagauuauccuuaacagacugcaucugauuaugggcaagugaugcaggaacuugguacaaaagaguaaaucacuagggcgcuuaccacucccaucuggucaguacugagaccacauccaucugcccuccagugaacuuucuuagcuucucucauaugaauugcucaacuaaacccucuggaggaaguuuauuaugggaacaagucucugacauuauaaguaaugggaaaugaaauuuccuuuacagaugaauuuuauuuuuacacacuaucuuuuuccauggauguauucuguuacauuuuuugccuaaaaggauucuagccucaguaaggauugguuagauuuauuuaacuguaaaacucuaauaucugacucggagucucuguuaguauugacuuaauagaaucaauccauauguauuuuuugcagcagucccaggagauguaguuucuuuuuuuuuucuucuuuuuuugacagcauuuugcucugucacucaggguggagugcacaguggugcuauuauggcucacugcagccucgaacucuccuggguucaagugauccucuugccccagccucccaaguagcugggacugcaggcauacaccaccaugccuggcuaauuuaaaaaaaaaaaauguggagcuggggucuugcuuuguugcucaggcuggucucaaacuccuggcuucaagcaaucuuccuccuucagccuuccaaagugcugggauuauaggugugagcuaccacacccagcuagagaugugguuccuuacuugacaaaagauugacugaaaaauaaagacaauauuuuagaacacaaacuuucauuucccuaguacuguucaucuaacuuaagucugaaauuuuuccagggaggaaaaaauguuuuuuaaaaaaauauagaugugaucucuuaauauuugaucuuauuaacagugcagaaaucaucuguaugcauuguuuaucuuuucacuaaacaauucagucuaacaucauaguaaauucuuuguuagcaaagaaauuuucuucaugcuaaaaccggauaucauguuuagcccuaucuuggggauuuuuuuuucuuucucccuuauuacaguccuccuuucaaguuuauuuuuaagacucuucaccagguuguuauaaaaucugaaauaguuuauugugggcuuuuugaaauuauuuuccacagcuguaugugaagaucuuuaucugcuuuaaauauuaauuauauacagucuaauuuucucccugcuacagaauaauauuuugcauaugucauuuguccauucauuucaaaaggagcucuuggcuugagagcauaggagcagugguaaauuuagggaaugggggguucauacccuaagcaaguggaaccuugaugauauuuauauguguaaggacauacacauacauuaagacagagaaagauuauacucuuaagauucguauauuauucccugaaaaaaauuucagauaggaccagugaugaggagcauuuucucuagggagaagggcugcauacaauaaauauuucuucuuggaagugcaaaacaaauggcuugguagcacugauaggcaagccuggcagcacuuuuaugcuggcauguucucuuggcugggcaugucuacuggacaggugugcaagaguauucgcagggacuuaauacacacagaggaguuucuaaagccucuuuugacuuuagguuuugcuuaucauguuaccccauuagcugcaauucuucaaccaucuugaccauucccuucuccugccacacccuucuucagguguucucacauaucaccucccucgcuucauccaggucauuguuugugugucaccuucuugaagaggccuuccuuaacuacccuaacaaaaccagcccccucauucagucuccaacccuucuguccugcuuugccucugucuuucccaacgugaagguauacuacaugagagacgauuuuaaccucuuguucacggcuugugucaccagcaccuggagcugugaucgcaacauaauaagugcucaguuaacauuugugagauaggcgaaauaauuuccuucuguuuauugaccauuugguuuugucugugaauucucuuugcucuguguuaauauuuucauuuacaugaaaucuuuauaagugaaagauauuaguauuauaauagaagcagucauuucuuuucuuuuuuuuuaucgagacagagucucgcucuguugcccaggcuggagugcaguggcacaaucucugcucacugcaaccucugccucccagauucaagcaauucucccgccucagccucccuaguagcugggacuacaggugcuggccaccacgcuuggcuaauuuuuuuguauuauuaauagagacagaguuucaccauguuggccaugcuggucucaaacuccugaccucaggugauccacccaccucggccucccgaagugcugggauuacaggugugagccacugcgcccagccguuucuuguuuuuaauuaugaaaauuuauacauugagaaaaauugagagaauaauacagugaacagcaccuguguuuggcaguuguuaacauuuugccauuuuacuuuuguaugcauauacuuuuaugguauaucauaaaaauguauuuauacaagauguuacuauauaauagacauauuuaauaguagucuuuuuaguucacuauagucuagaagauaccauauacacuucccccucccauaacauuugccuuucaagaacccaggcuagugaucuuuuggaaugucuuauauucuagauguaucuguuccuugccacucgguccacuauauuuuccauaaacuggaaguuagacgagugguuccauuagauucauguugaaugguuuuggcaagcauacuucauaggcaaugcuuaucuuucauauuauaucacaucuaggggcauaggauuucauauuguuccaaagaugacuugcugagggugguacagugcccagcgggggauuuucuuaggcucucuagguggucaaacaaaaggcuugagugggucacacuuggcucucauggguaguuagcccaggaaacacagcagggcaguauuggguguuucucuucaucgagucuucacggcaguucacucagcaguacagcuuggguacaaggaaaggagacacaguguacaguagucacccugggcgagaagucucauguuccaaauaggaacugagagcuuuuuaacagcaccuagacauagcuuccagaucccuguuuuaccaguuacaggagucacgguaucaaggaagcccaaaguuauaagcauuuagagaccccaauacauguuauuuuccagucaggaaccacuuuaccuggugguauugccugguaauagagcuagaaaguucacuaaagaucagauuugucuucagagaaggagaaagcguuuuuuaaaacuuauauuuacagguagugacugucaaauuauuauuauaaagauaaguuuuuucauuuugcagaugagaguuugauauauaguguugaguuuauauauucaaaucacuuggggguuuuuucuuugucucuuccaguauucuuaugcuaagaaaauauuucuucuauuuaagauacaguagcuguucccuuguauuuucucauagggguucuuuguuuuauuuuguuugauauuuaacucuuaaauucaccugcguuuuauuuucuuauguauuaugagauaaggcuuuaauuugaucuuuuuuuccagaaugaaacaaauugcucaacagcaguuauuaaacaaucuuuucuguuucuaaugaugaugcuauauuuuauuauauacuguuucaucauuuuuauuguguaggaauuuuuugguuauuuucacuuuucaguacacguuaauacacuaugucacuaguacauggaaucuauguaaucuuucuaaagauuuccuugaauggaauuuuuuauuuagaauuucauuaaauguguauacuacuuuuauuaugaauggauguugaauguuaaucaguauucuuauguuuauggacaugcuuauucuguaucuguggaaaugaucuaugguuuuucuuuuuuaauugguaauguaaauuauacauuacuuugaaagaaauucuuccuuuguaacaugcagucacuccaugcagaagcauuguauuuauuccauucauauacccacagucuucuuucaguaacguguuuuuuucuuuuaguuucaacacauuuauuguuaagauuauuccuagauaucuuauauuuuuguuccuaguauaaacagaauguugcugauaguccuguaauuuuuaccacucuuauguugguuuguugugccagguauaaauaaaaaaucgguaaaaucugcaaaagauggcacaucuccagaagaagaaauugaaauagaaagacaaaagguaaaauacgauuauuguuacaugcuuaguggauaauucauagguacaauuuaaaugaaguuguacaugucacuaauuuuaaaaaacaacuuauuuuagcaguggcauuuauaacuaaauuguaagagacauaauuaaauauuuuagcaguguaguuucuaaauacaguguuuuuuuuaccaaacauaauuucuccaaauuguacaaaguuaaaauuaaccucaaauucaaggguauuuauuuucuuuuauaaauuaagagggaauuaucucacuuuuaaaaacacuuacuauaccugaggcagaaaauacccuuaaaaccucaaaauaauauugccauaaguuuuaauucaaucugaaucuguccuggaauacaguuugugguuaugguuugucaaaugcaaauuucuguuuuucuuauugugaauauguauauuuaacguacaaaauuacauucuuggaaaugcagugaaccuuaugcuucagugacccccuauguccagagucacacguaauuuuggcacagagucauaugugauuuugcugaggcaggaauugaaggcagcagugccccuagggcugauguucaugucacuguccagaagugugccugacuggccacauaaaguuaucuaaagagcaacaaagaaaaucaauuuuuauggaaaaugucucugaaaagccagcuaaaagugccagugacaaaaggaaauuaaggcagucuaaagugguaauauaggaagauccacaaaggucgagagcauacucuguauuuuuacuaguguacaugguuauuuacuugauucuugaggguucucguuuaaucccauggcugguagaaaauacccguuuaguguaaaaagacauuuacuagauuucagaagcagauccuaagguccuaccuucauagaaauguaucaguauugaaacaguaaaggccaaaaaaaaaaaagcaaaaaaaaaacuuacuuguuaaaaguuacacauuuagaaaguauaauuugcaucacaaaauaaacauuugcuagauuuagcaucauugcgcaaaaagaacaaagugaaaaugagaacuuuuuauuugaggguaguuggggacucuuguuccugcagccuacuaaugagucacacuaagugaaauggggccugguuuuuaacuacaagguuuuaccucuccugcucucaguaauguugcuuccagagauucuaccuuauugcuauacaaagaucucuuuguuuugguaauccacagucaguuuacagacaacaggugguaccccagaguucuagugauugagucuuccuuucuagaagagauaucuucugcccuauacuccuuuuuggggguggaaaaaaaagcacuguuguacauuugaacuuuuuuuugcucucuacaggcugaaauggcuuugcuuaugauggaugaggacgaggacaguaagaaacacuucaauuacaacaagauuguggagcaccagaaucugagcaaaaagaagaaaaagcagcucaugaaaaagaaggaauuaauagaggaugacuuugagguaaccauagacaccaggcauagccucuuaaagcuggaauugaaucuaaagucagcucugcagauagaaauugagcauagucaaaguuacccuugaaaaugucuuaggggcccggugcaguggcucacgccuauaaucccaacacuuuuuuggaggccgaggcaugaggaucacuugaguccaggaguuggagaccagccugggcaacauagugggacccucaucucuaugaaaaauaaaaaaaauuagcuggcugggcgugguggcucaugccuguaaucucagcacuuugggaggcugaugugggcagaucacgaggucaggaggucaagaccauccuggcuaacacggugaaaccccaucucuacuaaaaauacaaaaaauuagccaggcgugguggcgggcaccuguagucacagcuacucaggaggcugaggcaggagaauggcgugaacccaggaggcggagcuugcagugagccgagaucucgccacugcacuccagcccaggugacagagcaagacucugucuaaaaaaaaaaaaaaaaaaaaaaaaaaaaaaaauccagguauaguggcgcacaccuguagucccagcuacucaggaggcugaggugggaggaucgcuugaguccaggaggucaagccugcagugagccaugauuguggcacugcacuccagccugggcaacagaacaagacccugucucaaaaaaaaaaaaaaaagaaaaaaaaagaaaaugucuucagaaagacugaugguggagccaaaggcuacugucuuuuaauccagcacagccaguucauccuaggguggaugaaaucauuguuucuuugguugagcaccaggugaaauaguugacuuguauuuugguagccauauuguaccaaaaauguguaguuuuuaauguuagaaucacauguagugauccucagaccagcaaagguaugcuugaauagcagguucaugucacagugggucacacucacugugugcaguggccagcgcaguaagccauguuuuuucaguugcuguguuuuuuguuuccauuacuccuuccucuuuuuguugaguacauauuccuaauggcugcagaguccccuaagcaugaguuugagccgucuaccaaaaaucuacaaacagcuguuagaaacugcuuaaugacuuccaaccauuaauguggaagaacugacccugaguaagaugggggaaauuugggaaauuuuaaauuuguucaaacaauggaggguagcauacagauggcuucuaaguagcauauagaaggauuugggggcuacucuguagcuucuguuguuugagucaguuucacauaugcucccauuccaguuagguuuuuauugaguuacuuuccuuaugaaaagcaaagaaugauuuguagucauucugccuucauauauuaauauaugcauaaaaguauuuuuuacaggauuuuuuuccuuguucuggguaucaaaucccuuggccucgugauaacuaaguaaagcuacaaucuaucuccagguggacuuguauuucguguguuucccuuucugcugguuacccaucugccuggcagcccucaaaggcuggcugcaguuaaggguauauucuuaaacauggaaccacaaguuuuuauagaaagaagauaaaucuggggcuugugucugaccagaccuugaucucagauggauuauuugccauaguggucuuuaaaucuuuugauccauggaucaccuucaauaguuccuuauuuuggcaccaagauuaaaauuucuuaacauguacucagaguucagggccuccagcagauguucugauuggcuuauuuaugcugguaagaaauugauuuugugcuguaagcaugggaaagcccugccucacaaaccacugcuacagucauuuugucuaaguggucguuguaguuaccggccauaauauguauauguauggcccacuauaauucccuuugaaauacauuguccuugcaugauaagaacagggugccccacaaguugugguccaaagguaggccauaaagagcuauggaaaaacaguuuccuaaugaaucaguacaaacacucagguuuguauuuuauauaaucaacucaccaacuuucgaaauuuggccccauuucuggccuuuugcuuuaguaauuuuguuuaauuaauuuauuaauuuuuuuuuuuuuuggauuugcagguaaauguuaacgaugcacgguuucaggcaauguacacuucccacuuguucaauuuggaccccucagaucccaauuucaagaaaacaaaagcuauggaaaaaauccuugaggagaaggcccggcaaagagaacggaaagaacaagaacuuacucaggcaauaaagaaaaaagagagugagauugaaaaggaaucacaaaggaaguccauugauccugcuuugucaauguugauuaaaucuauaaaaaccaaaacagagcaguuucaagcaagaaaaaagcaaaaagucaaauaacuggauguuacuuauuuuugaacugaauacaucuuuuccuaaaauguacaaaaauaauaggagggaauauuuauugggaacaaagcuaucuuucaagaacaugaauaaaaucuuuuucuggacauaguaaaauuuuucuccauaaauaauuguacuuaauuguggaugacugacaaauuuuuauuguauauuccuacagaucagucauaauuaaauuaccugcauuauaggguuuauaaaauuuuuauauuuuacaauguucaguucuaacuaguggaaaguuacucuagcuuuuuaaaaggcuguuuacaauucuguguaaaaauagagcaguaucuacucaaguuuguguaaauguuagggauaauuugaaaaauauauauauuuaauacauuaauuucucuggaagcaggaggcauguuuaaauaacuauuaaaauaauuuauuuuucuagccauaaaggauggaagucaagaacuuuuuguuguuuagucauguuaaguauaguuuaugaaauuaacuuguaaauaaaaguguaaaauauuuucauua

SEQ ID NO: 191247 - RNA, 120635 nt, Homo sapiens
ggcgucuugccccgccuccugcaggcggcccggcgcgguguuuacccgcggugcaugguggggcggucuccuucggcaaccccggccgaacggccacccagaggcugugcugagcuggcgcagcggcagcagcaugagccggacccucgcaucggccgugccccugucgagucccgacuacuacgagaggcugggccaacuccagcacgggcugcgggacagguaagggcacuggggcggggguggggagucggcccgcgccgggggucuuccgcgugcccugccccauuuuccuucccgcucccccguccgagguuccccggggcccaggcccgcgcgcaacgccccccaggcucccaguggggccuggaggacaguguuuacuagagccacccccuguauugggggugggagcggagagaggugagagaccgcccccgccccgucaauagcagcuaaagccuggucuacgguuugaggaugcggccgcgucacagaauuugcccagaagugaaggugggaguucuucugccugucacucuccaucaagccuugugaguuucucuuguccccuuuuacacgcccccuccccacucucuucaaauugccaucccgccgugacagcugcacugcaucaaugaugacaaguccuggaacgcagacgguugugugugugugugucaaacaugugcccccguuuaaacucaggagacuuuuagggguagcgagggcuggcuagauuuccagcgaagggaugaaauuuccagcuagagaaguccagcuuccagaggguucaugaugccuuugauuaagauaugaaagaugggaaccacugaaaacagcuagaucuaagagugcauauagagagaaaauuauaccgcaauguacuaugaauaaccacguaaaagauaaauugcuggaccucuuauuuagcugcuaaguuaauuggaguuguaacucucauuaguugacaagaaaggaaauacauuuuuggaucucuugauaaacaaaacauuuaaugaguguuaaaaguuacaaaaucauucuagugaacaggagagcugugugcgugacagugcuaaaaugauaacaauaauuacauggaaaauaaaggcagaagugagcgauuuugaaaaggaauuacauuuaucuuacgcuagauuuaauucuugucagauauuuauagagcaucuacaacaggcuuccuuaauugucguuagcauuuuuuuuaccuuguacuccuuuucuacguccuauuuucuuucugacaugucaccgcucacccauaucagugaccucuuaauuucugacuuuaaaaagaaaucucuuccuguagagccuucccuguuucaacccauucccuaacuuuugugacucuuggcauucuuacagcacucauaaauggcauucuuuuugaacuauuaauuguaaguuauuuuuguuuccugugcuaggaacaccuggcuguuuauaguccuuauggcacaauaacuguauaauaauuauguacuuuaugauuaacacuuauuuaauuauuaaacaaggugaggcuguugaaaauauauaaggaaugugaaucaaauuuuauagccuguucacgguucugcauuucgagauuuguuuuauuuuuaagucaguacaaaucuguugcuguguguguucauuuuucauuuuaagaauuuauaacuaacucaaauuaaugcacacuggacacaguuauagaggcaaauaauucuagauacagaaaaggcugcaguagaaauaucaaaaccuggauucuaguccacgaacaauugugugaccuugagcagguuguuccaccucucugaaccuugguucuuuaccaggaaugagggggcuugacuaauaugcaaaguaaggccacagauuuuuuucuuucucucuuugcuagaauaaugggccuuaaaguaaaaaaagaaaaaaaagcugaaagcuguaguuuugcaaagcaauguguaaagaauauuauugucuguauccaauuugaguguuuggauguaccuuuuuguuuguuuguuuauuuguuugaaacauagucucacucugucacccaggcuggagugcaauggcaugaucucagcucacugcaacccccaccucccagguucaagcgauuguccugccucagccucccuaguagcugggauuacaggcgcccaccaccaaccccagcuaauuuuuguauuuuuaguggagaugggguuucaccauguuggccaggcugaucucgaaccccugaccucaggugaucugccugccucugccuuccaaaguguugggauuacaggugugagccacugcacccggccuugguuguaccuuuuuaaacaaagaaacacaaagcaucccacugaucacagauaccacugucuccuaaaauuccugagucauuucauagggagcaacccuggguagucacagcugcuuuaucaauccagaaacuucugggaagugggagacaaaaaaaaacucccucuuucucagcccuuuuagagguggucauugcaauguuagcuggucaaauaaccagcauauuuccagcccaagucauguuagcuguaguuacacguagauguaauuuuaucgucugaauguuuuccuauguguguacaguguuuuuucugcauuguggugaaagucaauaauugaaucuaaaagagucuaauggagugacuuguuacaguguguauagcacccacaagcaugguagaaacuuauaaguggaauuggcucuuacgguuauacaaaaacauccuuuuaaaagggcccauuagccagccgcgguuuuuucagugccuauauugauucagaguaagauaucauaauagucuagaaacugacacugagauauuaguagaguaagcugaagaugguauagaauugugguaucgagacaaaaacagaauaacaaguggcuuaaaaguagaaaacucagcaagauaaggaccacuuagcuguguaaaacugaaagguccaagugaggggugacugaaaacaugaacuauggguaagcaucccagggauggguauuucaaagauucugaauagagauuuaauauguaagaauugcaagccauggaaaggcuuuucauugaggcaaauaucugguuuuuaguauuaaauuuuaaaaagacauggagggcucagcauucugaggugcugcaguguggaugaggggcuagaaaauaggccugugaagaagaguuaacaagauuaccaccguuuugccugggagagaaagccaagaggaguuugauuaucaggguaugaaguguuaugauagagaagugugagcagcagaugucugcaucugcugaagauguuuuacaaauaaauuuuacauucauuacuaagaagaacuugcugcuugggaggugguggauuuccaaagugacugugguccuuuuucacuagaagucauaggugaauuuuagaaauuauuuuaaaguggcugggcgugguggcucacaccuauaaucccggcacuuugagaggcagaggcggguggaucaccugaggugaggaguuugagaccagccuggccaacauggcaaaaccccgucucuacuaaaaauacaaaaauuaauugggugugguggcgcaugccuguaauccuagcuacuugggaaacugaaacagaaucccuuaaacccaggagggagagguugcagugagcugagauugugccauuguacuccagcuugggcaacagagugagacuccaucucaaaaaaaaaaaauguguguauauauauauauauuuuuuaaaguaaauucuagcuuacaaaaaaguugcgaauauaggacaaagaccuccaguguuccugucacccagaucccucaacuauuaacauuuuauuagauuuuugacacugagauaucaguuggguaucuauuuaaaucugucuaucuaaaaccauuagccuuuucugaucuguuugagaagugcauauaugaugccucaucacuccuaaaaucuucaauguguguuuccaaaagccaaggauguucuuguacaugaucacaccauacagcccuccuaguggugaaaccaguccgcagacugcaucagauuucaccagcuaucuuaacgaugcucccuuuuuuuucccccugguccaguggcucaccugcaaaccgcgguugcauuuggcuggcaugucucuucagucucccuacaucuggaacgauuccucagucuuucccugucuuucauguuccugacaaguucauagaguacagcuuucauucuagagggugacccucaagcugagucuaucugauggugucucauuaccagacugcagucgugcuuucuuaggaauacaacagaaaugaagcacuaccucagggcauggggucauagauguauucagaggucuuccuuucuuuguaauuuaaugacaaguugcucacacuauccagucauucauucugcaugaaccaaguacccaauugaucaugaaacucuagggggggaaugguaacuaauaaaaauuucuaauguggaagcaauuaugcuauguuuccuucacuucuauucuaaguucacucuuacuagugagaagguaaagauuugugaugcuauuaguuaaaaauguguguuuuuguaauuuuuuuccuuuuaaucuuuuuuuuuucuuuuuaacauaggcauacugcaacccauggguuguguuccccaagugaagauucugugucuggauuuuggaccccauauucccauuaaaugaauuuugguuaaauaguaguuuccauuuaacauuaugcaaaggaaagaaaguuauguaaccuguaauguagcuaacagugacuuuugggaugaucuuuuuuuuaaaggaaaagaacuauucugaagauauauagaaacugauaauuaagagcucacaaauggagcauggggccagccccuuucccucaggaagccaaccugagaucaccucuguuggaguccuuaucuuuauuucacagccuuuuguuuaggauucuuugcuuggauagaauauuaugugguuucuuuuuuggccuuuacuuaauguuaacuuagaugagcaauuuagcuucaauuaggugggauugaaacaaauaguggugcucagauggaacccucuguggcuaauccucccaggcacucuucuugggacugaauggcuucaucaguuuuaucccccagcccccugguuuuggcugccucugcuuccucugcugcccaguucccccucguccuugcccaggcugguugugggguaagacagguuuucuccuuagcuuacugcuagcacucaccugaacagcacagguucagucuuuacugguaguagcuccaggaaaacagcaaccugugacaaauaaugacaccauuacagaguuauaaaaagaaaucccuccaaauuugaaaugauggucuuagaaggccuggucuucaucagauguaagugaggccagguuuacuuuucagaggucuuucucuaucucauccacuuggcugugcccaggcuugucugguugaaaacagagcaagccaccagucuucaaucuguacacaagaucugaugggaccccaucaccgaaaugccagcgacucagagaagucuggccacguuacauuuuauauacuuaucuuguuuauuauugucuguccuucucccuagaaugucaacucuuugagggcaggagucuuggcuggcuaguucgccauauuagucuccaggccuagaacagugccugggucaucauaggcacucaggaaauacuugcuaaaugaaggcaccugcuucucagacuuuuccuauugcauuuccccauuuacuuuguggauuuuauucuuuugucuccuauugguguucguuuuguuuuuuagauuucccuggcgacugcugcauacuuuugugccuuuuguuuuagaugcgucuggcauuuucugcuucuuagaccagagaagcauuuucacaaaggugugauuugguauuugggcuuuuuuugaccucuaaucaacaccuugcaacaaagccauuauuucaaagaagagcauggucuaaauccaacucccuguuacuuaucauguaauuacuuauaaaauguuuuuuauuauagugaaaagaagagauuggaccuggaaaagaaacuuuaugaauauaaucagucugauacaugcagguaagagacgacagugggaacaguuuucaagccagguuccauauauuaaucaaaaauguaacccuaauguuaugucauaaauauuguaguuagaguacuggguuuuugguuuuguuuuguuuaguuuuuuugagauggagucuugcucuuucgcucaggcuggagugcaguggugugaucuuggcucauuguaaccucugccucccagguucaagcaauucuccugccuuagccucacaaguagcugggauaccugagauuacagguaugugccaccaugcuggcuaauuuuucuauuuuuaguagagacuggguuucaccaugcuggccaggcuggucucgaacuccugaccucaagugauccccacgcuucugucucccaaaaugcugggauuacagcagugagccacugugcccagccuaguuggaguacucuuaccauucucuuauuuuuaguguguaauaauuugaaauaaacagugcaguuuaauauaauuacuaucaaauuugguuaaaaucgguaugagaucaaaauauguuauuuucauuauuucauauuuguuuuauuucaagaaucuguuuugcuuaaaaaucuuaaaauaagacauagccuuaucuuuuugguugcaauuuaaacacauugagcuugugugaugauuaagacauaauuacuguaguugaucuuucaagguacuacuguaggcaggauuaccugguaucucauuuguucauggauauaugagaaugacuauuaaaauuauaagcagugaauaauauauuguacgcauuauccuuuuuagguuucuuccuccacuauuaagagcagaucuuaaauauuuuaauuucuauuuuauaaaaacugaacuuuauccuuaagccaaaaguauggcauuaccucuuauauuauucauaugaagaacuucuggcuuugauagcauuaaguuuguaauuuauccaugucacacuaugagugagaaaugaaaagaucucauccagaagagagagaggccaagaauccuuuaaagucaaauuaccuauuaggucaguucuuucccuugucuucaaaauuauucuuugguuuuaagauuuaguguacuuccaaagcuuccaguugagguagacagccguaugacucuaguaacucugaaagagacaagaaaucaguuguuuuguguguggaagaaauagccagcauuguggaugcuguggccucaagagugggcccaagucugaggggauccuuggcagcugccauuuuucuagcccauggcuaaagggcagaagauuguguguagacguuucaugcagucuguucuugggaaggcuccuggccuucugguggugggaggggcaagugugagaaaaggaugggcacuuuuaccaagccgucaguucacugagcugcugcuucucucccagccucuuacuguuuccuggaagacagaggauaugauuugcuaaaaauaggcuugcuuagauugccuguagaagaaaauccaaacaaggcugccuccaccuaguaccugccagaaggcagagucugagacgagggucuguguauaagugguaauuuauuugacaagguggucaccuaaaauuggagagcagggcugggcugaccgaaauaagagcuguucacugcagugagcaccuggggcucagucccuccagaccuucagaggagccuucagaggagcaguguagacuacccuucugcuccgcacagugucuaauccugcgaaaggagauggggcuguauuccuaccgguuucugacccccacugguaagggcagccccagguggaguuaacuccuuuacacaucuaggcuuuuccaugcugcaaacucagaacggcagcccugaaaugccaagugcagcugaggcagaggcagaggcagacgcucucagguuauaccacaugcagcaggcuguggcggcuguggcgacuguggcgacuguggaugguagaaaaaaggucgggccaggaggcgugaggugggcacaaagggugucucauccagcagcccaccagacacgccauuaucugcacccuuuuuaauuuacauuaucaccaucucucuccagccucucccuaagauucgacacugacugaaacgucaggcucuuaagcaugacgggauguuuuguaaugugguauaaacuucuaggcucugugguuaggugcuucacuuccaucugagccucaccagcucugagccggugaccuuggggcaauuacuccaacauucggugccuccauuucuucuucugucaaaugggaacaaugacagcugugagaacucacuaagauucauacaaacccuuaaagcagugucugaccuagagccaauuauuauuuauuacaauuuuaucaacauucuuuuuccuauuuuuugccgucgagcuuucugacaugcuguucccccaccuggaauguuuuccccucaucuuuucauuuuuggcuucaucaauuuugauuaacucucauucaucuuucagguuuuuuuuuuuuuuuuuuuuccccaagacagggucuugcucuguugccuaggcuggagugcaguggugugaucucggcucacugcagccucugccucccggguucaagcaauucuccugccucagccuccugaguagcugggauuacggacacauaccaccacacccggcuaauuuuuguauuuuuaguagaggcgguguuucaccauucuggccaggcuggucuggaacuccggaccucaggugauccacccaccucggccucccaaaaugcugggauuacagccaugaacccccaugcccgacccaucuuucaggucuuagcugaaaguuauuuccacugggaaggccucccuggccuuuucagcuaggucagguugcccgguguguagaaguccuuuuuaguuucccucauagcauucaucacguauuuacuuauuucauuguuuucuuuguugaccuuagcugaaagacuuugaucuuuagagugcugaauauauggauaauugcauggguagaugaguuacucacucauguggucagcuuugaagguuaaugugguagcuggaauggaacuagaauuuggauggagaaggcauaguacaauuguacccacuccggguagacaccaccagcagcagcuuuacugagugccugagugugaacgacaguauguuagguucuaccucuguuacaguuacuugcgucaaaaaugcagagacaugggcagcaauaagaccagccuucaguuuuuauucagaaagaaaaaugaagacagccaaccauggucaaagcgcagaauuauuaacacgauaaagacuuucuugaaaauuguuggccuaggauuggaaguuuaagaucuguuguuaaacaacuuuggacaucuccagcaucuuugcaaaucuuuguuuugagggugaauauuuuugucauuuuaaauuuuauuuuuguuugaugaaagaauguugaauaauuuauugagccaacaauugaaaugcuguauaacagggaagaagaguuaggauuaacagcguuggugccaugagaaaagucgacuacacaacuugaacuauccaguauguuuuuuuauguacagaaaaauuggaaugcagaauauguuuuugcuauuauacuuuggauaagagucugaaaguuuuuuucacaguuggaguaauuauaguccauauauuauaaaauauuuuaauagugaauuauauuguagcaauuucuaacaaguauguuuauauuaucuaaaugagagcuuuugguauuuuacauuuuuaaauuucuuuuuaauuucuuaauuuuauggguugugauuuguaguuugauuuaauuccauaugagcaguuauuuuugaaauugucauauguaagaauguuagugagccauucgucgaacauguccacauagacacuacucuugaaaucacauuuaauuuugagaaauaaauccauagaaaucuuuacugugugaauguuagaauguggucuuauauauauuucucaggggaguuaugcuuagaggaaaccgauaugauaccucaguggugcugcauuaacuuucucucuccaaaaauguguauauacauuuuguuguuuggguuucggugguuuggguaaaauaccuuagaauacauugucucauuaacaauuuugaugaagaaaauucccuuucuuagauucguccaagucuaguccauuguuuuaaaacugcuuuuaauuuucuagaguuaagcugaaauauguaaaacuaaagaauuaucugaaggaaauaugugaaucugaaaagaaggcucauacucgaaaccaagaauauuuaaagcgauuugagcguguccaagcucauguuguacacuucaccacaaauacagagaagcuucaaaaacugaaggugacuuccuguuuuuuacuguguuuuauuuuauuuguuguuguguguuuuuuuuuuuuucuucaagaugagaccucacuguguuacccaggcuagacuugaacaccugggcucaagcaguccuccugucuuagccuccugaguagcugggauuacaggugcacaccccauguagcuguguaccucccgaguagcugggauuacagaugcacaccccagguuuauguuuuguuuuuaaucuuuuuuuugcuaaaaugagaaauaaugaguacuaaguuucagaucagugguagucacuaauguuuuguuguucauaauuaggauuaaguaucagcuuuuucugugaauuaccauguggcugaauuuuaucagggaacuugaaacugcauuuuccaagauucuucuuuaguuaaggaaucaaugggauaucucuaacacaggcaagaucacuagccaguaccuggcacgguguaacacaugguauuuguuggcugaaugacugaauuugagcagcauugggguucucucuagaaacugauucugucuugaaaggguucuuuuucuguggucugggccccucuucucuggcaaacagugcauugggagaguaguaaggguagaacuguccccgaggaguuugccuuuaugcuccuggucugugugacccagagugacugcccuugcagcucucucugguucuggcaccuuuuuccccuugaagugcaggugcuuggcugccugcugcugcuuggcuuccugcugcuccacaaauuaugccaaguguggagggccaggagcuaggccuuuauccucaccauuugcacuggucagguguuguccaauguaacccaucuuaacacuggucacaggaggaguuggauucaguauucugccugcuagccugcuacugagccccccuaccuuuuuuuuuuuuuuugcccugcaguuuuucuucagccuuuuauuguaaaauuuucaaauacacagaagaguuagcauaauuauuaugaugaacacucauaauucuccacuuagaugcaguaguuguaaauaucuuguuauauuugcuuuguauguguauuuuuuuuuuucucugagccauugaaagucugcugcaggcaucaugacacuucuuuccuaagcacuugagcguggaucuccuaaaugcagggacagucuccuacauaaucauaccauuaucacgucuaagaagauuaaaaaugauuccacaauuugcuuuuugagacagggccuuaccaugucauccaggcugaagugcaauggcgugaucauggcuuaugguagccucaaccuucugggcucaagcgagccucccuccucagccucaagcugggacuauaggcaugcaccaccaugccuggcuaauuuuuuauuuuuuuguagagaugaggucucacuauguugcccaggcuggucucgaacucccagucucaagaaauuauccuaacuuggccucccagagugcuggaauuauggguuugagccacugcacccagacauaauauuuaauuuucagcucguauucagauuuccccacuucucccaaaaaguaacuuauuuuuccagacuaggagccaacuagggcucauguauuguuuucuauguuauugauuauugugccuuuuuugucucuuuuaaucuaauuuagucuccuaccauuccuccuuuuuuuuccccaugucauuggcuauuuugaaaaaggcaguccaucugcuuguagagugauccgcauucugaaucuaaggcaucauuuaacuugcacagcauccccuguauuuccugugaacuggaaauguggucuaaacaagcacuguccaguagaauuuucugcagugaugacaauguucuguaucuaugcugaugcuaucuaauacagcuacugcucauauauggcuguugagcacuuaaaauguggcuugugacacugaagacuguauuuuuaauuuugucaauuuuaauuaauuuuaauuuaaauaguuacaccugagguuauacuuccaacugcaucccaucaggaggcccaugaugucagguggccccugggugaggcugacuuugaccccuugguuaagaugaugaucucuagaugucucuauuguaagguacauuuuuuuccccuuuugcauauuaguaacucaucuauagagugauggguuggcaucaugggaauauuguguuccuuaguauccuuuuaccuaaugguuuuagaaccuauagaucugagccuugccugaaccaguuauuucuaguggagguuaugaaaaguggugauuuucuguuuuauuguaucuucuguuagcugacuuuccucuauaacgaagaauguuuucccccuuuucuuucuuucaaccucuuuuuuuuuuuuuuuuuuuuuuuuaaagccuacaacagcaccugguauucccaggaagucucccauccaaguaugaaaccggcccaacccugcuuagccuucaagaucagaugagagcaagcguguucagggugguauggccguaggaccuuuuuuuuuuuuuuuuaauguuaugauggacuugugaauuucuauuuacuaguauguuaucaauuacaguaauuauucuuuuuguuguuuuaucgucuuauauuuggccaauuggagucucuccagauuggcuccuguguccuuuugacauaaccccguuaauucugagccuucuuugaucuggggcauaacaagauauuccagguuuaccucacauuuuuucucccucagauauggaauuaaccuccuauccaaggagcugugguucuuuuuaauggagagggguauuuagaaaccaagauauaugguuaaauguguucaagcaauagcaaguuuuagcuucccaauuuuuucuuuuaguauucaugaaaaauguuuaaaguucaaaaaaaguugucauuaucaauguuguaaaccacuuuucaaagauuucauggagaaaaugaaagugaugggcaaaggagggaauuuugucuucccaauaaaauaaaggaaauaauagaacauuucugcuuaucuucauauugaggcuucauuuaauaguugauuucuuauuauaaccaaauuugagaggaaggaauuugaagggaagaaucaucuuuuguaauuuuuuauauugagagcauucauuauauaaaauaggauauguuauuaaaaaaaccuuguaugagcugcuuaagacuaucaacaugggggaccauuuuaacaugacaaacuagauaggaauaugaaaagcuuuauuaauaaacaugguucaaaaauuauguagguguuccuuauuugaauuuuggauaaggaaugccuuuaaaaaaauucuucuaguagcguaaaagaccaaaucauggcacuacacucaggaaggaugugaguuccauggagaacuggacuuuggccaucacccuagguccaaagccaaugaauguuuguugugugccuacgaacccagacagcaaugucagcgaccccuccagugaucccaucuucuucagcaggcugugcagugagcugagguucaacauaggggauguuugucucugguguuuucccauuucuuucugcuucuuccuuuugggccagaguccagagguggcccagguaugccagaaccacuugucuccucuuaaugcugccauccagguaucagauguuuaccuccuuucuugacugaccucacauaagucuugggagaaagguguucacagugcauugcccacacaccccaaaaugccacagguauugcaccuugaacagacuacaguuaauacaaaugaacuucaaauugguagaauuccagaaagugcaaccaagugaagcagugugagagaaguggggguuuugcccaaacugauaccaagugacuuucucccacuuuguagaggugggcugggcccaguucacuauauaaugcuaaaaucuccuaaaaugagcuaaauacugaaaacacugucaacugauuuuaugacucauaauacuuuauuuggaggccuauaauaauuuucagggcuuuuaaaggauauugacguguuauguaguuuugaaaauacaguguuauaucuaugcugcuacuugucaguuggauaaaggggcugaauaaacacaguucaaaaauauaaauauuaggucugggcauggugguucaugccuguaaucccagugcuuuaggaggcugaggugggaggaucacuugaggccaggaauucgagaccagccugggcaacauagugagaccccaucuguacaaaaaauuuaaaaauaaaauuuaaaaauuaaauuuaaaauuagccagcuguaggagugugcaccaguagucucagcugcucaggaaucugagauggggggggaucauuugagcccaggagguugagguuauagugagcuaugauggugacacugcagucuagcccuggcgacagagcaagacccuggcucuccaaaaaaaauuaauaauaauaaaguaaauuaaaaaaacccaagaauguaaauauuaguauuaaugcugugaggagucugcccuccucucccucauucugccccccuacucccuguauuagcugcuuuuguagagggggccccaguugguccuaacuuaaagcaguuucacucagguccccauuauccuugucucagguuggguucucccugaagcagaccuggagaacagggauuugacgguaagugguugauuugggaaauaaggaauaucaguaggaaaugggggaagggaggcagggagggcacuggguguauuauuaagcuagcuaccauagucagccuggcgccaaauccuacagggaacuucugguaagugguuugcacauucgggauauguguccagcagcuccuaagcagcauugauugaggacugcugagcaagguuguaggugguagggaauuaaccaaacacucuccagagcagccuucccagguucugagaagccuuaggcacggagccccagauuccagaaguuaggagugcccagaaagguccuagggauguguguagaacguugccagcaucugccuuagccuaccucauggcaauauugccaggcauggggucuacaugucagggcauucagggaggauccccauggcaggcacaagagucuucaucugguuaggucucuccuuggccugaaaugcuggcccaggcuuuugaggacaaagcccaggugcuggucucugccugcacagagcagccucacccuuauuacuccucccaacacacacacacacacacacacacacucucucucucucucucucucucucuguguuugucucucucacacaaauacacagacgugcacauuuuuucuccucaucucucccuaauuuccccccuccaccuucuccugccauccccauuucucccucuuaucucuccccugucuccuauuccugucuccuugccucuucuugcccccaaaucugucuucuccagauccucuaacucuuccacccccauaucuucccacugucucucuacaucuuuaucucccgcacacguacacacacacucucucucacacauacacacauacacacucuuacaugcacccgcggugcuuuaagcaugcuggacaauuugcauuuccuugaaagcaccacauuaucucauaccuccuucaauuagaaggccuuuuucccccugcccugccuuaggucugugucauaauuaucucaguaagcacuuccuucaugguauuauaauuguuuacaugucuguuuucccacuucacugugagcuccuugucuuauuauuucaaugcucucaguaucugacccauaauauggcacauaauaagcacucaguaagcauugagacuucccccuugacugaaauuaauucuuccauauuuuuugucucauucuguuauggaccaugaacuacuacuaugugagaacuaaugugguauugaugauacucuuuauuauaccuucccaguuagcauuucuguuuaauagcagagguauucugaauauauaaugucauuauuuaaagaugugauucuccaggccuggacaacaugaugagaaccugucucuacaaaaaaauagaaaaaauuagcuggaugugguggcaugugcucuagucccagcuauuugcgaggcugagguaggaggauagauuaagccugggagguugaagggcagugaguugugaucaugccacugcacuccagccugggugacagagcaagcccuugucucaaauaaauaaauaaauaaauaaauaaaguaaaauagauguguuucuccuugaaaauucagucauuagguuauguaugccuauaaggggcuaauauuugagaacaagucuuuugaacucugauuugguuucugcugaggauugugacagacauugugagcagggcacaaccuucaugccccuggagggcaaaguguguagcaaauaccacuuuuuaucaaccaaagugucuugccuguuaauaugcauuaguugaacaaaugaacguucccccauaucuuugguaaaaguucacgaucuaagaggaagcacagauauuggaaaaaaauaggagaagagaaaacaaaagacugugaagcuuaguugcaucucucauacugacuugaggaucaaaucagcccauuauguaacucucuguacccauuuccucaacucuaaugugaggagacagggccagcagauuuuaaacgucgauucaguucaauuauucacuuauucuguaacuugagaauuagcugugcaacccugaaaaacaaugaaaaaggaaaucuguagcaaaaaaagauagugguggcacuuucaggcaaacaguaaagugauggaggggaaauugacggaagugagaaugcagaaaguaucauaauggaaaacguuugugagcauggagagaaaucccagagaccugaaacuucugccagaaccuccaucaauccuccaucaaucuguuaaucguuguuaacagauuucauuaauucagcugaaauaaauuacaugugcauacugaggaaguaaauggaaagguucugcuaaauuuaggugggcagcaucaagccagugcugugaagcaauacagugacagacagaacaaguuaccugauggauuaacucagugcucuuggguuuauuaaaacagauuucuuggguuggggcaggggagauaagggaauuauuuaucccuagaggggcuccagaccaggagauguuacuggggcaugaguaggcucuggagagcgcuguggaaaacuccugcucuccaguguuccggacauggauaauaaccagguguuguaugcaaaaauaaaaaagaaaaagagaacaaaguauuuuuugauggaaauccauggucccaggggauauagacuuacauucuguaucauuaauuuaucauuguaucucucugacuucauugugcgauuucuguuugcauuauuaauuuagcuaaagaguaucuacaguugagugacuuuuucaguugcauugagagcagucuaaauugggcuuuuaaagauacuucuuucuguucuuuaggaagacuuuaugcaguuaucacuuccuuuuuccuucagcaaaaugaauugaauaaaacucucauauuucuaugagaaagugcucugucuuuggaagguauggcucugaaaugauccuauaaugaggaaaucagguacaaugcucauugaucucaaagagcguaagaaaacauuuguagucacaagaaaaaagaauuuuuauuuaaccuguaauuauauguuuauauuguaauucaucccccauuucuuuuugagauacuaucccuuggaaucuguaaaggaugccuguuuaaagcucuuggggcuaaaauguaaacaucucuaaguucagaggaauagauauggaacagagagauguaaauuguaucuuuguuauugcuuuaucuauuccuaguuuauuauuuuaucauuuguacuggccugauaaaauuuucauuuaauuggguaucuauuuagagaauuacugccaucuaucauauaguacucugcuggagaaaaaaaaauccauaccuaacuguuacuaaaaaugagacagcauauauuaccuuucaaaauauuuugagggaaacaaaucaguuugguuauuauugcccauuuguuuuucguaugucaaaacaaagcucaggccuauuuuauguucagagaacuaaggaaacagcuuucucauuucaucucauagguguguuucuaauuacagugcauaccugccuaauuuagaaaauguucugauacuuaucuuugauggaccacaauccaugacuuuuuuaaggcuuuaauuacuagcguacugaaucaaagugcuuuuuuaugccuugcuuuuaagaaaaagccauuuuaagauugaaucacuuucaccaauuauaguguggugaugaugcagacaucuuuauguaguuauuagugccagagcaaauugguuucugaucauugaugucugcaguauauuuuuauucauagaaaauggaauuuguuuuaaguugaugaucuagcaaguaugcucaauugcugugacgaucagaaucaugauauuuuguagauaucauauagauaagaaaucaguaggauugauuuuuuuuguuuguuuggggcaaaacuucuaaaaggaaacacugucuaaugugcuacuuucauaauaaaggaauuguauuuuugugauaaaguaucaaacuguauacauauauauacacauauacauguguauauauauaaagauuuuauuuccuaaguugaugaaaguaaaaauccaucaaaucuuauuuuauuuaaaaauuguagcauuuuguaaaauucaacuuuugauaugugucauuugcaaaauuguucauuuucuaagauaaggugaauuucuuggcaacaucagcuuuuacuuucuacuucaaugcucccuguauguuguaaagaccgcaguauacagacaggugcuaguuguaaaaauauuuaucacaaaaucaaacuuucuuuauauuuagcucgaauaugagacucaaauuaagaagaugcuaugcucaaaagauagccugggacuaaaagaggaacugacagaugaagacagagaaaagguaauaaacuaaauugguaaccuuucuguuaacagaggaauucuggaguguuuauaucuugagauauuguuuuaaauaaaaucaucuuauuaggaagaucccuuugauuaaaccuuacgugauuauuuaaagauuuuugcuuacagaauauugcuuuaaugucuaauuuaauuaaguuugcugaaaggguguuacuuugugaagaaaggauagacucuaaagaaaaccucaguguugucaguagguaaaauuguuuuucuaaaucaugccuuguagcugcucuuuucuuaguuugagaaguguuuuaaaugaaaaguaaacaaaauauggcauuuugauucuuuuauuugugcgaauauacauaauuuuguacauuuuaaccuuugcacagaaaacguggaaagaaaagauugcauaucuaagcaauagacaaaaagaucgacaaggaauacuuaaauaaauucugcuauguaucugcuauaaugcaggcuucuaauccuccugccuaucuccauauaaaugauucuguucaagaccguagauguuuucuucacuaaaagcaguaaagcucuuuuagaugaaaugucuaaaaacaucuuguaauaacuuggagcaugcuggcaagaguagucacuugugacuaugugugaaacccccucagccagucgauauuguaauaagcaaaaaugguagcaucacuccauuauucagaaaagccaacagcgugcuuguuccuuaggcugcagcauucauuaagaaaagcuuacugggcugaaagcuggaaacagaugauaacgggauaugauuuucauauuuaaugcuuuccuuggaagagugugugugcuacagauugauagaagaaucaacugcuacuuuacuaaaagacuuucagguuugcccuauagcuaccgauggaaucauucagccaagaaauuaacuuuuucuccuuuuaccugcuuuauauaucugcuaagcaggcugccuggcugccaguaaauguuauuaugcaguuaacuguuggguauuuaagacucuuaucagaaaagaaacagaggccacacuauuuuguuuuuauaguaggaggaagguuuuaguuuuucuuucuuccgugcauuagcaggcauuaaucugaguuuauaggaaguuuucguuuuccuuccucauagauuaaaaaauuaaaaaaaaaacccuagaacuuagagcauucuuuaaacuguaagauacaaaacaccaagccccagcaaccuugaccuauauaaaaaggcuuuaaugauaaaugacguauaugccauucgauguaggccaaaugugguaugaugugauagaauuuuagagcauucaggcaguuuuucuauuugauauucggucaugaaauaauugauguguuuuaaucuagaagccaguuaguucuuucuaugccauucuugauagacauauucuuagcacggcagugucaaugguacuucaggaaaacggaagcuuuuuuuuucuuuauuuacccacugauucuuuaccuugcauguaguuguggagucuccuuuuaggacauauuuaaaauuagggcaagagacauacaguugacaaccccuuaaaauguuacauauaauaauuagaagucuuuucauuuauauggaaaggugucauuuccuuaaaagcuuugacuauuggcuguauaagaaucgauuagguaacacuuugagaaauuuauauuuugcauuuucuaauuuuccauugauguucaaccaauuaaaagguaaauacauuucagcaaaaucauguuuuaguuaauccuuauacuaauuccugaaccauuccuuaucauaugaguuauagcuuauuguuuaguggaaauccaagcuucucuucuuugggcagucauaugaauuggucuuggucauugaccuccagggccuuuccugaagcauaguacagucacugguugaaucaauaaauaguuguuaagcaucaguucucuuugagaagcaacaguaggccccucuaugaaggccacaauuuucuuaccuucagagugcuucucagaaagcaauguucuuucuaaggcacagaauagugugugauaaagugccagucacgugggacaaacaugagcaaugagaagaaagaagauucugcuuccugugaauugaguaaucccagcccugguggaggagguggugugugagcuggcauagaaggaugugcaggaugccagucagugguagaaaaugagcuuggaaagcuaccuugugggauuugguaccuggaacuauggucccaggcuaagaacugagauuuccuccuggaauuuguguguguguguguguguguguguguguguguggcagcagaugaaggaaggacuugugagcagagcagucacaucccaugugugcagcugcgggaagaugaggcuggcagugcugugcaggaugagccuggggaggaguacguggaacugaggaaaucaggcuccauucagacaggaggaauuaacagaauggaggaccuguauuggggauggccauugagguggaaaacacuaacaaaggggagaggaucuaucaaauuggugaucauucugaauuauaaaaagguauuuuuuaaguggcuauacagcuuucaaccauaggcaguaacuuggaugccaagaaaagucaucaagugguguguguccauuuuuuaaauauaaaaacucuggcucaguuuugguguaggacaucuauuauuugcuugcauccaguaguugcucuuuagaaucauacauucgcuuagaaggauuaauaguuagucuguucaucugccaugcuuguuuccacuauuaauuuacuuagucagcuuacaaaaaaugugucuuaccaaaaaggcacauuucaagccccacucagauccucacaaauuuuacuauaguaauucuucaccucuauuauauauauuguuauuuuuuauuuugggggcaaacucuguuuccagacauguucuucugguugaagaacggugacuagagaauauacauaaaaacacauaaaaauguauguccucaagaaagauugagauggcguuuuugaaugacaguauacauuuggggauaggguuguaagguuucuuugaacuauuaugcugugaaauauauucuacuagaaauagaagcaaacugaucauacucugucagggauggauagguguggaggaccagggaauuucaucacagagcugaaggcuuguugaggagcuucacuuccacugugguaacccucccugcaaggaucaggugggagaaugguuauaaagguguuauucccacuuuuaauacugguaguaacaauggguaauaaucacugcacuuuuacuuugcuaggugcugcguuaacacuuuauguguaucaacucauuuaaucuucucaacaacccuggaaguagaggauauuguuguccccauuuuauaguaaggcucagaaaauuuaguuaacuugccgaaaacuacacaaccaggcagaaccaauauucaaacccagaccacuggacuucagcauccaugcuguuaaccaccuugcagcaaugcccucuaagguaguauggguaaaagauaguauggguagcucuucaaaaguuggagaaauuccuggugaaauaaaaacaacuuuaaauacugcauuuuuaccuagacuugagggaggaaauggucuuccuuggugcuguaguauuugagcugaaucaggugagccauggcaagcugaggacccgcccccuaaacugcccauguuugcaauaaaagaagcguccguuucgguuggcuuuguugggcagaagaaaugccuuacaacucgacugaagaagaacuugaagggagaaagccugcacggccacaggaggcagcugugugccugguaugcagggaugagcucugcaguggcuuuagccacggaucugagcauguguccgaggugcucccaggagcagugccacugcaggagaggcacacgucagagaagacagcaccccaguaugagaugauggaaaggguucuuccauuccagauguguucccaggaucugagcaccauucauaagaccaaggcagccacuguaggaccuggcucaucuccaaggaguaaagggaccagauaccuugugugggggaaacuugauugaaauaaauauugcagcaagggagaaaggaauccuaaaacuauacugaaagagcaagugacuuagguuggaauccccugggaaggacccuaacacaaggauuugaguguaaguaguuuauaugggagguggucccaggaagcacagauagaaaagagaggaagauggcauggggaagggaaagcgggcuguaagagugugugauugaguggguuaucacucauagcaccuggugcucagucccauuggggaaccuuggaugacuguguagggcaugccucagggauaucccauucaaggaguaggaaagggagguuuuuccccuccaggucugucacuaccagagugccacgccuggcuccucuucuggugcugcacagcagcugagagaaacgcuugggccaagaggcacaggugcuuagaggaggacacugggcagguacuggaaugaugagggcccagggauaugggcccgcccucucacaccugcuaagggaaauaacaguggguggaggagguagagguuauuccuuugaguucucuguauaagcccgauuucuuauccuuauuagcccacagugccaccuucaccagcagccuccuugaaucacugcucaacuauaaacaacacaaaaaucucccuagacgggggcucugagcaguugccuucacggggaacguggcccucgguucugccauucucaaaguuauggcuguacuugauuuagacagagccaugacaagucaaaaaguagccucucuguguucagcuggaccuuuuuauauuaacugauuucuuauuuauauguguuuguauucagaaaacaauuagaaauuaacccgaauuacacaaauuguauuucaagcccuggcccuaaaacuacaucugcagaucugcagaccuuuuuuucaagagaggguagaacaugcucuucucucccagcucacuugacaguaagcuuccacauggcagggcccagccccuucuugccugccacaccaccccacagcacccugcaccuggugagugaugauaaccugcugaccugaaaggaggaagaggggugggcugcucucugagugaaggguacuccccauuucaugugguguucgagggcagaugacauuuggacucuccacuccugcuuuugggggugccuuccaaggagcugguggggaguguggcucugauggacagcucccccaugggucuuucaggcacuauucuaaggauuuuauauaauauaggcguauagaaauacacauugguuacagcaaccuuacaaaauaagaacuauuuuaauacccauuuuacagauuaagaaaugggagcucaaauaaguaacuuaauuucuuagucacacagcuaguaaguggcauacuggucuggagucuuaauaaauacaucagucugcuuuucaguuacuggaagaaaggauuuacuuaggaaaauggugggagagggccuuuuuuaaagguauuagcuacucucucauagucaagaaggaaagacaguauuuuuauaacuuacccauuguggggacauuuggcuagccagcugucuuccuuugcucuucucuguggcaguauucuguggcaaguguauuaugugacagaggcucuaacaagugagaaaaucguauucacagauagaggugccuaucguguaguggaaugagggggaagagaaaaaaaguggaugagaaggggaaaagaaacguaagucaauuuaacaagaaaaagauaaauuuuuguggggaaacacuguuucuuuucuccuuuugauaguagaaaaggauuuauagaagcuccauaggagaacgaguauugaguucuuguucuuuagaagacuuuccaaauucauauaguccaugaaauacuguauuauuagaaaaagauauacuucaugcagucuuaaaaaaaaaguuagugccuagaacuuucuuggaaaagaaucugguaguaacagucacgaugaauacacacauaugcuuugugccagcagucccacuuuugguaaucugugcccuagaaagaaaaucuuuuguucaaaacggcaaaaauauagucugcguguugcaacauuauuuguagcagcaaaaacacagaagcagccugaaugagcagcugcagaggagaggcugagcuagggagagagagcacccucaugaucaaguauucugcauauggcgcccagaauccagugcauuccucaugaucugggcagcguccaaggaauauuauuaagagagcaaagcagguugcggagaguugcuuacaacaugcucucacuuuguacaaguggccaaaccuuaccagcaaggaauuaguuguccuggguuugaaggaaggugugaauaggcauccuaacugguuugcuucaguuacuucauggaggggagagggaggcaaugagcuggggaaaauaaguaacuuguucuuuacaucccuuugccuuaugucucauuucuauaauuuaauaauuuuuauacgauuuuaaaaauuaaaccuaugaagaagggaugagcaggugguuaguucauuuuaggaagaaggagccugcuugugguugagacuguucuuuuaauugugggggagugugaguugcuuacguccuuacucaaaucccucagaauuauagaaaauuggaggugccuuucuaucccucugauguaguucugcauauuucuuuugugaauggagaucucuaagagaguuuuauccugaguuacccuauuuggggaugguggagcauauacaggggauauugaauuguauuauaaaaagaaagggcuguuaccuugacaguuuuagguauuuguuaagccucuuaggaaguguuacuugaaaaccauaacuuaacuuuguauuacuuugaccaagacaauugcuuaggccuacggaugugaaacagugguuuugggguguucuguuuauuuugugaaaguuaccugcugucacuauuuuggaaugccgaauuucucuugaagcucauaccugcuuuucucuuacucuuccauuuaccccacauagacuagguuuuauuuaucauauacaaguucuauucagggucuaucuuagugagaucagauuuugaguuauuugaaguuagaaauuaggcacaggcuucagauucacuauuagggauuuuuauguuuguuuuuaaaagcugugguucaguaaugcaauuugaguuugacugacucaguuuugaauauuguagcauaagagguuugcauuggaguccugguaucugaguuuaaauccuggcucugugaacauggacaaguugcucaaccuggcuaagucucauaagaguagggcuaauaauaaugauuguuuucauaauauaaaucucuuagcuccuccuugucaccucguacaugcuugauaaauguucccugcucuugaugccaccgucaccaccaucauuaccauuguuguucuccacuaggguagccuuacuuugauccuggauucuugccacuuauuuaagauagugaagagguugguguggggguagggagacuaccuaugaauugaagaaauaggagguaauagcacuugauggugacaauucguaaagauugauuuugugcaagauaauuuacagaauacaccauuaaagccuaauuuaacagauauaucuuaaauuuagauaguuccaauaacuguugaauuucauggccagagauaucucucgauggucuaaguugugagauuuuggugaugacuacauuugucaugguggcaacauguaagaagaagacuuaaaaaucacaauggcauacuguauuaguuugcuagggcugccauaacaaaauaccacaaacuggguggcuuaaacaacagaaauguguuuuuugaaguucuggaggcuggaaguccaagaucaaggugccaacagggucgcuuucuggugaggccuuucuccuugagucauagaaggggccuucucacuguguccucaugugccuuuucucucugugcaugaacugagagaucauugguaucucuuccucuuauaaggacaccaauucuauuggauuaaggucccaccauuaugacauaauuuaaccuucauuaccuccuuuaaggcccuauccuuuaagccacaguggggauugggacuucaacauaugaauuggacacaauucagugugugauacguguaucauguaaaauauguauaauaauuuuauaauaaacauauaacuucaggauuguuggauguaaauuauuguuaauggauuuuuaaaaaucuucucaaugugacuuaagaacuugcuuacauagaaauuaaaaacaauaauuguaccaugugagaagcugaaaauuuggucuaacagcuucauuucuguucugcauuuaacuugcugcuucucauucccuugucugugaagauaauaagaagaagaaaaauaaagauuuccuuagcauuuugcaaaacaugaaguguaacuuuuuuuucaaaguauacuagugguugaggucugccuuuaaaugcuguaguucauaaugauuaagacaucauuacaguucuaaacuuguugaucucuucuuaugcucacuccucuucuuucccccaguaaagaugaauuccugauuuuuaaaaguuaucuucuguucacuaauaaauauuuucagucauguucaugugcuuugcuauugcuucccacaacuccuaacauuuuucaagacugcagaugaauaacugugacaagaagagaagaaaacugaacuaaaaucuuggauuauagauuuaucucuagcacucaacuacagaaaguaauaggaagguguggaaaaguuggucauuaugucagauccuuaaauacugauacaugcugcugcuuuuggcaauaacaucugucucucaaaaacuuuugaauuccuaauauuauuccugugucaacaauaaugugaaacauggcauucuguuuucagcuucccuggcucagaaacugcuuugagaagacacauaauaguguucagaauuuaagauuaaagaguacucuguuuccuguugcuaagcuaauaaaaugacagacuuuuaaaaaagaagagacaccugucuuagagccugaucucagcaaaugggaaaccugccagccuacagaaacucagcuuacauuucacuggagccaguauuuuacguugcaaguguggagcuaguucaaaugcagcauugucuuauagugagcagcaguuaauuuuugcaaguuucucauuuuuuguuauaaaaguuuauauaauugccggugggaauguaaaauggugcaaacacuuuggaaaacaguuuggcaguuccugaaaaaguuaaacauauaguuaccguacgaggcaacaguuucauucauagcauagcauucaagcauagcagcuugcuguguacaagauuggacaccaaaaguggacaaaaguuuauagcagcauuauucauaguagccaaaaaguggacacaauuuacauguucucaucugaugaauggauaaacaaacuacaguauauccuuaaaauagaauauuauucagccaugaaaaggaauaaaauacugauaaaugccacaaaauggauaaaccuugaaaacauugugcuaagugaaagaaaccaaucaaaaaagacaacauauuauacgauuccacuuacauauucauaaaaugugcagaauaagcggauuuuuacaaacagaaaguagauuaauggcugccuagggcuggggacugacuggggaggauggggaguuacgcuaaaagguaugggguuucuuguuggagugaugaaaaaaauguuccaaaauugauuguggugauggucgcacaacucugcgaauauacuaaaaacccacugaauuguaugcuuuuaaaaggauaaguuuuaugguaugugaauuauaucucaguaaaaugguuuucaaaaguuuaaauuuaccguaucuaaguauuuuuguuaugacauagucuuuauuugccucauuuuuaugacuucaugaccuuucccuauuuuauagucauauaaguugcuuccaacuuuuuaugauuugaaauaaugcucuacgugaacuuguuuguccacauagcugcuuuuucuauuagcuuuauuuccuuauuaugauggauuuccauauagaauuacugaaucaaagcaacaagcaugguuaggacuuuugaugccagauucuuuccuacgaggauucugcccauguauucagccaccagcggugugacagcuucuauuucaccuaaccuuccucaguacugggggguuauaauuuuuaaaaaucaucuuuauuuuacaauaauuuuagauuugcagaaaaguugcagagauaguacaaaguguucccuuggaucccucaccuaguuuccaccauuguuaccaucuuacauuaccaugccacacuuggcaaaucuaggaaaccaacacagauacauuacuguuaacugaacucuagacuugauucagauauugccaguuuuuccauuaaugucuucuuuuuuugcuguuccaggacccaauccaggauuguuauaauuuuaauuuuuaaaaauucaauauaauguuuauagaaugguauuacauuguuaucagucuuagacguaggguuauaauggagcugaaaaaauuccuguugccuaaugacuuaacauuguaguguaaugcauuccugacauguuuguggugaugcuggugucaacaaaccuagugugcugccaguuguaugaaaguauagcagaaacaauuauguauaguauauaauacuuggugauaauaauaauaaaugacuuuguuacuggcuuauuauuggcccaauugacaaaauuggauuauggguuguggaauagaaaacaagauaauaucaauguuaaauuuucugauucugaucaugaacugugcucaagaaagagcgugucucugugcuuuuggaaaugcucacugaagugcuuagugguagauaggcagggugucccaacuuacccucaaaugguucagaaaaaaaucauagcuuauauuuagguauacacacauacagagacaaacacauauauguagagggagagaaaaugauaaaugggauaaaauguaaacauuugguaaaucuggcuaaacacuguuaagggaguguuuuguauuauuuuugcaauguuucuguaaguguaaaauuauaucaaaguaaagccacgcaugcugaugcacaccugcagucccagcuacuugggagacugaggcaggagggucacuugaguccaggaguucgaguccacccugggcaacauagaccacaucucuauaaauaaaaaaaaaauuguuuaaauuaugucaaaauaaaaaguuacugguuccuauaaauaauacuggcaacaacuagaaauagugcgggaagacaaccuuccuauugaguugaagcagauccucaaguacacguugccuuuuuugggcccuuggaugaaugaugcaucguccacagacuuuuauuuuuacacauaauuaagggccacuuuuuuauaauuguuaauuuguuacaggccacuaacaugccauguacuuauuaauuaguauauuacuagaguuuguugaggacccagaguucaguauuccaagaagucuggcaaugcuuggcaaaauugcaaaacaguuaauaacuacuugcugucacagagagugguaaauacuccucuuuuugggaaauaaaccucugcuaacaguguugucucuugaauuggccuuauuuucacuuucuguaguucugaagcauuuacuauaaguacaucaugguucccugcuacuuuuccugacuaugcagauuaccaaucuguuguuucucuccaguucuuggcucuggauucguuguucaguuuugccuaucuuaggggguuggagacauuugagaauuacuaguugagagcaguaacucaggggcacuuccuuuggcccuccucaggugucuuucucauaucugaaaugugccuucuuuugugcuuuggcuuggccuuuagcggaucaaaagaggaaggugcuuaggccugccauguccucccugugcuggguuagucguugcucugguguuggugcauuaacacuucauaaacuggucuugaaaaugaaaaauuaaaggcuucucagacuccuaagucugaucacugauuugcuucaugucuccaccaaguaacugcuauugcacagccacucugaggccucagcccuuuuagcccugcuaaagucuccauaguagcccaucccuuagagccaucuauuuacacaacuaguuuuuuuauaacaggaaaaaugaaaguaguuguuagauuacaguagugguaauagguaauuuuuccuguuuuaaaauuugucuuuguuauuauaucaguguaauauauaucagcuuuuuuauuacaaaaggaauagaagacacaguauauuaugaauacuauucauauuggugagucagaauguugauuaauaucauuuugcuguuuaaaccauaugguauaauggaaaauucuuuaaaaugacauaauggccucuuuggauggugaaaugacaguauucuguaaggcaggcuugacccagcaauuucaguucuagaaaaguauccuacugauaaacuugccugugugcagagagacauacacucagggauaaucacugcagcaugauuuggaguggaagauggugggaaacaaaccaauguccuucaauagcagacuguuuacauaaauuaugguacaucuauagaauaggauaauaugcagcuguuaaaauuggauauaauaaaaacuauaauuauauaaugcaaaguaugucacccuuuacgcacauaccuacuaguguauccagguccuuucugcaagaaacuuagaguugcuuucucuggggagaacagcuagaggacuaaaggaucauggagguggaacuuccuuuuuccucuauacuuuucuauccuccuggaucuuccugcuucuccucccucuguggggagagaugggagagauguacuuuuccuaauuuuuuuuugagacagggccucacucuguagcccaggcuggagugcaguggugcgaucauagcucacugcagcuuugacuuccugggcccaagcaguucuccugccucagucucuaaguagcugggaccacaggugugugccaccaugcccagcuaguaaaauacauauauauacacauauauuuauuuauuuauuuauuauuacuauuauuauuauuuuuuuuuauggaguuuugcucuugucacccaggcuggagugcaguggcaagaucucggcucacugcaaccucugccuccuggguucaagcgauucuccugccucagcccccugaguagcugggauuacaggugcccaaauauuuuuuaauuaaaaaaauuuuuuuuaauuuuuaauuuuguagagauggagucucacuauguugccaaggcuggucucaaguuccugggcucaagcaauccucccaucucagccucagggccgggaacucuuccuaaucucagauuagcugcauaacuuaauuucuuuucuaaggauuuuuuauucauuuguucauuuucuuuuuuugugauagcuuuauaguuuuuauuauauucagaguugcgcagccauaaucacaaucaauguuagcauacuuucauuccugaaaaagaaaccccauaccuguugggaaucacuguuuaccuccccccgauuccuucuacuccccaccacccaccccagcccuucgguccccagccuggggcaaacaguuaacuacuuccugucucuaaaaauuugccuauucugaacauuuucuauaaaugagaucuuacaguauauggucuuuuaugacuggcuucucauuuagcaugauauuuucaaaguucauccaugauguaacagguaucaguaauucaucucuuuucauggcugaaaauuauucucuuguaugaauguauuacauuuuaucuagucaucuaauguuggccauuggaguuaucuccacuuuuggcuaucauaaauaauguugcuaugcacauccuuuuacaagauuuuguguagucauauguuuacacucuccguacuucugccuagauauggaauugcugguuagaugguaacucuguuuaacuuuuucaggagcugccaaacucuucuaaagugggugcaccguuuuauauucccaucagcaguguaugauucuaauuucuccacauccuggacuacacucguuauugccuguuguagugaauucuuauaauuuuauguugccucagcauccauuuuaaaucuaaguugaaccuucucauaccagaagcaggacucagucaccccugacacaguuggcaguuccacccuccuucgcaguuccucaguguggucgguccagauaaccugccuuacacagcugcucucuggugaccacuucccuaugggacagcuggaugcagccugcuugacaggcccuucugaccuucgcaucccccauggaccauaugccacagugaccaccucucagucacuggguaaccucccagaacucaugccuccuugcuuuaaacucaccaguuaaaacuccccaggcugccugugggaaaccuguuuggauaacaccugcgacucaguaaagacauuggcucauguguccuuccccucaaccccugcuucuaccauguaaggacacgggucccuuuucucucucucucugccugcgcucccugauguuuguguguguggccuccaggugugccauguacuccccagaaccuguaagugauaaugucuuuauuuccaucucauauuucuccuaauuauuggagggguacucuccaucuuaaaaauccuaaauuaagacaccugucauucuuaguauagccauugauaugggcugaauauuugugucccccccaaaguucauauauugaaauucuaauccccaaggugaugguuuuugagggugaggacuuugggaagugauuaaaucaagggggcagagccuucaugggugggauuaguuucuuuauaaaagaggcccguggaaauuugccugccccuuccacccugcgagcacacagcagaaagaugcugucugagagaaagcaguuccuuaccagacccagagucugcuggcgccugccuugaucuuggacuucccagccuccagaacuaucagaaacaaauuucuguuauuuaugcacuguuuaugguauuguuauagcagccugaacagaccaagacagccaucauaguggguaaagugauaucuuauugugcuuuugaauuauguuucucuaaugaauaaugauauuaagcaucauuuuauguguuuauuggccauucauauaucuucuuuggagaaaugucuauccaaauccuuuucccacuuuuaagggcuguuugucuuuuuauuauguaguuauaugacuucuuuauguauuuuggguacuagacccuuaucagauacauaauuuacaauauuuucucccauuauguggguuauauuuucacuuuccugaugacgucuuuucaaagcauguauuucuuuuuucaaaaacauauucuauacuuucuuuuuuuugagauggagucuccaggcuggagugcaguggcaugaucucggcugacugcagccucugcugcccggguucaagugauucuccugccucagcuuccugaauagcuaggaucacaggcaccugccaccgugcccggcuaauuuuuguauuuuuagcagagacgggguuucaccaugucagccaggcuggucucgaacuccugaccucagaugaucugcccaccuuggccucccaaagugcugggauuacaggcaugagccaccacacccggcuuacuuucuuuacuauauuuguuuugugaacuaucauuguuauuaaaauuaaauccuauggacuuuacugcuuuuugcucauucauuauguaggaagccaugaguuuaauaauacaugguaggugcugauuucaauaaucaugcuuuguuugaccuccuuucauuucuggaaaaaaaaaaaaaccccaccuaauuguuuauacacaguauguuuaacucacaucucuuuugguguugcagguugcagugcacgaggggauuaacucaggaacagccaugucaagaggauuguaucaaccagcaacaaucuuuaugggccgccaaaugucagccaucuuaagcaugagagauuucaguacagagcacaaaucuccccagcccacaaagaacuuuucaauuccugacccacauucacaccgacagacagcccagagcaguaaugugacagacagcuguguaguacaaacuaguaaugacacacagugcuuaaauaagucugacaacauagauggaaaggcaucucuucagauuggugagaaaaugccagucacagccaguguauugucugaggaggaacaaacucauugcuuggagauaggaaguaacacacgucauggcaagaguaauuuaucugaaggcaaaaagucugcugaacucaauuccccguuacgggaaagauuaaguccagagaacagaaccacugauuuaaagugugacaguuccagcggaucagagggagaaauacugacacgggaacauauugaaguugaggaaaaaagagccagcccgccagucucuccgauaccaguuucagaauacugugaaucugaaaauaaguggucucaagagaagcauucuccuugggaagguguuucaggugggaugagaggcugaguuugguugcugauuuuucugggugguagugaucuuauguaaggacaaaauauacuaauuaucucucuuucauaaaauaguaucuuugccaacaaauuccauucuaaugaacucuuaaauauguacaugggagugaauuugcugauuuuuaaacccacugugauuuuuuuaaacauuugaaaacguguuuaagcuuuuaaguuccguaaugaauuguguguggguugcuucuccauguuuuuaacugaugaguaauucugcuguguguuaccuugcuuccuccugaagucagugauugguaaucaguucaugucgccacuugcagaucaucuugcucacagggaaccaaagucacaaaagcccuucagaaaaaugcaggaagaggaggaggaaaguuggagcaccagcagugaccuuaccauuucaauaagugaagaugaucugauuuuagagagcccagaaccacagccaaauccagguggcaagauggagggagaagauggaauagaggccuuaaaauuaauccaugcugagcaagaaagaguugcccuauccacugaaaaaaauuguauuuugcaaacccuaagcucuccugauucagaaaaggaauccuccacuaacgcaccaacaagagaguaagccauucaauuuuuuuuuucuacuguucuguuuuuaauuguagacauuucuagagaccauuccacugggaauguauuaucgagcacucagccaugaauguguaaauuccuuaagucucauaaguaaucuuguaggcaagaccuaauuuucuuucuguccuucuuucuucuuucuuuccuuccucccuuccuucuuucuuugacaaaaaaacuuuaaaaguuugaauaucauugaaucauggugauugcagcuuauaauuauauacacauaaucccugguuaacuuauaagucauuccccaacccccuacucuccaggcuuucagaaaauaaaucuguuuugaaguuuugguaccacagaaggugacaguuaaacuuacuaggaaugcagcauuagagucugagaacuuuaugucuaauuaauuugcuuaauccuuauauuccuugccauauuaucauuuuugucaucugauuaaauaugaguuaauaaguucuucuaauuguauauguaagccagauuuccuuuuuugaaucuaaauaggaaacauuagaaucucuaauguuaaaugggaacaucagcauuauacauuugagaacuuauauuauccgacugauaaaaauuuguauauguuuuugugcuacugauuggagacgcuagaagaaaacuuuguagaaaguucuuguguaucuacuauguagaaaacuuguuaacuguugaaaagugauuuugugcugaaaaauggcauuauaacaucaaaucucuuuuagggguagaaggaaccuaaguaaacaaccuaagguagaucucaccuuuuacaaaugaggaaacgaaggccggggcagaguggugucacguaggucuacuggaucugcuggggcagaacaccccacagccugucugccugaaugucacaccacugccccacccccagaauuuucuguuacaccguaaugcuggucacccuuucauuuccacaaagcuggcagcagugaaaagccaagugggccuuuuuguacggcauauguucucuuuagaacaccauuguaccuuuuaauauauugccucuuaccauucauugucuacuuauggugaaaaguuuaugaauaggcuuuaauugauagauuguauccaaacugauguucaggaaauauuuauuaagagcauauccaaguacagaguucuugcacuauggauggaagaaccgacaugguuccugucauugggaaauuugauuuauuggagaggcaagccaaauggauuuuucuaguaauaauacuucucucaucaaagaggcacagguaauacauauuacaucaucagaaacuuuauuacuggagguagaauguuaucuaucucuaguuuuguguuugugggcuuauuuuuauggcaugguggacaaguuaguacuuugguaggcuaacaaggggacuaauacacuuacccaggacucagucuuuuucugaggugaaaaaaauugaguauguguaugaauuccuacuaaacauuucucuaagagucaagaauguucauccugucuccauucgaaugacuuuuuuuuuuuuaaugaucuuggaggcauaaagucaagcuccuuggaguuuuggcauauaguuuuccaguauuuauuggaaaauaugggcauguggggaauuuugaguauuucucuuaauaaaaugcccccagaaugaaaaugucagucagcagugguuguuucugugucuguauuaucaaauuugagccuacugauuuucuggguaaaaauauucuccaggaauagguugaaggugguuuuaaaugaugcuaguuaacuugcugacaucaccacugcauuugaggccccacauuuucuuaauuuauuguuuaacuggcgcucuucuccuuugcucugaggguuauuggucugagaccauagcauagcaucauauuuauagagcuagcacuauaaccuaaacaguucaauauuucaauugacuuuagggucuguugggggccuggagaaaaaucacuugaaugaauuuaauuagcaaagaugcauaaaugggacaaaggaggacacauaggagcauaugauccagaauguaaaaucugcgcaacauccugaagucuguauaggcuuugaaggagaaagaggagggaaagagcaaauagggucuggaggaaaaugcaagaaggaaugcggagcagagaacacagaggacaugggaggggcagagcaaaggaccccaugggugaggagggccuuuuggaguuaagguucaaaaugucaccuagggugagguugagaaaggccuggaauaucagguuaaugaauuuagaguucacucuaugcuuuguagagcuguugaagguuauuuuaggagaaggacagugugaugaggcuugauuuaggaggauuaaccugacagcauuaguucauuaggauuaaucauccaugugguaggcagaaguguagauggcccugagauucccgcucccuguuguccauucccuugccuugagagugggcaggacugggagucugauggauuuuacuccugugaugaagcugucaugugacaaagaugaaggauuuugcagauauaaugaaggucccaaaucaguugcccuucagcuagucaaaugaaaauuauccaagguggaccugaccuaaucagaugagacuuuaaaagagacuggcccuuacugaagccaguggcacaaccucagcucgcugcaaccuuugccuccuggguucaagcuauucugccucagccuuacaaauagcugggacuacaggugcccgccaucaggccuggcuaauuuuguuuuuguuuuuguuuugagauggaguuuugcucuuguugcccaggcuggagugcaauggcgcaaccucggcucacugcaaccuccaccuccuggguucaagcaauucuccugccucagccuccugaguagcugggauuacaggcaugugccgccaugcuuggcuaauuuuuguauuuuguauuuuuuuuuuuuuuuuguccaugaggcauuuuauuuguaaauauauguauuacaucccuagaaaaagaauuccaggauuuucccuccuguguguuuucgucuugcuucuucaugguccaugaugccagcugagguugucaguacaaugaaaccaacuggcaggauggaagcagauuauucugccauuuuuccaggucuuugaguugcacgucaaaucuggagcugaucacuccacacuuguuuagccugccugugagguucacaacaauuucccagcucuguggucaucaaugauuucaaauucgccaguguaaccaugcuucaucaucacaaugagaaaccggacgaugacuuuggagcacggccuaauaagcaccuggcguuugccucucuuuucggcauuguugauggucuugagagcaucugccaggacauucaugcgcaccauuguggcggugcggaaagagcuuuuguauuuuuuuuuuuuuuuggagagacuugguuucuccauguuggucaggcuggucuuguacucccuaccucaggugaucugccugccucagcuucccaaaguguugggauuacaagcgugagccaccgcaccuggccaauuuuuguauuuuuaguagagacccgguuucacuauguuggccaggcuggucuugaacugcugaccucaagugauuugcccaccuuguccucccaaagugcugggauuagaggcgugagccaccacgcccagccugaagccagagagauuuaaagcagcuaagauacucucuuguuuccugaagaagcaaacugucaucuugugggaaagaccacaugacaggaaauggcaugcagccucuaggggcuaagggccucaguccuacagccacaaggaaauugauucugccaauaaccagugaguguggaagaagucccugagccuuagaugagacugcaucuccagcagacaccuuaauuucagccuggugagaccuugagcagaugaccccacuaacccagauccagacuucugucucaugggaacuaugaaaucauaaauuuguggcaauuugugauacagcaauaagaaaauucauacaacucaguugaagaauuggaagcaaggauugcauggauagaagugucuacccauaaugacugggaacaggcugaauuggacauguucaggguuccuugugggaacacaugguaacaaaguagcugagugagugauucagcagccaagguaaccugugcuuccccuccccuuauaccuucaccaucugagcaagugcauuuucacacucagguaagcaguaguggaacauuauagacugcuagggacucuaaaagugguuguggcuaucuacauuaaccaacaagcaguuucucaugcuaguggguuuuuuguuuguuucgcuuuuuuuuuuuuuuuuuuugagauggaguuucacucuugucgcccaggcuggaguacaauggcacgaucucggcucacugcaaccuccaccucccgggugcaagcuagucucaugccucagucucccaaguagcugggauuacaggcaugugccagcacauccaacuaauuuuguauuuuuaauagagaugggguuuuaccauguuggccaggcuguucucaaacuccuaaccucaggagauuugccugccuucaaagugcugggauuacagacgugagccacugcgccuggccuacuuuguuuuauauaucaaugcauaaugauauguauccaccuuuaaaguaccauuaaaaaauaguuucuuuuuuuuauuauuauacuuuaaguuuuaggguacaugugcacaacaugcagguuaguuacauauguauacaugugccauguuguugugcuucacccaguaacucgucauuuaacauuagguauaucuccaaaugcuaucccuccccacuccccuaccccacaacaggccccggugugugaugcuccccuuccuguguccauguguucucauuguucaauucccaccuaugagugagaacaugcgguguuugguuuuuuguccuugcgauaauuugcugagaaugaugguuugcaguuucauccaugucccuacaaaggacaugaacucaucauuuuuuauggcugcauaguauuccaugguguauaugugccacauuuucuuaauccagucugucauuguuggacauuuggguugguuccaaguuacauuuggauugguuccaacuuacaagagaugugaaggaccucuucaaggagaacuacaaaccacugcucagugaaauaaaagaggauacaaacaaauggaagaacauuccaugcucauggguaggaagaaucaauaucgugaaaauggccauacugcccaggguaauuuauagauucaaugccauccccaucaagcuaccaaugacuuucuucacagaauuggaaaaaacuacuuuaaaguucauauagaaccaaaagagagcccgcaucgccaagucaauccuaagccaaaagaacaaagcuggaggcaucacgcuaccugacuucaaacuauacuacaaggcuacaguaaccaaaacagcaugguacugguaccaaaacagagauauagaccaauggaacagaaaagagcccucagaaaugaugcugcauaucuacaaccaucugaucuuugacaaaccugacaaaaacaagcaauggggaaaggauccccuauuuaauaaauggugcugggaaaacuggcuagucauagguagaaagcugaaacuggaugccuuccuuacaccuuauacaaaaauuaauucaagauggauuaaagacuuaaacauuagaccuaaaaccauaaaaacccuagaagaaaaccuaggcaauaccauucaggccauaggcaugggcaaggacuucaugucuaaaacaccaaaagcaauggcaacaaaagccaaaauugacaaaugggaucuaauuaaacuaaagagcuucugcacagcaaaagaaacaaccaucagagugaacaggcaaccuacagcaugggagaaaauuuuugcaaccuacucaucugacaaagggcuaauauccagaaucuacaaugaacuccaacaaauuuacaagaaaaaaaaaccccaucaaaaagugggcaaaggauaugaacagacacuucucaaaagaagacauuuaugcagccaaaagacacaugaaaaaauguucaucaucacuggccaucagagaaaugcaaaucaaaaccacaaugagauaccaucucacaccaguuagaauggcgaucauuaaaaagucaggaaacaacaggugcuggagaggauguggagaaauaggaacacuuuuacacuauugaugggaguguaaacuaguucaaccauuguggaagucaguguggcgauuccucagggaucuagaacuagaaauaccauuugacccagcuaucccauuacuggguauauacccaaaggauuauaaaucaugcugcuauaaagacacaugcagacguauguuuguugcggcacuauucauaacagcaaagacuuggaaccaacccaaaaaaauaguuucucuacuugaaaaugaccugugcuccaucuacucaccccucuuccuuuaaccccaccugaaccccuugcaaguacugaucuuuuuagugucuugucuuuuccagaaugucaaguagugggaauuacauaacaaguaguauuaucagguuggcuuuuuucacuuaguaauguauauuuaagguuauuccaugucuuuuuauggcuucauagcuuauuuauuuuuagcacugaauaauacuccauugucuggagguaccagaguuuauccauucaccuacugaagaacaucuugguggcuucuggguuuugccaauugugaauaaagcugccauaaauaucucugugcagguuuuuguguggacauguuuucaacuuauuuggguaaauaccaaggagugucauugauggaucauguguaagucuguuuuugguaugggguuauuuaguuuuuaaauuuuaaauuuuuguagauacauaguagguauauguaucuauuuauaggguacaugaaauauuuuaauacaagcaugcaauguauaauaaucacuucaugguaaaugggauauccaucuccucaagcauuuauccuuuguguuauaaacaauccaguuauacucuuuugguuauuuuuaaauguacaauuaaauuauuauuuacuauagucauccuuuugugcuaucaaauaccaaauacuagaucuuuuuuuuuuuuuuugagacggagucucucucugucgcccaggcuggagugcaguggcacgaucucagcucacugcaagcuccccuuccuggguucacgccauucuccugccucagccucccgaguagcugggacuacaggcacacgccaccaugccuggcuaauuuuuuguauuuuuaguagagaugggguuucaccguguuagccaggauaaucucgaucuccugaccucgugaucugcccgccucagccucccaaagugcugggauuacaggcgugagccaccacgcccggccaucaaauacuagaucuuauucguucuuucuaacuuaucuuuuuguauccguuaaccauccccacuucucuccgcccccgaacuccacuacacuucccagccucugguaacuaucuuucuacucucugucuccaugaguucaauuguuuuaauuuuuagcucccccaaauaaaugagaacaugcaaaguuugucuuucugugccuggcuuaaaucacuuaacguaaugaccuccaguuccaucuauguuguuguaaaugacaggaucucauucuuuucuauggcuaaauagguaagucuaugguuaccuuuguaagaaacugcugaaccaucgucuuccaaaguggcugugccauuuugcauuaucacuagcaaugaaugagaguucuuguucuacaucuugucagcauuugguauugucauuuuaaaauuuuagccauucuaaaagguguuuagugguaugcaauuguuuuaauuugcaguucucuaaugacauaugauguugaacaucuuuucauaugcuuaucugccaccuguguaucuucuuugaugagaugucuguucagaucugucacccauuuuuauuucaguuaguuuucuuauuguugaguuuuaauagcucuuucuacauuuuggauaucaguccuuuaucagggggauagugugucuugcagauauuuucgcccaaucuaugguuugucuuuuccuuugaacagugucuuuuacagagcagaaguuuuaaauuuuauuuuuuaaauguauuuuguuuguuuguuugugacagggucacacucuguugcccaggcuggaaugcaguggugugaucauggcccacugcagccucgaccuccccaagcucaggugauccugccaccucacccucuugaguagcugggauuacaggcgcgugccaccacacccagcuaauuuuguauuuuuaguagagauaggguuucaccauguuggccaggccagucucagaguccuguccuuaggugauccacccaccuuggccucccaaagugcugggauuacaggcaugagccaccaugcccgaccuuuugcuauaugacuuucgagguugaguuauacauaaaaggccuugcagugucuacccuauuagcuggaacucucacuaugggaaccacaagccaccauauugaaagucugaucauucuaggcagcugugcugaagaaauuauguguaggugccccaguccauaguccuugcugagccuuauccuuccagucguccccaccaaggugcuggacauauaggugaagccuucuuggacucuccagacaaauccauccagaggcuaaauaucacuaaaugcccucucuugauaauaugugaaacagaagaaucacccagccacuccuugccugcuuuccuaauccacaaaagcaugagauguaaugacuuggugguuguuuuaagcuacuaaguuuugagguaguuuuuuauuagucuauagauaacgagaaaagggguacauucauuuaacauuaaauauggaacaccugcucugugccggguauuguucuugcuuuaugguacuuaugaucaugcauguggagaagaggaaggaaauauaaaccaguaaacaaucugugugaaaaguauuaugacaaagggccaggcacggugacuaacguguaauccuagcacuuuaggaggcugaggcgaauggauuguuugcgcuuaggaguucgagaccagccugggcaacguggugaaaccucgucucuacaaaagaugcaaaaaaauuagccaggugugguggcgcacgcuugagcuauuuggggagggugaggcaggaggaucacuuaaacccaggagguugagacugcagugggcugagauugugccacugcacuccagccugggugacaaagagagacucugucucaaaaaaaaaaaguauuaugaugaagaauaagcagguuaaguagauagagaaggcaugggugcaguuuaauacaagauauaagauaguggggaaaggucucuaugguaagaugguaguugaguaggaccugaagugggagaguugguaagccacauucagcugugcccaugccuucucuauccacuuaaccucaucuguucuuugucaucuuuuagacugguuuauguguuugucucuuaguuuauacuucuucucuccucugggagagagaugggagagggaugggauaugucuugagaaagagcaugcuaggcaaagggaaccacaguacagaggccaugcagugggggcauacugaguguuuccuggaacagcaaaguggcuggugcaccugaauccgaacagguguuggggagacgggagaagcuggagugagagaguaucagugugccacguugugaagggucaguaggcugaaggaaggacuuuggguugaacuucaauugaaaugaagaaucacucuggccacuuauggaaaaucaaguuggggaaagaguggcagcagggagugcuguuuggauaauauagcagagauccugcagagaggugcuguugcuuuggacugugguggcagcaguagggugguaagaaguggucagauucuggauauauuuuuauauaaaagaaccagcuggagggcugggugugguggcucaugccuguaaucccaacacuuugggaggccaagauggguugaucacuugaggucaggaguucaagaccagccuggccaacauggugaaaccccaucucuacuaaaaauauaaaaauuagcugggugugguggcgggugccuguaaucccagcuacuugggaggcugagccaggagaauugcuugaaccugggaaguggagguugcagugagccaagauugugccacuggacuccagccugggcaacagagggagaugccgucucaaaaaaaaaaaaaaaaaaagaaagaaccagcuggauucuuuauggauuggguguggguuauaagagaaagggaguagaaggaugacucaaggguuuggggacagagugaguuauuuauugagauaaggaacauguaggaggcacagacuugaaggaaagaaaaucaagacagaaguuuuggguauguuagauuugagaugccuuuuugacguucacagggagaugcugaguaggcagauggauuucaugaacuuggaauucagagagaggucagggcuagauaaauacauuuguaaaucaucaggguauaaauacauuuuaaagccaugggccuaagaagaacacuagagagugaauguaaauaggaaaguggcccagggcaugacuccacauucagggucaggaagaucagaaggaaccagcaaaggagucucagaagacgcugcagggaagaacgaggagaaccaggaggguguugugcugcaggugccaaguagaauguuucacaugagguuuagaaagcuuaaauaaccugcucaggucacagaggugcagcuagggucuaaacuaacagucugaugccagaaugcaugcucuuaauuucuguuuuccaccacccaaaucacaaccaaaaugguuguuaguacugacuccgugccaggcacuguuuuaacaccuuuauuuauaaucauuuaauccuauuaucaucaucauuuuacagaugagaaaacugaggcacagggaguuauguaacauauugaaagucauaaaacagcugugugugcuccaaacuggcccucugugaccagaguuaacugguacccuaugcugucucccagugaaucuuuacuaccuggauaguuggaguaucaucaaagauaauauuuuauaagguuaaauaggaagcucaaaaagcaaauuaaauucuuuaauuagaaaaagaaaaaagaaaagaaaacuaagcaguggcaauuugaccucuuacuccguccauauugauuuuugugcuuuccaaccucaaauaggccaaugaagugcuaugugccuuuauucaggcuugaacaaaguacuugcaaaguugcuuuguucugucuccuccuggagugugacugaaaacagaauguaaugcugccuuuuaaacuaagucacaugaaagccuugguuucucaaggucauaaaaaugugaucacacagauugaaucccauccagugauuuuaauuuagcuccucuucaaaguuaaguguaggaaauaaguuauugcaucugagaaaaauuuguugcugaaagucaugugccuggaauaauagguuugaacuauguucauuuagaauuuacccugaauucacuuuauaaggagcuggaagcauauuuagaaauucagcauuccuucagaugugaugaugccuucagaugucuguucucagcugucuguuuucaucagcacaguugccuguuucucuugaacaugaccuuuggcaccucaauacugguggccccugagccuuuucuugccaccacacagauucuguccuuuguucccaaaguaaggcuaugcauuauacuucuggaaaaauaacccaguggcaguagauguggccgucaggguauucccuuuguuuucuaccugucacuucauucuaaucuugccuuugcuuuuccuguuagcucaccuaguuucugaaaaaucuaagacuuucauuauccuuauuuuggucuaaauuuguaaaaauccaaaccuacuaagaagggaauaguccugagaccugauccucagcaaaguaggcaauaaucguagucacagccauugucacuugguguauaggagauauuaaaagaagucuccauuggccaacaggaaugaacccaggucuccauccuuugccagccaucucaccauaugggauucuagccucagucagaagaacaugagugacauggagcaaaggcaggaguuagauaggaacugagaagcacuuggugaaggucacagcccaggucaccagaagacugaaaccuaauccaaguaccauaaaaggcuuccccucccccauaccuugccaccacaucaauagggauccuguauaguagcaggaaacaauuauacaacugaaugaaccacaugucucagaccuuaguuaagucucuaggaggccaggcaugguggcucacucaugccuauaauccccaacacuuugggaggcugaggcaggcauaucacuuguggucaggaguuugagaccagccugaccaauauggugaaagcuggucucuaccaaaaaauacaaaaauuagccagucaugguggcacacgccuguauucccagcuacucaggaggcugaguugggagaaucacuuaaaugcaggagguggagguugcugugagcugagauggugccacugcacuccagccugagcaacggagugagacccugucugaaaaaaaauggaggcugggcacgguggcucacgccuauaaucucagcacuuugggaggccaagacaaguggaucaccugaggucaggaguucaagaccagccuggccaacagugcaaaacccugucucuacuaaaaauacaaaaauuagcugggugugguggcgggugccuguaauuccagcuacuugagaggcugaggcacaagaauugccugaaccugggaggcagagguugcagugagccaagaucgcaccacugcacccuauccucagugagagagugagacucugucucaaaucagucaaucaaucaaucaaucaauccggaaagcugaagacaagggaaggagacaaaaacaaggacacccaaggaaaguuuagccucugauaccuacauuugcagcugcaacagacaauaaacacagccuaacuucuaaccagaugaacauaaaaccucagcuugaaggccuguguaccuguucacccuaaaggacuauuuaccuaguacaucaugccuggcuuucaacaaaaaacauuacaaggcacaaaaaaggcaaaaaaaaaaaaaaaauacaguuugaauagacagagcaagcaucagagccagacucagauauggcagauguuggauuuuucagacuaggaauuuaaaauaacugauuaauaugcuagggcucuagggcucuagagcucuaaaggaaaaagaggacaacgugcaagaaaggauagguaauguaaacagaaagauggaaauuauaauaaagaauaaaaaaguaaugcuagaauuaaacucuguaacagaaauaaagaaugccuuuggugggcuuaucaguagauuggacuugguagagaaauuaugucuagcuuauuucacuuagcauguugucuucagaauucauccaugucaagaugugugucaaaauuuccuuccuuuuuaaggcagaauaauauuucauuguacguguauuuucuuuguccauucauccauugaugaacauuuuggugguuucuagaucuucgcuauugcgaauagugcugugaugaacacuggagugcuaauacuucuuugagauccuuauuucaauuauuuuggauaaauacccaaaagugagauuauuggaucaaaugguaauucuaguuuuaauuuuuugaggaaucucuguacuguuuucuauuuuacacucccaccaacaguguacuagaguuccaguuucucuacaucuuugccagugcuuguuaucuuuuguucuuuuugugaauagucguaugaacugaaauuuuucuaugguuuugauuugcauuucccugaugauuagugaugagcaucuuuucauauaccucuuggccauuuauauguuuuauggagacguugaagaaauguuuauucaggucuuuagcccguauuuuaaucagguuauuaguuuuuuugcuguugaacuguuggaguuccuuacauguuugggaaauuaaccccuuauauguguuuugcaaauauuuucucucauucaguagauugccuuuuugcucuguuaguuguuuccuuugcuaugcagaaacuuuuuaguuugauguagucccacuugucuauuuuugcuuuuguugccugugcuuuuggugucguauccaugaaaucuuugccaaggccaauguuaugaagcuuuuccccuauguuuucuucuaggaguuuuaaaacuucaggucuuauauuuaaauccuuaauucauuuugaguugauuuuucugugugguaugagaguccaguuucauucuuuugcauauggauuuccaguuucucccaauaccguauguuaaaagacuguccuuuccucaucauauauucuugauacccuugucaaagaucaguugacugcauaugcauggauugauuuaugggcucucuauucugaauguuccauuggucuauaugucugucuuuaugccaauaccauacuguuuugauuaugguagcuuuguaauauauuuugaaaucaggacgugugaugccuccagcuuuuucuucuuucucaagauugucuuggcuguucagggucuuuugugauuccacaugaauuuuagucuuguuuuuuuauuucugaaaaaaaaugccauugaaauuuugauagcaauuucauagaaucuggagauugcuuugguaguauggacacuuuaacaauauuaaaucuuauaauccaugaacauggaauucuuuccauuugcuuguaucuucuuuaauuucugucaucaauguuuuguaguuuuuagcauggaagucuuguaccuccuuaauuaaguuuauuucuaaguauuuuauucuuauuggugcuauuguaaauggaaauauuuuucuaauuucauauucagacaguuuguuguuaguguauagaaacacaacugauuuuuguauguugauuuuguauccuacaacuuuacugaauucauuuauuaauucuaacaguaugcaucuguguguguaugugaucuuuagaguuuucuauauaucaugucaucugcaacagggacaauuuuacuuggauuugaauagcuuuuauuucuuuuccuugccuaauuauucuggcuagggcuuucaguacuguauuaaacagaaguggcaagagugggcauccuugucuuguucgugaucucaaaggaaaagcuuucagcuuucaccauugaguaugauauuagcugugaacuuuauauaugugaccuuuauuaagcugagguaauuucauccuaugucuaguuuauugagagguuuuuauugggaagggguguugaauuuugucaaacaguuauucugugucuauuaagauggucaugugauuuuuaucuuucauucuguuacugugguguaucacauugauuuuuauauguugauucauucuugcaucccagggauaaacaucucacuuaguuaugauuuaugauucuuuuaauguacugcugaauuugguuuguuaguauuuuguugacaauauuugugucuauauucauuaggcauauuggucuguaguuuucuuuuuugugguaucuuugccuggguuuggcaucaggguaaugcgggccuaauaaaauaaguuuggaaguauucccuuuuuuucaguuuuuuuggaagaguuugagaaguauuggcauuaauucuuuaaaugucugguagaauucaccagugaagcuaucugguccugggguuuuuuuguuuuuuuuuuuuuuuugaugggagguuuuugauuacugauucagucuccuuacuaguuuuaggucuguucagacuauuucuuuauuaauuagucuugguauguguauguuuuuaggaauuuauuuauuucuuccagguuauccaguuuguugguuuguaauaguuuauauaguuucuugugaucuuuuuuaaucucugugauaucaauugcaguguuuccucuuucauuucugauuuuauguauuuggguuuucucucuuuuuucuuaaguagucuagcuaacgguuugucaauuuuguuuauuuuuucaaaaaagucuuaguuuuauugauuuuuuuuccuauuuuuuguauucucuuuuucauuuaucucugaucauuauuauuuccuucuaucuacuaacuuugugcuugguuuguucuguuuuucuacuuaaggugugaaguuagguuguugauuuaagcuuuucuucuuuuuaaauguaaguuuuuacugcuauaaacuucucucuuauacuggucuugcugcaucuucuaaguuucgguauguuguauuuuuguuuucauuugucucagauguuuucuaaugucccuguugauuuauuuugugauccauuaguuguuaguguguuguuuaauuuccacauguuugugaauuuuacaauuuugcuucugcuauugauuucugauuucauuccauuucaucagagaaaauacuugguaugauucagucuuuuuaaauuuguaagacuuguuuuguaagcuaacacgugaucuguucuagagaauguuuugccagcacuugagaagaaugcuauugcguuuggguggaguguucuguauauguuuguuagguccauuugaccaguacuguuauucaaguuuguuguuucuuuguugauuuugucugguuguucuauuuauuauugaaaauggaauacugaagucucccaccaguauuauauugcuauguauuucuccucauuuucaaacucaaaaaucugugaguuuuugguuugcucuuugcuccuuuuuuuuuuuuuuuaauaaggaaauucaggcaguuuuuuaaaaagaugaugacgaugacaacucuuuuccuagaauuuuuuucaccauuuuauauuuaaguaaauuaugacauuuuggggcagucucccaaguaaguguuaaggugcccuacccccacucucuuggagccaaauaagugguaggggguggggcgagggacgggugcaaggggaggaaaagucaggaaggcuacugagagcauagagccgacuucagccucuguugggaagggaaccagcagucaagccaaauccuacuacggguguagcaaaacucaacuucuuucaauacgaauuugagaucuaagaguaguuuauucugguggagcaggcuuacccaugguuucagaaguuagagaggagacucugagagucaagcccugguuguucaagacccaaauaaggcaggagaaagcaggacauaggcagguuuccaagaaaaugagcccaauagcauucaagccucagugacaggccagguauagguacuccagucaguagucccagcugagcccaguaguucuagcccaagcuccagaugugaguuuaggaaucaccaaauaauuccagucccuuuauuccaagucacccucagauguucaagcugaggccccagacaucauggagcacagacaagcccuacccauguccagauuacugaaccacagaagccaugaggauuauaaaaaguuguugguuguuguuuuauaccacuaaauuuggguaguauuuuauuauacagcaguagguaaccggaauaaccaugaugacugguuuggcuaguugaaggagauucaucauuccagauuuugagggcugcaguaugaacagaggccuggagauaagcaagcauggcccguaucugggaacuauuguuucuccaacugaaggaguggcucacaugccagcaaacagcaccacuguaggcccaggggaugcagucagggucugcaaagugucuuuuccucaccucuccaguccgcacacaagagcagccaccuggucuugccucaugcuggcccagccacaccaauggcaaggguucuauuguuaacucagauuuuuuaaaaggacaaagaggagacauguuaggggcaggaugcacauuugucauuuuaaaauaucuccuuaaauucuuuucaaugaaacacaaauuugaauuacugaaaagccaucuauccaaguuuuuuuuuuuuuuuagacagggucucacucugucacccauaccagagugcaguggcgugaucuuggcucacugcaaccuccaccucccagguucaagcguuucucaugccucagcuucccuuguagcugggaucacaggcaugcgccaccaugccuggcuaauuuuuguauuuuuaguagggaugugguuuuaccauguugcccaggcuggucuugaacuucugaccucaagugagccacccuccucggccucccaaagugcugggauuacagaugugagccacugcaccuggcuucugaguucuuuuuuaaaacuuaguuuucuggcauuguugaacauucagcuauuaucuugauauaucaggaugcuguugguugccaauaacaggaacacugucugaaacacagaugcuuaaacaagaagugcauuuguucugucucauuucuggaaguccagagguagagcaggccauggaguugguugguacugcccaucacuuuuguugucaaagacccagauccuuuccauuucccugcucugacauccucaguguugaccucuuccuacagccaggagcaaaguggcagcagcagugcuauuauggacuaaauguuugugucccucuaaaauucauauguuaaagcuguaacccucagugugauauuuggagaagggaccuuugggagguacuuuggguuagaugaggucaggaagguagggcugucaugauagaauuaaaugcacuuauaagaagagacacaagagagcucugucucgcccccaccgucugaggacacagugaggagucagaagguggauaaauaccaaggaccccaucuagacaccacagccuuauauagcuuccaaagacagaaagagacucucuucuugagucucuguuagaagcaaggaaaguauucaauagacuuccccuugcaucuuguugacuaaaauuuguucacagacccauuccuaagcuaauuacuggcaaggguuauuauaauuguucuagacuaaggaagccuuuucuauggaagaccaaauaguaaggccaggcgcaguggcucagcccuguaauccuagcacuuugggaagccaaggugggcggauugccugaguucaggaguucaagaccaaccuaggcaacauggcgaaacccuaucucuacuaaaaauaccaauaauuagcugggcguguuggugugcaucuguaaucucagcuacucgggaggcugaggcaugagaaucacuugaacccgggaggcagagguugcagugagccgagauugugccacugcacuccagccugggcaacggaaugagacuguccccccaccaaaaaaaaaaaaaaaaaaagaccaaauaguaaauauuuuagacuucuuuucuccucuccccucccucucucugcucuuuaucucuuuaaauaugugcucaagagcuauacaacagcaggcuguggcuggauuuggucacuccuggcuuagauuaaucacagucuacucuggaaugaggcaagggguuauugccccaugaguuauacaagggagagguugauuacuaaacaaaauuggggucccaugaaaaggaagaagggagauggacacugaguaggcaacugcacgauugcuaaauuugguccaaagaaagguuaguagaugcagagaacagccaaagggacugaaucuggagacaacucuaccccagcaagguguuuguccugugacugguggguuaaaaugggaaugcaacaggcaaguuguuugugaugaauagguauugcuuucauaaucagaaaaaaaauuaagaccaucuuucagaaauguucuaaaauucgauugugugaugguugcacaacucugaguauacuaauaaaaaccauugacguguacauuuuaaguuagugaauuuuaugacaugugagucauaucucaguagagcaguuaaaaaaagaaucucuugaauuccaaagcuuaaaaaccauggaccgcagcucuguggugcuugcuguuuagaggcaagggcgccuuuggcuguguggcuagcuucacggcuuucacggauggccuuggaaaucuucccauaaugggaaugcuuuuaaugaccauuucuuuuuacauaugugcuaaauauuuuucaggccaugcaaaauauuuuacauuuuauaaucaaagaauuagcaugcuuacaauaaaaauaaaacugauacagaaacaguaaauuacaggauuuuuuuuugucccuuuuaacccuuuuuaaaguguauuuucucuuuuuaugcaguaggacucauucacugcauaugucaaugcagcccagugguagacagucuucaggcuggcuuugcccaagccucagaugguaccagugggcucugacuucucuguuucccucugaucuacuccgucuggaucaacucaguucuuaggcccugcagcuggagaauuuuucccuggcaugcugaaucagaggcugucauuggcucugaccacaucauaugcccauccccuacacaaucacugaagcaagggcagaguccauuggcuuuuaccuggaucucaugcuucacucaagcuguauggguuaggauaggggaguagugguucgucagaauaaaacuggguucuguuaaugguugccagguggcagacccaacacuuuccuucucugcaucccugacaucuuuuuuuuuuuuuuuuuugagucagagucucgcuguuguugcccaggcuagagugcaauggugcgaucucagaucacugcaaccucugccuccuggguacaagugauucuccugccucagccucccaaguagagcugggauuacaggugcccaccaccacacccagcuaauuuuuuguauuuuuaguagagacgggguuucacuguguuagccaggcuggucucgaacuccugaccucaggcgauccaccugcucggccucccaaagggcugggauuacaggcgugagccaccacgcccgguccccugacuucauuacugccuguuguugcccauuucauucuuccuucuuuaguucuauguggcauacuuucccuuuaauuaucuuuaacuuauaguucucaccuuugaagaauagcaguugagcuucuagugacagacuuuuggaaaaaccaaguuuguuuuaaggugggauuugacaaagaaccuucaagcuugauaacugagugggaaagcuucccuucagugagggaaaagugucugcagguaggccaggugaaugagacacccuaaaacuugaaaguuaagcaggaaauaagacuuuaauguuuccuggggccucgugucguggcaugccuuuuaucccagcacuuugggaggccgaggugggaggauuacuugaggccaggagauugagaccagccugagcaacauagcaagaccuuggcucuauaaaaauaaaaauaaguuagucaggcaugaugguacacaccuguaauccuagcuacucaggaaacugaggugggaggcuugcuugagcccaggaguugggaaauacagugagcuaugauugcaucacugcauuccagcccaggcaacagagcaagacccugucucaaggaaaggaaaaaaauaauugugugugugugugucuguguguacguguguguaugcacgugcacgugcuuucuguacuuuuauacugaaucuauuuugaauuuggguuggaagcuuuagaauauuaccuuaaccuacaagagagaugugaggaauaguucugaguccccuaucuuuuauggcuuucaacuauuuuucucacuuuuuuucugacgguuuuccuuugucaguguaaauucauuuugauuugcuuguuauuuugauggacuggaaauguguuuuuaaaucugaaaacaguacuaguuucaaauuuguuuucuuuacuguagugauucucagauauauuuuaguaaaauuauucuaccuuuuuuuuuuuuuuuuuuuugagacggauucucacucugucacccaggcuggaaugcaguggcaugaucgcggcucacuguaaccucugccuccuggguucaagcgauucuccugccucagccucccgaguagcugggauuacaggcagccaccaccacacccggcuaauuuuuguacuuuuaguagagacaggguuuuaccauuguugcccaacagggucucgaacuccuggccucaagugauccacccaccuuagccucccaaagugcugggauuacaagcgugagccaccacgcccaacccuacuuuuuuuuuuuuuuuuaaacagagucuugcucuguugcccaggcuggagugcagugacgccauccuggcucaccacagccucaaccucccagguucaagcaguucuccugccucagccucccgaguaacugggacuacagacgugugccaccaugcccugcuggaauuauucuacauucuaaguucauaggaaaauuaaucuuugaauuuugagaaccgucucaaaauugguuuacuaaaacuugggcaccugcuauauaguuugccuacuagaagauaauaaaaugaaugagaguaccaaaugaaaaauaauggaaaguauggaaguugcugaucucgacagauucuuaaaucauggacguauguguuaaugguuugauuuuuauauuguguacauauauuuauuguuuacuaguaaaaaauguucuaauuuaugugauaaauggaauauaucaauacuucauggcaaaaauuuuugugaauuucagguguucugccaccuuaaacguugaaaagcacugcuuuccaggauagccaaaucccuaaaagaauuucuggucaugagacugauuauccuuacugaucagcugugucacacaucacauggacauaugauguccaugugauggacuggacugggcaugguuguuuuaggagcaugacuggcaucuguaaucaugaguacacuuggaauccguuucuuccguuucgaaaaguccacuuacccggaauugggacuugucugacauccccuaaacucugacacugacaaaagaggucauugcaucugguucccagcuacuuccauacuuuccauuauuuuucauucgguacucucauucauuuuauuaucuucuaguaggcaaacuagauagcagaugccaaagcuuuaguaaaccaauuuugggaagguucucaaaauuauaaagaguaauuuuccuaagaacuuagaaaagaccacuuuacucaaauguagaauaauucuacuaaaauauaucugagaaucacuacaguaaagaaaacaaacucaaaucuaacaggcuguccuaggagagccaguuagcuuuuguuguuuucuugcuuacaucccgccuucccuucuuccacacuuaauccauuuauccauucauaauacuuguucuuguccacuuucauuuuucuuauuucuucuuuuugucuuuggcuuccucuuagcagcuucuuagacaaacaagcacuugaauaauaaauugauucagcaucuucaguuuaauacagggcagguugagcaucccaaauccccaaauccaaaguccgaaaugcuccaaaaucugaaacuuuuugagugccaacaugaugaauguuuauuggagcauuucagauuugggauacuuauauuccaaaaucaaaaaauaaaaauuaaaaaaaaacacaauucaaaaucugaaaaaauucaaaauccaaauucccaaccauuucagauaaaggauacucaaccuauauugauccucuaaggguucaacagcaaaccagcccaauccuuucagccauccuauauuuggugucuaccaugcucagggagcaggaggcaugauauucauaagccaggcauuucacuguuaucauggaaguagaccccgagcaaagucagaacccaggaugggaccugcccuacucaucugagugcccccucaguggaggauaacucuguacuagacccauucccauucaucagacuaaauuggccucuguggagacucacuuauccuagagaagugacauggcagcuuauuucagggucucagcauugccugagccgaaauucaguaagccuauccaccgugccaucaugccuucuuguuucccuucucccugaauccgcucaccuaguguaacccucaccagcccagucugagccuccucgucuccucucuuaaacacacguguauauauggauagaaacagacagacagacauggaacaacacagcagagucugauguuuuguuuuaugguccugcgucagccguuaauccucacaaagauaauucuaccuugacaacaccagauaccuuuucaucaucaucauuuaaccucuagaguuuaaugauagaacugauuauaaugucuaguaaauucuuuaugauauguuuguaguauuuuaaaacuuuuugaaaauacagagccuaauuguauuaaauuuggggaaggcauaaaguuguaugauaauaagacauuuacccucguugggccucagaaaaugacaccccaaagggaaggccccagaaguaaguuucucucugaucuucucccacucuccuguaccucagccucauuuucucagagguaagcuuuagaaacuagaauuccuuuuccucaaagugaaucauaaaaaccugaacccauuuuccccaaagccagccauaaaaccuaaaaauauuacucgaauuucccuccuguauuucuguggcagaguuggccguaaagaaauucucuaaccuacccuguuugauugugagucguaagacuccccauuucagaaaggguccugccccauaccagggaggaaggaacacugcacagagacgccaagaagaaugaacagacaggccuggcagaguuuccccacucagucuguuagcauucaaucauacuuaccuucuuggccaagcacaguucuacaugguugucuguucuucacugaacuucagcauaaaaauggaaaguuuucccaauauccuuaggucuucaaucugaaggcugccaugucacagaaaacaaugaucaaauaaaauuuguuuuguuuucuucuguuaaccuguuuguuauaaggguguugacugugacccuuaugaugaggaggaaagggaucaccccuucugacccuacacccuccacauuuuuuuuuuuuaguagauauuuaaagcggucacuuuagguagcuggcuccauaauaagcccuggagaucuguuuugcauuuuauuuuauuuauuuauuuauuuauuuauuuauuuauuuauuuuugagacggagucuugcccugucacccaggcuggagugcaguggcacgaucugggcucacugcaagcucugccuccuggguucacgccauucuccugccucagccucccaaguagcugagacuacaggcgccugccaccacgcccagcuaauuuuuguguguguguguuuuuuugguagagacgggguuucaccgugucagccaggauggucucgaucuccugaccucaugauccaccugccucggccucccaaagugcugggauuacaggugugagccaccccgcccagccuguuuuguauuuuauuuuaagagacggagucuugcuauguugcccaggcuggucucaaacuccuagguucaagcaguccucccacauuggcuucccaaagugcugggauuagagguaugagccaccauccugcaugcuguuuaugcaucucaguuggagaacucagccagcacccuaaugacuucacccuucuauggcugcugauuuggaagaaacccagggaagcaagaguaaauuuucccaaucuuuaccuguccagucaggaggauuuuuucaaccugaaaaaaacagaaccccuauucgguuaaagggguuaaguuugggauccauagaauuaccaaagagagaaugcuauucauuucauaaaggaugucugccaccauuacaaaugauccuuggcuauuaaaaaugggugauugguucaggcgguuuaaggguggaggaacaaaugcgugauggguucucucuuuaaggguggauggaaauaccuauuaaaaauucucccaagccuuccagcucuucauuaagaaacuuuuuuaaaaagucauaugggagaggguucguucugaaaauuaaaauggaacagaaugaugaggucuauucagaggccaaaguggggaaaaggcaaggguuuugcuugugcagccugugcuacaaugaagaggaccuuaguacagacggauggugcccuaccaaauguagcccauaauucaagcugucagcuucaucacacuguuuccagguaaagagaaggagcccuuguuuccuggguaaagagaaggagcguuguuugcugaccccugguccacagccugccguggucgccucgcugugcuggccuuuguguugcuguccccuccuucccuccuuuuuggcauugugcucccuucaaguggcccccuggaagggaccacccagggggcugcacaauggagauugagguagccacaaaaacacagguuuuguaagacagcccuuuaaaagaaaaauacuguuuaacuauguauguguuuguccuuucuacaacuguuuuguguggcaaacaaaacccuguauacaaacuucacuguggccucacauacagcuguuccagccaucgggugucaggcuugagauagucgcuuccaguuuauuuucccaggacacuaauucuugauguaguuucuaguuacaugcuuagauuuauggccaagaaaugugauaucaaaacaagcaaauugcgcuggcuuuauuaaacuauuuuaucaguaguccucacaguugacggcugggcauugcuccugggugaaauuugccuguaaugcugcuuaacaaaagcuagcagcccggaauucaguucucaauagccauuuacaccucuguaaaaggauuagcgcuagccaauuguuacacuguuuaaaucuuaauuugcaucacuauggggguagagcuucuacagaccucucugguucccaguugaauuuguguaccuguggaugggagagucacuagagauuucucuuauugaugaaggugcuaaauugccucgggauaaccgguaugccacaaauauugaauuagccucucagguuccaacugacagacaauagucugcuuugguucauuaguuauauuuuauagcaguugugguccuugaguauuugguacuuggaugcauucuucuacaucuguuucaaguaaaaauuuucaugggucuuaggaggauuuuaaauguuguuauuuguaaguagcaaauuuccuugggaauuauaugcaaaacaaaaaacagaacgugauaguuuuaaaaguaaucuuuuucuauccagaccauauguuuuuaaagaucaaagccuuuuuauguuuagaauugcccugucaauagacaauagaugaaauugucuuuucauaauguaaagcuggaacuacacaucaguuucagaugcucagccuaggccugagugaauucuaauuguaagauggaggaggagggagguggacagggagggaaacuagcaggucaggagcauggcaggaagagaggguauuaaacuacauuaaauggaugaaaauugagggaguuuggaaugcuugguuggaaugaaaacaaagcuugggacauuuuaaugaccaccuuaucaccacuuccaccauuuuucccucauaaagcauuuguucauuuauucaacaaauaguuacuagguauccaucucaugcauaguguuagccacugaauuuagugauuauugcacguggaguaaaaagaauugucuugguugcugagaguagucaggaugguaaauauaauuuaaacagacuuugcagccugcaaguuuuccauguaauagacaugccaggcagaaggaaagcagacacaacugcuuauaaauaaauauugcccuuuuaagaaacauuaaagaaauugaaugcacuggguggaagggcuuuuggggaacuccccaggaaagguuguuuugagucuauggcgaaagccaggccagccauuccuggggaggugagccacagcaaaggcuuugguauuccaagaaagcaaccacaacuaaauuauuuuuuguuuuuuaacuuuggaaaauuuugaggcagugacuggaugcucauugauccucacagaggcuaaagaaaucgucaugguuuaaaaauuaaaauaacugaaauaaggaagccuguucauuuugcuuuaauguaucuuuguacacaugcuaaaagagaacagggggggaagcauccagaaaggaacuuacaccuuaguugauuuguaccugagaagaauuuuuaguauaugagguuaaccaacaaguuuguuuuguuuuuuggagaggagguagggcuuguuuaaaagaaagaaaaaaaaaaaaagcagccccaaacucuaccaguguaacaguaaaaggaguuuagugagagaaggcaguaaagcagcccggagcucccuuaucgagaauguuuuaguuucuucuacucacaaacccucuuuguugggaacuguccaaccccagcuucugccggcggggagggguacacugggauuggaagaagggaaaccagggcuccaaggagcaggaucaggacggaagguagggccaaccccaugaaaagacagaaguugaguuuccuagccaguuuuucugugucacuggaaaacaauuggaauuugaaacaaagguuggcugccuugccucuucccaccuuucugaauacaagguauuucugaauuacauguucaucacuuagggaccaccucuccaaaugauaccauuuuguuguucauuucuggauuuuuuuuuuuuuuuuuuuuuugcgggggaggguguuauuuuguuugauuauuagcgacuggguuauacuauguugcccaggcuagacuccaacuccugggcucuagcgauccuccugccucacccuucugaguagcugggacugcaggcuggagccaccgugccuggcuugcuucuuuugaaauacaauuuccuucccuaaaauuuuauucuggaugugaucaacuacagugcucugugaccuucagucucacuaaaaauauagugacaacauuuuauaaaacuucuaaaaaguaauauguaaauuauguaaguguaaguuucccugaaaaaugaacugacaaaaggcagauuaauaggagaaaagacuugcaaaauuuguuuugauaugcacagcacagggaaauugcagaagaaugauuauccaguaacccauugggguauggauacuuuuuuacccuucuucauaggggaggggagauggggaaagcuggcaauuuggggcauaguaaaugauuuuuaggggaaaaugaauggacuugaagaacauacaguggccugggacaaagucuguguggccugcagaguagacagugguuugugaggaaaucuguccagauguguugacagccuuaguccuucuuucugcaguguaaguugaguuaauaaaaauucagagaagggaccauaggugauuguuuucuucuuccagcagguccagacuuuaggcagauaaaggaacuucagagaacaauugcauccugugcuuugagagacaggagggaggugggggagggaaggucagagagaccuugcaucucugcuucagcccagcauuucaaaaugcuguauuuugggauaucagcuucugagccccaauguuggcaaauuuguuacuauuuaugaucagagaucacaccauuuugagauugcuauuccuuggagaaaauaaaaucugcaaaucaagccuauugugccgcaacugaaacacaaaaauuuaacucaccaaaaagauaacacuggcaggaauauguaaaaguuaucugauaggguuaaggaaaaguuuauuuucuguagcccucauacagggucauuuuugccaagaaguaauucucaguuugcaauucugagcccagcacuuuuucucucuuacucacuuuaaaaaucccuguaccuugggaucuagaucuagaaauaccauuugacccagccaucccauuacuggguauauacccaaaggauuguaagucaugcugcuauaaagacacauggacaccuauguuuauagcggcacuauucacaauagcaaagacuuagaaccaaccuaaauguccaacaaugauagacuggauuaugaaaauguggcacauauacaccauggaauacuaugcagacauaaaaaaugaugaguucauguccuuuguagggacauggaugaaacuggaaaccaucauucucagcaaacuaucgcaaggacaaaaaaccaaacaccgcauguucucacucauaggugggaauugaacaaugagaacacauggacccaggaaggggaacaucacacacuggggacuguugugggguggggggaggggggagggauagcauuaggagauauaccuaaugcuaaaugacgaguuaaugggugcagcacaccagcauggcacguguacacauauguaacaaaccugcacguugugcacauguacccuaaaacuuaaaguauaauaauaauaaaauuagacaaacaaaaaaaaucccuguaccuuaauuucaguguucccaauagccuggaguggaguugucuccuaaauccugugugacugaaaaugaagcuagaaagcaauuauuuuuaauuuggccaaauuuuuuacauuuauuaugugcuuuaacugucguuggauaagauaagcuaugcaucuuuaaagugccauuuguguccacaaguuacuugucauucagcagguuccuccaccugccagaccucacagagaacaaggugaugguagggcuagcauguuggugccagagacuggacacagguuccucaggccagugcccuucuagcuggaaugauuuuggcaggaacgcacauagaaaaaggaauugaggucuugaguucuaaaauaguuacaguguuucuauaacacauagucuuuaauauuuaauuccauacagcguuugaauucuuuaguugaguucuuuugagcaaaagaacugaugaauauuuuauaaacuaaagucugcuaucugggaagagcacuguuagaaauccucagcauaaaccagcucaucuuuuaguccgagaaaguucugaguuagaguagaucauaagcucugugcauagugcuuguggccagcugauugaucacccaguaccaagggggaaacccuggacugguguaacaacaaccauuauaaaaauacugucagccaggugugguggcucaugucuguaaucgcagaacuuugggaggccaaggugggaggauugcuugagcucaagaguuugagaccagccugggcaacaaagcaagaccccaucucauuuuuauuaaaaaaaaaaaaauacuguaaagauaagugugucauaugaauuucuuucaucuggguuuaaguuucagcuugucauuugacauguaguaucauuaaguuguaugcucagcauugugccgaaugcuaugagaaauaaaaguaaaaaauuuagaagugcaguugcuauucucaccaggcuuuugcucuuguugagaagacucggcagaggugacuuaacuauggaauagcacaagguaagagguaagauggugucucuuuugugcuaaagaauucagggguaagaaagaucccuaugaguaagguagucagggaagcuucuagagggugaugagaugagcuagucuaaguaagccugacacuuauauugauaagaucggcaaagaagaaagguuaucugggauuuguccuggcaggacaaucaagcauuacugagcacuggcaugcaugccauggugguagugaggggaugucggaggagugcagaugcagguaauaaguaggugcauucuauggaagaauuuaaaaacaauaacgagaccacuaaagucagucugccuucuguugucaccauuccuaaggauggcaaagauaaaauacaccuuaccauggagggaaccugcucccacugcagcauccaccagcaccauggagugucagccaguuuccaguacugcacaguacuaaccuuuuagaagauauccaaaaacauuaagccaugguccuugcuccagguuugcauccugguuugggaagugggacuaaagggaaucuaagcuuggagaucauaagcugguggccugcaggccuaccuugggcugcagauagguucucuuuguccugucaguggguaggcaaccuuuugaauuagucaccacauuuuaaaaauugggagcuguuaaauaaaaacaaaacuugcaauuauaaacuuccagcuucucuuaaaaacugagaagaucuagguucacugggacacacacuccucagggggagcuuuugauggaggcacuggccccagcucuccacagccccaccccaccagcagccagcauggucuccguuaccuucccuguagucagcugagugcuccccaggugagcgaugaaggacuguuucuuccucccuugccucacccacuuaccugcucuuccucugccaccuacagcacaaagucagucuccugacuggucucugggccucaggucucucuccucaccaacuccauccuugcaaggcugccaggcuaacccucugaaaaacacugcuuucgagaaaccagcaauggcucagaaauccacaagcuuauugcuguauucuuuccagaguuucauauugaauuuaauuuuccauugcuauccuacuaugaccaacagcaaccccuacccagccaaacuugucucccuugcugguccccacaccacucuuacccugucauuucccaucaccuuugccugugucucuccuuaguuucaaaugucaucuccccuucucucuaaaaccugccuggcucacguuccuccuccuuagugaagccccugagacuccagugaucucucugugucuuuaccgcuucauaauuccugauugucugauggccugcccuauaccucucaccguugauuacaggcucucuuuuacuacucugaaauuggcucaccauuggugggaccucuuaagggcagcuguuauucuggaaauugagugaugacaagauaaaggcuuccaggaagaauuaggauccagauuuugccuaggcaauaagagguauucauagguacuauaagucagauaggccugaagucuggaagcuuuggggcagcagaacccaggagugaaggacccaacucggggucugaccuacaagaacugagaauccaggcuuagaguuuagacagaagccugggaauuggcaaggagcuggagcaccaacaguguggauaagggucaggaauagcacuugaaucuugugugccuguuauuauuccuucccagcauaaagguacacuucagaguagggcuaagccugagucugcaguugucacucacccuccaauagauggaccacaucuccuucauccuuaucacaucaggcacauagccaucaacuagguccaguaacuucaccaacuguagugcuauuuacaaauuaguaccuugcaaauuaacauauugcuuuauaaguugcuuuguaacuaaucuucauuuucuuuuugggguguguguugaauauucccaacuacaaaugugaacagcuccuuuaaaguagaaacacuguuuugucuucuccuauagcuuuuuagaaucaugcaucccucaaaauagucauuuuuuaaaagaugguaacuaaucuauuugaaggcuacugugauacaacgacagaccuaaccuaaaacagugaccaaauuuuuagacucuuaucacuuacucaguagacuggauauagauaauaaaagauaaaucccucuuuccaugccuuccuauucugauuaagaauaaagaaaauuugacugcaauaggaucugaauggaaaacuaauagucauuuuucuacauucagaaauagaggauguaaccuauacuucagccagaaguuuucaauuucuuagcagugacaauuuaaguaaauuucauacgaguuguggggaucuaacuuuguuaugauugacaauauaaaauuagccuuuucugcuguuaagauuaucuagcauaccugucauucagguggaauguggaacgagauugcccagcuguggauuugaacaucauuaaagucaacaaaggguuaaaaguuacuuccucugauggauuuaaaauugccgcauacacgcaaacaaguuuuucaaacugccccauuuuaugucuuuguugagagacaguauaguugcugcauuuuaauguccagauuauauuacagauauauuucaguaaaccaugaagaaccaucauagauucuagaagcuggugaucugugcuuaaauaagcaucuccugcagcaucuuuuuuauuuuauaggcucuguaaucacaauggcauucugaaagaagaccuugaagcucacagagcagcuguccuucaccagcucccaggacuccuaccuggggguggcagcuaugaaaagcaagucagggcuuacuggcuugacauugcugucguggugggauggccauucuuguuuccgaaugcuccaaaaucaaaaagaucacaaaguugcaauccucuuauuaauuuuuuauuuuauuuuauuuuauuuugagacagagucuugcucuguugcccaggcuggagugcaguggcgugaucucagcucacugcaagcuccgccuccuggguucaggccauucuucugccucagccucucgaguagcuggggcuacaggcgccugccaccaugcccagcuaauuuuuuguauuuuuaguagagacgggguuucacuguguuagccaggauggucucgaucuccugaccucgugauccgccugccucggccucccaaagugcuggaauuacaggcaugagccagcgugccaggccgcaauccucuuauuaaaauacaucugcacuguuuacuagcagagaauagauuauuacucaggaguggucaguagaugcaugucugugaaagccccucugaagggaccuuguuuggcuggcugagugagugagugaguggcuuugggucugcuuagccuacaacauagugcuguucuccucaccugucaugugccacuuaggcuguuuuauguuaaagauauaaauagggaggauauuuacaggauucugcuuaaaucuaguacacauugauucuaucaaaggguggauggaaaucaggauaauagucuuuaaagggacccugucacaagaaaacuucaccggauuaaguggcuuuguuuuacauuaccuucugcgucuguacuaguaaucuugaagcuaugggaaaugcuggaaaugaccuuccuggucaguagcuuuucaaccuaaggcaguaaagggcaaugccagaaaacccucuuucaguuuuuauccugcagaauaaaaaccacggucuuaaaauaauccuuuacaacguaguggaagaagcugguuugggaggaguccuucugcgcucucuaggucauuuggugauuguguguuagaaggcucuuuaaucucccguuucuuucucacugccuuuuauaucuguuuguauacuauuuggcauaaaccacaguugugguguauagcaugggaaggauauaugcauuuauaauucucugcgcaaacugaguuguuaaacuaaaugauucauuuugugacucucuuaaucuaggcugcccaacugugauuaugggugauaagccaugaugucugcaccuacuagacuaacgauuguuagaguuucucagcauucauaauagagcauugauuuccauuaugaaagguuguguuuuacaugacuauugaucuacaguuauguguaaaucagucuuccauaagaaaugauccuucuuuaugaccaccacaaauuuuaaaauuaauaucuggagucuucaaaacuguuucuuuaccacagucauuuuuuagagccagauaaagaagucaagaauguucucugcugucagcauuauguucugcuacagcuagaauugcuguauacauugugacuggguaugcuguuuaacacacacugauuaucacugguucacucucuagccuugaaaaaagugccaaguguuugugaccuuugagagacagcagucaggucuuuaaacacagauucuuccuaauggauuuuagucaccaggcugccccgcugcccuccuugcucuagcuuccucuugugccccuuagcacccagaagucccugcugggaacuccaaaucuaagugaaauagaccuaucugcuuugugaucaucaccuggccaguuugaucaaccauugcagaaacacugguuuggagagaaugauuuauucuuguucuuuaaugguuaauaacucuggugucauagaauuauuuuuuucuuuuuuuaagacagaaucuugcucugucgcccaggcuggagugcuguggagugaucuuggcucacugcaaccucugccuccugagcucaagagauucuugugccucagccuccugaguagcugggacuacaggugugcacuuccacaaccugcuaauuuuuuguauuuuuggcagaagaugggguuuuaccguguuggccaggcuagucuugaacuccuggccucaagugaucugcccaccucugccucccaaagugcugggauuacaggcaugagccaucacacuggccuagugucauagaauucuaauccaggcaggaaaggcuuugacugguuacaaaauccuuaaaggauuguuugguguagcagcagcucacaucugucucuuuaaucuugaucuguaaaaugagacaccugcccccauagcauacucuagagcagcagucccuaaccuuuuuggcaccagggaccaguuuuguuuaagacaguuuuuccauggagcggguuuagggaggugugggcaggggcaugguuucaggaugauucaaguacauuacauuuauugugcacuuuauuucuauuauuauuacauuuuaauguauaauaaaauaauuauacaauucaccauaauggaaaauuagugggagccuugagcuuguuuuccugcaacuagauggucccguuugggagugaugggagacaaugacagaucaucaggcguuagauucucauaaggaacaugcaaccuagcucccuugcaugcacaguucacaauaggguucaugcuccuauaagaaucuaaugcucccccugaucugacaggaggcggagcucagguggagcuaaugcuccgcccuccugccacucaccuccugcuuuguggcccaguuccuagcagaccacguaucaguaccaguccuuggcccaggcauugggaccccugcucuagaagauaaugugaagauuucugaauuccugcucacaaaauaaagcaucuuaagagaaaaaaagaacaaaccacgcuugucaucauuauugauuuauguuauaucaaggauuaagaccuucauaugggccagguggcuaacgccuguaauaccagcacuuugggaggcugaggcagguggauugcuugagcucaggaguucgagaccagccugggcaacauggcgaaaccccaucucuacaaaaaaauacaaaaaaauuagcaaagugugguggcgcacaccuauagugucaguuaggaggcugaggcaggaggacugcuugaguucaggauguuaaggcugcagugagcugugauugugccacugcacuccagccugggugacacagcaagaugcugucucaaaaaaaaauaacaaaaagucauaugcaaaguuuacuauuaucauguggaagaccaagcuauuguuuuugacaacuaugaauuauaaaaauaugauucaugugauuuagagaaauugauuuaaaaauugcucauuauugucuucuggaaaacauuuuaauauaaaaaugauuaauaaguauuuuaugagaaacauaaugagacuauccauuuauuuuuuuccaggugcaacuaauucucuauauuaguggcuacuuucagauacguuucccaauuguguucuuaugcucauacugaaaaauugagucggcuuuguauuguuuggauuauaguauaugaaaaucucuauuuuagucugccuguguucagaauuaaauucaggguauuuauuacucugcauuuaaaguuaggaaauacggauacauuuguuuaaauuucaccuuucugauugaaagcccuuucaaguacaugaaauuaauuauagacaauucaaacuauauuccuuuauuacauuuuuaauuaaagaauuaccugacauuaaacuuuguuuuuuuaugugucaucaauguuauaaauuuuccaacguaaauuagacaaaacagaaaaaucuccuuuaaauccuuuguaccacuuugcacauuuucugaugugguauguuuuuguagagccaugggcgaagcuccauuuagggaagccauggcuguugcacuucuugccugaucuaucccaaaagaaaucugcaagucagcuuccuuuugugcuuuaaggguugccuuaguuguucagaagucacaaacccuaggugcuguaccuccuucaacagcucauuuuccguuugacuugggcaagucaauuaaucaauuuuauccuuuugugggaaauaaauauaauaauuauaggaaaccuuagcuaguuuuucaugcuaggacccaaaggauagaugcaauugggugguguauuaguaacaagagucuugccuucauuuugcuucugcagaaaaucuuguguauuagccaccagagggacuguucuuugauaauuucacucacuuagcuauuuaacuaauuuaauucauccaaauuaaacuugcuuucaagccaaaagcauaguugacuuacuuauuauaagaaauguaccugcugaaugggcuagaauuugcugaugacuggucagugcauuuucccagcagggcagucuguuaagaaaccaaauauagaugcaaaggucaaaacaaaggaauuggguaguuuaaugacaucauugcgguacgguggcaaccaagaaaggcaaguugcugaaaggucuuucuaucaaacuagucagaggccuuagaaucaaaggauuccaaugacucaucucacuuuauucaaguccuggaaaaaaauaggguuaggucaggcacaaguaauaacaauuaagauuuauugaggaagguucugaacuguaccuagacuuacuuucuuuuccagagauuuuauuaugaaauuuuucaaacauacagaaaaguaaaaggaaucauaggguggacauccauauacacaccgcccagauuguacuccugacauuuuauugcccucucauauuuguuuauccauccuuccaucaauccuuuauuuuuauacuuuucuaaguaaguugcagacacuaauauacauuuaacuuuuuacuuugacauuuuuaaacauucgaagucucauauacccacuacucagauccaccaacugcucacauuucaucagucuuguuuuaucucucucccuaacgcuuuuuuucuugaguaguuuaaaacagacaacauaucauuucacucacaaauacuuauacaucuaacauauaaggauuuaaaauacuaucauuuaacauaaucaacaaaauucuucaguuuaucuaauaccuaguccuugucaguuugccuugcuuaucugaaaaauuguuuuucugcguuuguuuuguuugaaucagaguucaaauaagguccacauauuacaauuggcuaugucucugaaaccucuuuuaauuuugugacauucccucccuccuuuuuuuaugcuauugauuuguuggaggaauugggucacuuacccuggagaauuuacaugcucuauuugguugguauguuuaaccaguuccucuuuacucuuuauuaccuguaaacuggugguuagauccaaauaugugauuaaguuccaggccaguuauuuuagcaagaaaaugucauggguggugcugauauuuaaaaccgggcagcacauaauguuuuguuaccccaugguuagugauacuaagaccgaucuguggguucaaaugucgaaagguugaugacuucaggacagaaguuuacuauuauguaauuuucacaaaauuaugaccauuuccuagauacaucauuaauuuggacuuacaaaauggugacuuuucuaauuugaucauuucuucugcauuuauuggaagaacuuuuccuugucagcuacuuggugacucugaaauguauuuuuugaccacaaaagcaggauaaaugcuuuauucuauuucuuuauuuaccaauuugcagaauaaugaauuguugcccuaccagccuccaaagguuuuaaaauuuauuucuauuuugucuuuacugugguuuaaaaaaaaacauaaaauuagccaucuuaaccauuuugaacugugcaguucaguaguguuaaauaucuuuacuuuguuguacaacagaucucuggaacauuuucaucuuacaaaauggaaaaucuauacccauuaaacaacucuccauuuucccuuccccccaggccccagcacccaccauucaacuucuaucuuuaugaauuugacuguuuuagguaccucauuuaagugggaucauacaguauuuguccuuuucugacuggcuuauuucacuuagcagcacaauccccuuaagagucaucuauguuuuuuuuuuuuuuuuuuuuuuuuuuuugagacggagucucucucugucgcccaggcuggagugcaguggcgggaucucggcucacugcaagcuccgccucccagguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcaagauucaucuauguuguaguaugugacaggauuuccuuccuuuuaaggcugaauccaaagguuuauauuuuuauuuuuuaaauuuuauuaauuuauuuauuuuuagaugaacucaaggauuuucauguauucccuguguuucaguccauugcagucaguauccuuuaggugcuuaaauugucccaucuuugacagugggagcuuccuaagauauccccuccccaccuucaguucuuuugauacaacuuugagagcuuccuuacuuucugguacaacaagauguuucagguucaucuugugcguuuccugccccagaccugaauagggcauuucuuuaaugaacuuugguuccuuuuaguacauaaauaccacagccugagcagcaauauaggcuuauuuuuuaacucuuuccuaauaucuuaauuuuuaaaaaacuguaaguagaccaugguaagaguguaacaaaacaacaacaacaaaacaucugcuguugagaugaaaaugugaucuuuuucucuucacuacaugugggagacugaccaucuaugcagugauucaaaaccauuguugugcuuuagaaucacucugugagccuuaaaaaucccacugaccagaccaggcgugguggcucaccccuguaaucucagcacuucaggaggccgaggcagguggauuauuuaagccccagaguuuacgaccagccugggcaacaugaugaaagccagucucaugauccaaugagacuaaauaaauaaauagauuaaaauuuuaaaguaaaauguuuaaaaaguccacuggccaagccauaccccagaccauuuuuccuggacucuguagagguggccccaggcacccagauugugcagagcuccccagguuguucugugugcagcaaaaguugagaaugcucauuuagcaaugaaauaaccaaaguuuuuaaaaguuuaaaaaaaaggauacuuggacucaaaacucccuuagaccagaauauguugaguuccagacuucuggauaaaccaucuucuacuaacguaauugaggccuuuaaaaaugugggaaucuuauaauauuacaaaucuauagugaguguccuguuucuguuuuauagaccuggacaaacaccagacucagacguaccgaggcacaggugggucagcauguugccaccuugaaagaacaugauaauucugucaaagaagagguagguagcuaaacugucugaaguuuucccaaucacaaauguggaccacaggguaagguuaguaauuuuuauuuaaaaaaaaaaaaaaaaaguuuuggccaggcgccguggcucacgccuguaaucccagcacuuuuggaugcugaggcagguggaucacgcggucaagagaucgagaccauucuggccaacaugaugaaaccccgucucuauuaaaaguacaaaaauuagcuggaugugguggugcgcaccuguagucccagcuacuugggaggccgaggcaggagaauugcuugaacccaggaugcagagguugcagugagccgagaucacgccacugcacuccagccuggugacaccaucucaaaaaaaaaaaaagucucaagaugugcagauuauucauuugaggaaauguuauguauuugaaaaaaauaacgauaagaaaaguaguaagugagguuuugugguugguugguuuuuaacuuucugaccuugggccuuuugcauaauguuuuauguaggaauuuauuuuccaagaaauuucaaagcaucuuauaacacucuaguuuuccgucuccacuccguacuuuagaaauacuuuauagucauucaugucaauucagcaaaugccuaucgguccauuacuguacacagauaucagcccagauccguuggagggaaagagacaaauaaaaugugacccccuccuucuggggugugacaucaugggaugcauguaauaagaaaaugucaaaaaugugggcuuucaggaaagagagccaagccaagacuccuggagaagcaaggaaggcggaggucaugauggagggaguacaguggcaugagaggugaucuuuaaaagauaggcuuuugaugguacgaguugggggugggggcagaggugacaagaaauggcugcuaugagccaaagagcacacugggaaacccaacacauguucaggcaacagagccauccugaggcugaagcaugggcucaagucuggggauggugagaaggagcacaagaaguaguugcuggccauagugugcagcauccgaugccaggccagggagaauguguuuaguuuuguaccuuuugaaaagccacuggagcuuuuugaacagagcugugauaggauuucugcagugccuuagggaauuucauguuugguuugggacugagacauugaaggagggagcccugcccugguucaggcaagaggagggaggggccugauuugggagcuggugccaagagagaauucgaagaugcuaaacagaaaauggaaauggauggagcaaguucccaaggaaaucaugaggggaggaaccggaagcccaacuuuagagcauguccauuggcauauuccuuccucauucccuagaaaagccacauucagggaaacagccuuucuucuccuagguugaacaucuugggaaugugucuuguuucaaagcauguuuuuucaucuuuauauauaauacaggauuuucuggcuuugauucuuuuuaagguguuucuaaaauuauuguuaccaugcucauaguucaaggauuguauaucugcaccuucuggaaucaagccuugccugugucuugaagucacaugcccaaguggcugugccaucuagagacucuggcuuugccccuccagccuuccagagcaccuuuaguccuccucagaccccucuuuccuugcugcucuaauuaagagaguagcaggacuuuuuuuuuauaacauuucaaacauacauauauucagugauaggacggacccacuaaucccaugcccacaacccaaauucacauauguuguuaccauugcaccauauuuguuucagacccccuccuccucaucuuccuccuuucccccaucuucguaccccccucccuucccucuccuucuuuccuccccccacuucacccaccuucucucucuucugcucuuucucucuuuucccucuucuccucaaacuuccuucccuccccccuuucccuuagagggaagaaauaaauuauuacaaacauagauacagccccccguaugccuuucacagauuucaugccccuuuucaaagauaaccuagaucuauuccuucuuugcugaugaauguagaucuuuuuuguuuguuuuuucgagacggagucuuguucuguugcucaggcuggagugcaguggugcaaucucggcucgcugccaccagggcucacugccuccuggguucaagcaauucuccugccucagccucccaaguagcugggacuacaggcaugugccaccaugcccggcugauuuuuuuguauuuuuaguagagacaggguuucaccguguuggccaggcugaucucaaacuccugaccucgggugauccgcgcccccaucagccucccaaaguucugggauugcagauaugagccaccacgcccagccgaugaacguagaucuuaagaaagauacuguuuggguuuuauugucccuuugaguuagcacugucuuguaacaacauuauuucccaugcuuguucacugcaaguacaucacauucaggcauuuuaagggugaaauaaguguugaucgacuguccuuugcuaucuaauauuuuuuuaaaugauauuguuuauauuagaaaacaugguccaagucccaaacaaccaaucuacucaauuuuuccaauaaugggagggggugcuguccagcuaauaucuaaugaaucaaauuauauucuguuuccccuaauagaucuuuguuccuuuuuaaaucauucugaucucauuuuagugacaaucauaaaaaguaccaauagauuaaugacaaaaucuauccuuaaaaauggaaauaggcuggacgcgguggcuuacgccuguaaucccagcacuuugggaggccgaggugggcggaucacaaggucaggagaucgagaccaucuuggcuaacacggugaaaccccgucucuacuaaaaauacaaaaaauuagccgggugugcuggcgggcgccuguagucccagcuacuuaggaggcugaggcaggagaauggccugaacccaggaggcggagcuugcggugaccgagauugcgccacugcacuccagccugggggacagagcgagacuccaucucaaaaaaaaaaaaaauggaauaaacagguaauuucucauccaguuagguugugacugaagaaaugcacagccccaaagaauauuaccaaaaugaugcaggcggggcaagccuugugaacugaaggacaaaaugcuuuugugaguccuagaacuguuuugguuugcaugucauacuuuuccgauuagugaaaucaagugucuuugaguuguuucuguguauugaaaccaucuacacauuugguaaauacuacggguuaaaucuuucucuuuagauaaaaucuucaaaguaagugauuuucaaaauuuaaaaaagcucuacuagaaacuacuugguuaagagucuaaugaagcucagaaauauuuacuuugaucucuuggguaaauggcuaauuaaaaagccgcauguaaaugauguuucccugugagucccugugcugucagcccgagucaaucccuucucuugaguaaauacaucaucaaagccgcagaaacucagauuauguucccuggagaccagauaaggucugcagugcccacauaaccuauuaggcaauuacauaauugagcugccugcuuuuaaauuggaaaaauuuguaauuacuuuuuguggaaaaaaaaugaguugggugcuucauuaaaauacaagaugccuuaauauuacuuuucucccaagugauaccuguuucugcccuggagaacuuuaucacagcagagcaauaugcuggugacacucauagaguagaucgggguccugcccccaccauacacacagaccaguuuuauucaccaggaagaugcuuuccccaaaugcuggacuguuuucuuguucuuaucuccugaauacucauuugcugggucauaugaauaucuucucauuuaaaaaaaaaauugcuacacagguaaaaucccuucauucccuuuaacguagaacuuaaguguugaugcuugcauuucucuuuaaacaccaagaaauuacuuccaguguccaagaggaauacucuugaaccuugaggaagagucaguuaaaucugcauauuaggggaaaauaucaucugcuguccacauccauuauuuuuaauucucuugcuuuucugugucuguguuaguagcacugguuugcauauagaagggaauuuaauuuuaucagaugcauuuacauucauuuucucucuguauugguaccacugauagcagaaauuggauuucuuuagagcgagcauauguuuucuuuuaaaaacaagcauuaaaaaucuugaaauaguaagauaaaaagaaaacuggccauuuuccuacuauucuacuauuuauauauaacccuguuaacauuaugguguauguuuuuuuaaauauuuaauauauugauaugagaggccgagguugguggaucaccugaggucaguaguucaagaccagucuggccaaugugguaaaacccugucuuuacuaaaaauagaaaaauuagccagguguaauggcaugcaccuguaaucccagcuacuugggaggcugaggcacaagaauugcuugaaccugggaggcagagguugcagugagcuucgaucgcgccacugcacuccagccugggugacagagcgagacuccgucuuuaauaauaauaauaaugacuaauauauugaaaaacauagguugcauuauuuguauacauaaauacauaaccuuguuuuuuuuuuacccccauuugcugcaaagugaacucuuucauaccauuacauguucuauuuacaucauuucaaauggcuuuacagagguccccuguccacugucacuucagucauuuaccuguuguucaacauuuguuucuaauuuuuccucuaguaaaaaaguuucaaagaauaucugugcaauucagauuuuacaaauaucuguaauauuuucuuagaacgaauuccuagauauagaauuaguaggucaaaagguggguauaucuuucaggcuuuugcuaugcauggccagaucucacucuggaagggucaucagaguuaccaguaauggaugaaaauaacauuucucugaguucuuuaugaaacuagauacuaucagcuuuuuuuuuuuuaggggcagcaauuugagagaugaaaaugacauccaauuuuuuuuguuaauuugaccuuuuuauuacaauugaggucaaacuuuucucuaccuauuuauuagcuauuuguauuucuuuuuucauaauuugccagcucauguucuuugcucauuuuuguauuagguuaguaauauuauuucuuauugacuugcaaaaacuuuuuaaauauaaauuuggacauuuuguugcaaucuuuuuagcaguuuaauuuuugucuuuuaauuuucuuaaugguguuuuggauacaaugucuuuucuauuaaugucuuacaucugucuguuuauacauuugaauaucacaaccguaaguuuuuggauauaauuuaagagucagcuuagaugauucuugggguucuagauagagcaagauuaauauuuaaacugaacauggaggaaaauucuaguagaacugggcuaauaaaggaauaguacuguagguguaacucauagaacgauuuaucugccauaaugucugaaauauggaggugucaacaucagucauuccacaaauaguuugugcccuggcauuuaauuuccaaguccuuucuccuggcuccuggggaggcugaaaagugagggggugguuuguucguacugacuuagccuucagacugcugagaccaauggaacaaucucuaguuuucucuucuggccuccgaaaagagagccuuuauuaauaacagguaaguugaaacccaagcauaguucaaucauaagcacuaucagaaagccugugguaaaauuguugucuaauggcauuuuuuucagagaauuagcuccaauuugcagaacccauuuagucccagcaugagauguaauaaagcaaccuguuaacuguucucugagcuucucucuguguuagugucaucagucucagacugcaaacuccuucagauuggagguuuccuuagaaauacacuuuucuggaacaucugcaaacaguacaucuugagaauguguuacagacguuuuccugacugcagaaguuguuuuugcaaggcacaguggcucacgccuauaaucccggcacuuugggaggcccaggaacgcagaucacgugaggacaggaguucgagaccagccuggccaacauggugaaaccccgucucuacuaaaaauacaaaaauuagccugguuuggugacacacgccuguaaucccagcuacuugggaggcugaggcaugagaaucacuugaaccugggagguggagguuacaaugagccaagaucccgccacugcacuccagcuugggcaagagagagagacucugucucaaaaagaaguuguuuuugacuagaaaucugugaccuguucuugucuauccuugucugagacuaacuuuugucuucgucccugcuuaucaucuuugagaaauuaucuguggaauuaucuuaaaagauguguucuuuuauaaacauuucuaucaaaaaaguaacagaaauccuggagauaaguauugaguagugaagauaaaugggauaaaauacagauagucccugacuuccaacuuacaaugguucaacuuacaauuuuuugauuuuacaguggugugaaaguguuaggcauucaguggaaaccauacuacaaguaguacaguauccaauaaauuacaugugaaaaucaacauuuuauuauaaaauaggcuuaguguuaaaugauuuuacucauuuguaagcuaauguaaguguucugagcaguuuaagguaggcaaagcuuaacuaugauguucaguagguuagguguguuaaauacauuucugacuuacaauuuuuucaauuuguggguuuauuggauguaacucccuucauaaauugaaggagcgucuguguacaaaguaaauugaacuagcagugcaguaugcccaccacauuauuuaccucaccguggaaaagagggcucagugcagaacuguuggcaauggcaguauucuugucaagccuacaaggacucauuagaaagguguuuguaguagauuccagaagcaggugcagugcaguggucuguguaggcaguugggaugggggcagugaugggaaccagccuuggccuggccuucaagggcaggacccuaccccuagacugcagaaaugggaauacugagcaagucaucccaacagaguuaucacaguggagugaaaucuagggacuaguuucuagaaauagaggaaaagccccuggucacuagaacugcaccacagaaagguccuggcugcaaggcuaacuugacaccaaguucuuuggccaaggggacuagaacuccuuaaaucccccaaucagcuacuccagcuccucagguaggccauggguccaggucagccaguacuagggagggaagaaggcaagaacucugcagggaagucaggacuaaaggcaguugccuugaagcgucugaaaugccaaacaugcaagaccagaccuuccauccagaccuucuguccgggccuucuuaccgggccuuccguccgggccuuccgaccggaccuuccaugcucugacucucccugucggagugucuucaccuuguuucauguuaaucacaaggaagguuguuuuuuccaccuuguucacuggauaguuacauuguuaacacuucacucuuggcuaaugaugaccugugaacauuuguccacuucugcucuuuauauuaauuuuaaacugucaugugcauuuucccacaauuggguugaacacuacccaguauuuacugucauugucagcuaccugugggucaccaccaccaccgagguuuccucuccagcuaccuaaggaaaucgccaccugucaauaggaaaugagagaaacauacacucuggcagcgggauaaugugaccaaugguuaucuacuaaaaguuuaacucuuauuaccagcauauuuguauuucuuaggggaaaguacugaccugaaaaucaaaagacuuggcuacuaaccccaguccugugaauugccccuuuuucuccaccucuaagguuggcucugauaaaaaccuguguccuccuccuugcucaggacacaugaggcauuuaaguaagacaaugccuuugaaaaaagauaggcaguguggugggugaguuuccccagauccccagacgacuuacaggcaaagugcagaccaucuuaguacuugauugaagauugggauuuagaauaagggcaguuaucuuucuucucagugcauccucuucagccacaaauuuuucugcaaucuuccuguuuaggggaaauucaugggucauuuuuaggaggguggggauauggcaaggucacaucuuuccggaucuuuuucucaguugaaaguaauucugucugacaugccuagaaaauaggauucauguaaucaaagaauaaauuuuuccuucagaaaggaggucugaggcucuaccuuuuguauauaucgaagggaggauaaaccugcccagauuaacagagguggucacguuucauauacauacuuaacaagcagaagaauauuucugcauuacauaagauucagcccucaaaaaguguauuauugugaggguaacuuguaaagaauuagauuauaguagaaaauaaccagguguuuuuuuucuugacauuuuaauuucauuuaaaugugggaaacagauuaaauccuaaguaaagcuuaacuuaaaauuauauuugaaggcuaucuuugagaccaagaggaauguggcuacaguuuguuuuuauuucuuugugcuuuuuuugaaacacuguaggcaacagcauuauugagaaaagcccuuacagaagaguguggccguaggucagcuauucacaguagugaaucaucuugcagcuugccaucuauucugaaugacaauaguggaauaaaggaagccaaaccugcuguauggcucaacaguguuccuacaagggaacaagguaacuauuguuaaaguguguguccacagcaaaaaggcauucagggucaucaucaucuuucucaagguacaccuauagaauaucacugacuagugaauaccucugauuuuaauaugcauaauauaguauuuguuuuauaccaccuuccaauaaauauauauguucuccuuuagucuaacaggaaugggaaaucuaacuguaagucuguaguucuagugaauuuauuucuaauaaaauaaguaugaagaaguuacgaaaucuuaacaaaacuaaucgcuuggcaguagauaauuuugaucccucaaagaugaagaugauuccauaaaguacugugaaguuuuugauaucaccuaauagaauuuucucauaauuguaaacauuacuuuuaauuauaauagaaccuuaucagugucuaaacaguugauuaagaaucaaugaauuuaugcuccccaaauuuaauaacccauuuugagcacccagaaacugugauuauuuaagcauuacugcuaagacaugccauuuaacugcuuuaaugguuuuccaagacagcuaugaauuccucaggaauugcucgaguugauguacaugugcaggaugugagacucacuuauuuuaugucccaccuaaauuugauagaugucaggcccaguuauuuugcgugaaagcagcauagugguaccuuaauucaauuuuauuuuuaaauuuuugucuaugagauaccuuaauuuuagaauagguuuccuuuuaggaacaguauuguuucagacaagaaauacauuaaccaaaaaaaaaaaaagugaacauaaagggaaggacaaacacccaaaggaucuauuccuuaacuuugaaauacuuuuuuuuuauuaugcauucaauuuuuagaaguuucaaguggcuguggagacaagagcaagaaagaaaauguggcugcagauaucccaaucacagguaaagcuaugguugccuaagaguuucagacacaagauuuagcauuauuauauaagcggaacauuuugggucagugguuuguggaccccacuaagagcacauguauucagcuacugcaugcuggagcaggagauuaauccuaagagcagaacauauauacuuauguuaacauaaacuaagguggaaaaucaccgugucuauugaauucuucaucaccauguuauauauuuacaccuguaacauccuccaucaugugcccuuucagcaccugcgucucuguaaaaagguccaucucccuggggaacacccggucauuacacagcaaacuauagauguuucugauuuuacuguuuucuuuccuguaguaauugcauauguauauuaaaauaagcagauaauaaaaaaaugucagauaggaagcuugcguuugccucaguuacaaagccugucugauaauuuaaaaauuguaccaaucgggcuucaucaagaccuauuaagauuucugcacauguauuaggcuuguuuagguggaaucugaacgauaucauuauuuuuuucuuuuuagaauaagaacagcagcaauuaguauucuguacagaguucuacuugucauacaucugaauuuacuaguaccuuauuuugugaagugguguacuacuucauuauaaauucaaaggucugacuuuaaauauuuacacaaguaaauacaccauugcaccaagguacugaggcaugcaucugcauaugugguaguuuuguuguuuauaagcagaaaagaauggcuugcuuuuauggcagugcaguuccuggcaugauuaauuuuuuaaacucauguuucugugaugaacucugguuuugaaaaagcaguuuaugguagagcaguuauuguauauauuaugcauucagauaauauuucacucuaaaaugcagaguuuuuuuauuuuaaacauuuucaccaaugauauguuuauuguguuuuuagucugcauuuucugcaaacucugguauggcucccugcuauuuuuauuaauagaaauguagaugaucccaaacuacagauaaccaugaagucauuuggauacuuuucucuugcauuuacuuuuggaugcagaaguaucuaauggccucugaauuuauuucaauuaaaauuacaaaggauuauugaggagaaaccaggaaaugaccuuguucauucauucuucucuuuucaguauucuuuacaaucaucccuugcugggaguaguugacucuccccaaaguuaaugcaaauguauuuucucauauacuuucuuuauaagaaaacggauaauuaaguaccaggguuucaaaucccuucucaugcagaagugcaauauggcuagaagcaacuugggcuguuugccauuaagauuuuaaaagaaauuguaauuccagcaaccugccauugauccaucaauaguuggcaguuaaaaaaaaugccuugugccagaauauuagacauuaaaaaaaguacuuuggaaauuuuuuaaaaacuuagcaaagccauacacauuguuaagguguuacuguucuguccuugccaguguacuauccccacccagggaccucccaugaaauucauguuugagagcuucacgcaccuuggcacuacuaauacuguugcuuuguccaucauugcagcuacuuugaucucuaaguucuugaccaucaucccuuuauuaaauguuugugacuuuggcauaacuauuuggagauuucacuuuugguagaguaaagcaaguauguaguuuaauuuaagacagagucugucugccucuuuauaauaguucuguugggguguccuguuugugugggugcaugcugguuguguuugugugggcugcauuccuucuagaauauuccaaagaaaauauuccagaggcuguccccugaagguugaggaaauguagcaguugggcuggggcuuugcaaccagccaucagugucagcucuuuuacuccuugcucuguuucucuacccucucugagccucuguauugggaaagcagacauacugcccaauaggauugucuuaaaguuuaaaugaaaucauuugugaaagugccaagcagauacuagacacucaauuuuaucugugaaguauaauaauauucaugugaacauuauuaguguuccuggucuucugugugggcccccacaguccccagcauuuccaaaccagcuaugaggagccucacaaagcaaacucaaagaagaacauaaguagagagaaugaggaugcagcaucacagaaagugccauugugagacgagccccuggaagaguggacacuuucagucuguucugguggaccugcauaccuuccuugaguugugguggccacuugggaccaagacccacacaagcacaguacugcugcaauaccugcaagacagugcuucccaauaguacugcuauguuaguuucugcaagaaauugccacuugagaacacaauugagauucaaauccaggauaguuaccuuaucaaaaaggaaucucaagaagaguuugaugauacuuuuccaauuuccacuuagucccaugaggacauccacagagaaaaauccgaaacagcugcugaaguacuccugaagaucucauuggucaaggcccagacaucucugucucggggugccuaugugcccuuaguaacccuaugugcucacaauggaugauguugcaggguaccugauuaccaggcagcagaccuccccugaugugugugcugccccacaaguauugaugagcuaaugcagcauuuuccaaaauguguuauuugcaaugcuccacccagaaaauacaucaauuaauacauauuuuguugcccagcccugugugauccuucucucucucugcaguaugcauaaugcauagaagcauagugaagacuuggaaaagacuuucagcaaaggaauuguuuaaaaaugugagccuagaguuucagauaacuuaucauuuauuugaaaauggaauucuuucuguuaauagccaacagaauuaauguucuguggaacauacuuugugaaacauacacacauguauguggaacacuuuuaaagcagugaguccaaugugggcaccaguuuccucaauaugcuaaaauuaucuucagcauuuuucugugauuucauuuuguggggagcucccuugugcgugagauugcuuuauaaugagauuuugggcuaccuuaguguaacuacacccagauguuaugacugacagcugcuuguuacagcuguuccuugaauugacaguaagguuacaauaguaauuuuaggcgcccagaagugcuauucuucagugugggauccuucugugcgucuuuauuugcuuuucagccauuucagaagaaguauaagagaagacguggcugaggugaaaucugggaagucacaagagguugggggugggaagcugugaagucauaccuuuaucagaaugaggggguccuggggauguuuaaccugagaagggcacaguagcucuuuaaauauuugaggagcugccauauaccagguagaauauuuaucgagcuuaauuauagagcguagcucaguaacaaaacaacuuucuagcucuucauuucagcaaaaccaaguucaguaucuuccaggggugagugcuugaaccauggcaggaaccaugacuuuuuuuuuuucuuuugaaacagggucagggucuugcucugucacccaggcuggagugcauuguugugaucacagcuuuuugcagccucuaucuccugggcucaagugaucuuccuuccucagccucccaaguagcugggacuacaggcaugcaccaccaugccuggcuaauuuuuguauuuguuauagagaugggguuucaccauguugcccaggcuggucuccaacucccgaccucaagcagucugcccacuuuggccucccagaguucugggauuauaggcaugagccaccuugccuggcccuguggcucuuuaaaagagcauuguggaaggaauuauugcuucugugaccccugacauuccuucuaaugccaagggacugugcuucuuccucuaugcuaauggaauccagugugccagcauucucaucucuucauuucccuuucucauuugcuuaucaccacaaaacggaggucuucuuggcuggggcuccuccuuaaagagucugcuaucacuuugaaggcaucugcuuugcuaaucguuauuauggagcaugcgaguuuucuguguuuagauuuacauagaaacccuccugggcacacacugaugccccacccacaaacacagagucaguauuccauagccuguaugaucuguuguugugaauauaaucuaccccuuuuauuagucuaguuguuguucacuaaagaauccagguggaaaucaaagaugaauuuuuauaucuauaaauguaugguuuucuguauauaauaaguaguauauaauuagauguauugauacaauauauauuaguuauauauuauauaucauauaucauuauagaugauuauauauaaaauccuuaauuauauuaguuaauaaaauuaauauuuuuacgugggcugaauccugggauaccagaaaccacaaaagaugguaucccugcccucacuaagccucccucaucucuaaccuuuacaacaguccuauaggguaaacauuaguacucacccuacaaguggucagacagaaacuuagaaagguauccugcucaaggccauguagcugguguguuugaucuugaauugaacucagacuuuaggauuugggcucuugaacuccuuccauuucacugcccugccucuuuuauuuauuuuguuuuuuuauuauuuauuuauuuauuuuugagacagagucucacuccaucacccaggcuggagugcgguggcacgaucuuggcucagugcaaccucugccucccggguucaagcgauucucgugccacagccuccugaguagcugggauuacaggcauguuccaccaagccuggcuaauuuuguauucuuaauagagacgguuuugccccguuugccaggcuguacucgcauccuggccuaaagauacccacccaccuuggccucccaaagugcugggauuacaggcgugagccgccacgcccggccuacccugccuuuuuuauuuuaccaaaaagacaacugcaucaggauguccggaucaauuaaacaucaguguacaucauaacagaagaugggcuuugcaaggcugcuucugagagcaaugauaaacaaagcuugccuuuccuuucucuuggguuaggccuggagaggugggcagcaugcaaggauuuucaaaugcagcucaucccgagaggcaggccuuuuauaaaguggggcaaaccugagcccagcugggcugcugggaggucgguuucccugaaacacuuccugaccuacuauguaggucaguuugccugaaacacucaggccaugaggaaagugaugcuuaucuagauugggagagaaagucugccuuuugaacuacuuacauccgcaaagugaaaauuucccacauugacaauuuuauuuguauucacacuaaauuuaccuuucagcauuaagugaguuuuagcuuuagcagaugaugcagcuaugcuaaaugucauaaaaauacagcaccuagcacaguaucuggcacagagugggcacuuaauuugucaaaugaauaaaaauggggauauuaaggaauuuucuuaaaugcuugaugauucaggauagaauacuaucucuuucagucaugcacuccaccaauacuuuucccaccccacgugcccauccuggcaaaacuagucuccuuaagcuccaugugaaaagggcucucagcuuuuaucucaagaggauuaagccucuaagaauguccauucagacucucauucuuuugacaccaauucucuuggucaagcuguguugaaagugguugccugacugugccauuccucguggauauucuuuggcaagcugaaauaugcaggguaauacuaagacauccauuuagagucuuuccaggaggucaguauagauuuggagggugccacuuggaguucuaggcagugcuucccaaaacaugauugcuugaguuuuacaucaauuuggaaaagggcuggaaagauauaguggcuagguugucacuggugacuggauuuauccugggaggaaagacuguagugaugacuuugggcucccaaagcacaguggcauaacaccacuaguacugagguuuuaccgagaaugugcuucaccuguccuaucccaaagcauuuuccugacaagacucagucaagacauauuaccuguugugccuggaacgggaaacccccagcuugugcaaaaccaggggaaccacuguguguugcuggauuguccauugaaaguccacguggcccugucucugugccaggggucagccugcuggggcuucacccauggagccugcugccugcuacuugcgguagcaaaacaguccucauuauauugcagggcagugcuguuuauuuaacauggucauuaaaggauaaaagguacuuuucugaagggucuucuggacuggaugcuucuauauucagagagaugaacucauaaaugccaagagaaauucuccccagcgguucaugguagaaucccauguagaguuuuagaacauacccaugccccagccacacccuugugcaauuauuucugaaccucugggaguggcacccaggcauaaguacuuuauaacacauccagauaacuucuuagguuugagaacuguggagcaggggucucaguucaaaagagcccuuguagguccuguuuugaagcacccucauuuuacacaggagacucagagacaaaaucaggcuuuaaauauuuuaauaaaaugagggguuggaguguauuauuuuccuagggcuguuguaacaaaguaucacaaacuuaaaacaacagaaaugcauucucucacaguucugagagcuagaagucugaaauccaggcgucagcagggcccuugccucugaaggugcuagccaguggcuccuggcuugugggaguauaagcccugucucugccucugucuucacuuggccuucucuucugugucucugugucugcucuucuucuuagaagaacaucagaaauuggauuuaggggccacuguaaaugcagaaugauuucaucuagggaaccuuaacuaauauaucuguaaagaaccuauuuccaaauaaggucacguucugagguucugggaggacaugaguuugucggguugaggggaacaacauuauucaaccaacuacagggaaugaggaaggacuucuucauauuuuacauuuuuagcauccaguucaucuucuacaguaauuauuccugaaccuacuauaaauaaugguaaagauaagauugccauuucuaauuucucucauuaaauaaaucauugaguacaaauggcuaaaauauacuguuuuuuaaaaagcuauuuaaaucaauaaaauacagcuuucugaugaagauuacucaaguuuugaaaaguuaaagguuuccugagguugagaguugaaaauccaccucucacgacugaacaguguuaaauggcaagacgcaaaaguguuucagcucguuuugggaauguugguuaaaggucaguuucaagccuggaauuuguuuucagguuuaauuguugaguugccccauagaaguuaagacuaugauauaaauuucuauuuucugaagcagccccagacaacucaucugaauuaggcgggucucuucucgugcaucagccgucuuccugagagugcagagagcaaccuugacaauggaauuugcaggcccaggucuacagguggaguggaguuuauugcagaaagucuggaugugaaaagugauucugguuacggacccaaacuuguguaucuuccugccuuuuuaaaaaaaaauuccuaaauauauuugaugacuuuucuguauuuucagaauugcaaaagcagccauauccuauuuucucucucucucuuuuuuuuuuuuuuuuuuuucagagauggagucuugcucucucacccaggcuggagugcagugaugugaucucggcuaacugcagucuccacuucccagguucaagugauucucaugccucagccuccugaguagcuaggauuacaggcgcccgccaccaugcccagcuaauuuuuguauuuuuguauuuauaguagagacgggguuucaccauguuggucaggcuggucuugaacuccugaccucaagugauccacccaccuuagccucccagagugcugggauuacaggcgugagccacugcacccggccuuauuuccuuauuuuuuauuuauuuauuuuuuugagauggaguuuuauucuuguugcccaggcuggagugcaauggcgcgaucucgggucaccgcaaccuccgccucccagguucaagcaguucuccugccucaaccucccguguagcugggacuacaggcacgcgccaccaugcaguggugcagauaacagcguuucuccauuuuggucaggcuggucuugaacucccgaccucaggugaucugcccgccucagccucccuaagugcugggauuacaggcuugagccaccccgcccggcccuuauuuuuauuuaagcagauuacuaggcaaaugauuucuggauucucagugauaauauuuaucuuuugaaguaacuuaagaaauauaucucacaauuuuuauuuuauuuugcaaaaaugaccaaguuugcagugucagcaacacaccuaguacaauuugaaaaagcacuuagguguagaaauaugugaaaaguaacaaugcugagaaauucaguggacagagaauauuuuucagauuucauuuuaacuucauauagaaauagcaguuauccuuccuuacucaaacauacccaguucucuguugguucaaggucgguuuuuuagcuguagugauaguauuguuugcaucucccuuuguuguuuuuuucugagcccaacucuucuuuuuuucauuaaggauuucugcaaaagcaaugggcagauucccugccuccaagacaccccuuagagacuggugaaccacguguuugucuggcucuuguaaugggguguuaaaagcacuuguucaucagauauuuucuuuuuauuuguagauuuagaaguauuuuagcagguguacauuugcauauaaaagagaaaaaagauaagaaguugaggcuuuuucuuucuccucuccuuaacaucaucucucucccaccucuuuauucagcauguuuucacuuucuuucuguagcuguuucuauuuucuauacacaaaacgcauaucaaaaagaaaaaaaaacagucucagcaauccuucagcacuuugcagaaagauagaugauuggguucaggcagcuuauguaacaaaguaagggaaaauacauuuaucucaugucaucagucaggagugaauagacaaggauagauuuucaccuucuggagcuguagacugcaugagauggccccccuugccuugccuuacauuuuaaacuacaauauuuucuacuuuuuaaacuaaaucuugacgcagauuugaguauauaaucaaugcuugaacgaaagauucagaaccgaaaccuugagcaugcguguguguuuguuucuguguguaucagaacauuccaaccgaaaaugauuguauucuuuagaaaugcuuguuuuaucuaaacauuuucacuacucaguauuuucugagaguuuaacuuuacuaauggggggaaguguuucccuggauuucuaagucaggcuagaaagugaaaccuuuaaagcaaccacccaauccucaaauuuucagacuuacaguuuacuugcagcugagaaaacuaaauucuuuucaccuuggaaauauaucgacuuugucccuaccuuguuuguaacagacuaacuugaacuucuagagucauuacuuuugcuccuuuauuuguucauucauuuaauaacuaugaauuugcagagcagcaacaaaguggagcuuuuaacugauugguucaucacugucuuucuuccuucuaaaaaaauccugggccugaauugccacacaccucauguccauaacuuuacacucuugcuucaugaaacuagcauccuggccaagucuucugggcuguuucaggaggaugucugauuuguuugagaacuccuagaaaaaguacacucuugccuccagucugaaaccuggucuguuugauacagacagccccuuaaaaaucuucauacagcugaugcauccucccuggguaacauguuccaacaacccuuucaacaagaaagcuuuuccuaacaucuagcuuguauucuuuggcugcaguuuuucccuaaguguucuuguaccacuuucagugaacacaaaaaguugcucacuaccaucuaguuuggaggcuacaaauauguucuguuuugucugugcaguguuuuauuuuuaaaaagaagaaagaaaaggcagaagucuggcaagaccaggaccacuuucccaccaggcagcaauuggcugaagccaaggagcagcugugcucuauagacaagucaugugccuccuugccugcuacagggcaggcccuuccugcugcuccugccuggccauagucacuuauuggagguacuugcuugguuggcccuagaggcaucuggauccacaaugcccacccuguccagucuguuugcaauaucugaacuuuccuucccuucuccaaccuuguucuaugcagacuauguauucuuuaaucacuucuaauuuguuuuagccaacccuuauuaauuuuguuuuuccuguguagaucaucucucagucuuucauaaauaguuugugcaacaauucugacuaaauaggggggugaugcauagggagagcgacuccaucucccaugcaucugauccacaguugggcggcagcagugcuaggcgcucugcccucucccgcaacuuugacgucugugguccugccucagugagugucauuccucugggugaaugcacuucaucuuuguaccuuuuaaacuucacuuugccuuuagaccauuggagggaaucacacugggauugggggugagugaugugcccagcaguccucagccugaucucgccagcccuuuaggacucaggucagggcagcugcaucccaaauaaaaacugcccaggugggccucggugacucuccuuggagaagggccacagaggcuuaaggaugaaacaccagugaggugauugggaaguggugggcucugguugcguggggcaggagagugagccaucucaggaugggugguuagccaaaagcuccugagcccacacucuucaggaaggaagggagggggaccagaauggaaaguguggagcauagaaagggcucaucuuuuccagaguaucaaaauggucccuuguugcuagaagugaucucacuucacauugguaauuuccucccuugcuaacuucaaaccaguaauacuaucagcccuucuccuguuugggcagaaugcuuaaucccccccaaaucugaaauuaccucaggacuacuagcuugauauuucucacagaaauccccuucugauugccagugacacguuuuccugguuucugagaagcaggagagccgucucacuggagucaagugauuuaccuucagacaauggagaaaugaauuugcagcaugccgcuccagcuuccaguggccaggaggcuuuguuuaucaagaagcugcuccuuuuuuuucaaauuuccaucuuugcuaucuuuuccuugacgaaauaaguuuaauugaauguagaaauaacguggucauuaagaucuggacuuguaucuugagagcugaaaaacuuuuugguugauuuuuauaaaauaaaaacaaaacagggcauuuuuaccucuuuuacacugacuccuuaccuuuagaauucagacacucugucuuugauuuuauuaauauuaucccucuuucacaguuaccuuacaguauauuugaaguaacauggauguuaggauuagccggaggucaucacaacaccaucccauuggagccauccuaggacaaugcgaccagccucaucaggaaacacuuucgucccagcgacccccacacauacacacauuacacaaaacaguacuuuccccucuguaugcacugugucugauguuuucuuuaucagauuuuucaaaauacuaguuucagcgaccuaaacugauuucacaauccagcaauguuaaaaaaguguugccuuagaauuuauuauauucagagcaaagaaucccugaucuguauauauuuuaauuauauacuauuuaauauuccaaaguauaauguucauuuuaaauacucauuuuuaucuugacugauuuucaguagggcaagguaaguuguauuuuuauucuucagugugaugguaguuuuaauccaguaauagggucucaugguuaaguucuuaaaugaagccagcaaaagcaggaauccaaccuguugccagccccuagcauugacagugggacuccuuuuguguuacauugaagaugcagacauggaugcuguuuuguuaugucugugcugaaacucugauucuucauccugcauuucaucugggugcccuugaaacuuagaguaauggggaagguugugucacucagguucuuuacguauuuuuguuuacuguuuuucccaacagucuuccccaauuucacuuauagcagaugccauuagaagcccugcauggccaagagcauccuaugaacaugagcaggugcaggcugccacugaucccuguggacaccuggcuuugcucucuacaaacccguucucgcuccuuccccauggcaagacuugguuagauuuccucagcuuugggacucugagcucauccagcugucaccacccuuccugacccucuccccauucccccagcccugucccagagccccugcacuugagugugagagcccaagagccagagcaaagagaguuucuaagugaccugaccaccuaggaagacuugcuuucucuucugguucauucccguagcugucucuacaaggccccgagggaagugaaacuguuuugcugugauggggaaccuauccacagacccacucaaaauaaugacugugauuuggcugccucaaauaaacucauacagcuugucuuugagucuugaaacccggguucaacuaaauuguuuuuuguuuguuuucagaaugucuaaaaagugacaguucaaaaaauaauaauuugcaugcauuuaagaaguguuaaucucauaggaagaauuuaaaaagcuucuuucuggccaguaaaaaauguaauauuucuguguuuuucuuuaaucaacagaaacagaagccuaucaguugcugaagaaggccacccuucaggauaauacaaaucaaacugaaaacagguuucaaaagacagaugcuucugugucacacuugucagguaaguaagagcagauggcaguguccaggggcccagaguggcaggcagggcuguguucggggaagggugguuauucuuuaugaagguuucuggaguuugcucuguaacgagcugucaccaggacagaaugagcuaguacuuuuuuauccuuagcaaauggacauguggaaaagcccuuuuguuguguccuagacaugugcuggccagcauggcaauggcccuuccaggcccuggauucugccaagcaugucaugauagugacuugucaccagugacccugagaagacacacccaaauuccuucucuuccccacagcuacuagugucuuagucauucagugggcaguguuguacugggcugcuuucccucaccagaauguugggggauuuugaguucuuuuacugaaaggauuauaaaucccaggaaugcuaaauuuuauuauuuuauuuuauuuuauuuuauuucauuuuauuuuauugugagacagggucuugcucugucucccaggcuggagugcaauggcaugauggcuuacugaagccucaaccuaccaaucucaagcaaucuucccuccucagccucccaaguagcugggacuacaggugcgcaccaccacacucggcuaauuuuuguauuuuuuuguagagguaggguuuugccauguugcucaggcuggucucaaacuccuggacucaagcgauccaccugccuuggucucccaaaguguugggauuacaggugugagccaccaugcccagugaggaaagcuaaauuuuaagcuuaauuauaguuccuucaauuuaagauuuuguuuuaauuguaauuuuuuuauacuuuguuauuuguaugucuauuauuuucagugguuuuccuuucauuacaccaguuuuuagaguauaaguuaccucaguuuccuuugugagaguaaauggauuaauacagaaggaaauccacauuaaugacuuucuuagccaccaugccauaauuucaucuagcagaaugaacagugauuucuaaauagcauguaauucccaguccauauucagauuucccaguugucucaaggaugucuucuucaaccaggcacaguggcucaugccuguaaucccagcauuuugggaggccaaggugagagagcugcuugaggccaggagugcgagaccagccugggcaauauagcaagacacuguuuuuacaaaaaauuuaaaaauuagccacacguguuagcaucuuccuauacuaccagcuauuuaagaggcuaaggugggaggaucacuugagcccagaaguuugaggcugcagcaagcuaugaucacaccacugcacugggcaacagagcaagacccuaucuaaaaaggaaaacaaaaaaugucuuuuucagacagauauuuucaagggacauacuuacaguacaucagacuuagcuguguuuggagagcugauuccuagauaauauuagugguuaaagucaguugcggcaaaauucaguuauuuuggugguauugaggauuuggugaccaaugcacauuaagugcccagcacagugccuaauagugaaaagcccccugggagagccggccauugugguguuaguggugauuugaacucagcaaacauaagacauuguaguuuauugaguuauaaaacagggccucuguccugauggagguugucgucacuugcaaacucuuaacuguuugcuuuccaugaccuucuucacauuugagucauggaauuugaauccagagggauauuagaaagaauguauucaacacucccauuuuacaaaugaggccccaggagaguaacaccgugcucagagccuuucagcuggauagcugacacacacacuuuggcaagugacuccacacgucuguuucugguaaguguuauuuucaguaguuaauuggacaaaugcaaaagaugaguaaauuuggcugggcacuguggcucacaccuguaaucccagcacuuugggaagccaagggaggcggaucaccugaggucaggaguuuaagaccagccuggccaacauggugaaauccugucuacuaaaaauacaaaaauuagccagacauggugacaggcgccucagcuacucaggaggcugaggcaggagaauggcuugaacccaggaggcagagguugcagugagcugagaucacaccacugcacuccagccugggugacagggccagacccugucucaaaaaacaaacaaacaaaaagaugaguaaauuugacauauaaguucuagucccuucgauguguaucagaaauuauggauuaugguacuauuaauaaccuuguacuuaaugcauuuuuauuaauuuauucauaagugaaaugacacucuagguuguguagucaagcaccccuaaauucauuucccuugccccauacucaaaauuacacuacauguuuugcaagauuccaaauuuucuggcaguagaaucauggaagugcuccugccuauguuugcugucacugucauuguagucagauccuuuggcuguguuuugucuuuuacccuuacucucauucugauccuaaggacuuaucugagccccaaagaaaagcagaaagugggcugggaggguguagggcagcuucacaguguuguuagaaguagcagggaugggagguggugguguacucugcacucaagaagcccaccccacaucuaacuaaugaagaagcagugcauguuucacuuacuucugagucuuuggaccugaaggaaagccacuuaaauaaaccuugaggcuuaguuuucaugucugaaaagaccuccuccugguaagcauguggacacccucuuugggcugaauguggacacauuuuuaaaauaaucacuuugcugcagaguguacaugcaagcaggcagguuacagguuagaaacucagcaaaugcuuuuugcaaagaugcccaugcaugcuguaucugugauuuugacugccaguuaagaagcagaccuguagcagaaacauccaaggcugagaacucccaagaggcaaagaucagggauugcccugcaaacugggggcauugugggaauauccaagucucuggcuccaaagaaagagguggagugugcauccuccuccucaaccuuuagaggcugguaaagaguggccuugaugauuuucaguggagauucuuucuccucugugggauggaaaauagaggauuuuacagaggggcuuaagaguggauaaggugggugacuguuauccaugggucucaauuauuucugagcccugguuugcugcccguguguuauaacaaugggaauuauccagugcuuugugacacaguagagauccauaugccuacaugugcaucuuagucauuuaaaauugaacucuuuggaugauuucaguuuucacuuuuuguggcuuguguuucgguaucacaggaaagugccucacucccuuucgguauucuaccagcauuucauucucugccucagaagcucccuugccuucuguggcuugaacagcaucuuccucuguuggcguuuguuucaccaaacuuacugugaggccacuuuauucauuuugucccauggcugcaugacagcuaacccucacucuccauguuuacgcuuaucacagguuugaauauuggcagcggugcauucgagacaaagacagcuaacaaaauugcuucggaagcuaguuuuucaucuagugaaggaaguccuuugucaagguaaaguugugaaagccuuucugaauagcagcaacaagaugagaaaugucacagcgcaaugaauuaaacucuggcugcguauuauuuuguuguaugacuuggaggguuaugguuuggguuuuuguuuaucuaaaauaacaguugaaacuuuagucuaccuuugaaaauauuugcaccagagccaaguauuguuuugcagcuguuguuuccuugguuuaagacucaauugacaccucagugaaccacaaauuagcgucuacagcugcucgcaguaggacugcuuagagaccacacaauggagguugucagaaaaagggcagagagaaaacaucaggccuuaaaagaaauaaaguggcauguuucuucuuuuugugauggcuaauauauaaacuaguaauugcuggauauucauuuuuauuuuccucuuuuuuuuuaaccaaguguuuaggcuagguuauucuuuccuuuucuaauacuuucuugcuuauuuuccauaaagaacaaaauuuaucuuuucacauuugucaaacuguagcacucgcuucuuguagguuuuuugagcugugauaagagaguugugugcugaauuugucauuaacauaaaauacuaaucacaguagcuucaggucacuuagaauuuauagaugggaauauaagccaucaccugaugaaauacccuacucuuuugcuuugagcuaaauauuguuuaaaauggcauagcaacuuuccuuuuggaacagcauugcucaguaaaaagguguccuucagaugauuauauuacauuugaauuaacugcuugucucugaugaaauuuuagaacaggaacuuuacauuucuaguauaacauauaauguuccauaagagaaaaugauuugaaccagaaaugcugaauuuuuuaaaugaaaaaaauccuauuuuuauucauauuuuauaaacaauacaauguuuuuagaaccuggaguauauuaaaaugagauugaauuucuaaaauuauaaguuuuagaaacuugacaaguuaaguuuuagagaaauaacucauuuaauuuucagaaguuauuauuuuuaaugccugaguuuucguccauauuuuugaaggaagugggagguaaaugggacaggaagaguguuaaaguauuauguuauuaugauuguauuauaaauucaaguucuaggucuccuaaaagaaaguuuaaaagacaguaaauucuacagauaauuuucagggccgaauguuaccauuuggcuuaauaauauauagaggcacuaaaaaacucacuucuuccuaaacagucuuuacguagguucuuugggaaauuuuuaaagacauugagaaagcaauuggauuuuguaaaacauuucucagucuaauaauuucacaucuugucuauauuuuacuaaacuaaaaucaagcauuuuccuccuucaaauugagacagagguauuuuguuauuaguaucguuuccguaugaaauuaauuuccuaauaaauuacaaguaaucucaucauccccuuuaagaaaacaaaaaaaaaaaccacacaaaaaggccuugaaggaacucuugguucuaggcacuugauaauaauccagugaugaaaaggucuggguccagagugcguggguuuggcgugcuguuugucacgguuugguucuugugcugggcuugguguuguucauaugccacccugggcuuuggagagcuccaguuuugcuguuugugcuggauucacugaaauuucuuagaggcuuacauuuaaggaucccacuuacugcagucacuccuugugcuuuauugcuuuuacaaguggucucgaaacccgguacuugagaauaaacauaacagugcagugcugcuguagcacuuuuaaaauucuucuuugcucuauuuugucagugagcugaugagcaaccucaaaaaaagaaaaaaaaaaaacccacuggaccuaaaaaaaaaaaaaaaaaaaaauggcuuccucugauguccuagagacaauaauuaugaugugcuaguuaagcccaaacuacagcugagggauuuuacuuuaaagcagcggcuugggcgcaaaaaugcauuuauagcucuuugucugcaccucauuaugugugggccugauucauuaaguaauugguuugcaguuguuuacaugaguauuaaggccuucuuuucagccgccuuugagagauacauugugcaaauguugccugugaugaaugcagaaugagggccagaggguccguccuauuggcuaaacagugcacuccuguugaaaagccagagaaagggauugggugcugcuuugcauagcaaugacuuucuuaauaagcguuacagauuaauacacacaagcuauaaaagaugcaaagagauacucuuagcacauuuauacaugcucauuucauugugaugguggugggguucgggugcuuucauauuccguuuuucagagcagcagcuucagugcaugagccguaauagaauccgauguuuauuguauuauaaaucacgggcaaguaggcagauuggcaacaguuuauuauuaaagauucuuucaguguaaaucuuuuucuaccauuguauuugcuucagcaaaaucauuuugugguugaguggggaugaaaagcauaauguacgaaggagugaguccuaauaggaagccguucuccaaguaaagaccacuuguucccuuuuguucaggggugcaugccagagcuuccucuccucugcaaacauugucucgcuuuaccuuccccagcaagcgguuuucacucucccggauccauuuguucaauggagaguauauuuuaaaagccugcccuuagcuuacugguuccugccuuguaacuucagcuuacugguuggaccagauaauguuuuaccaaaaggaaagggugugugcuugcaacauaauugccugggggaaagguagcagaagucaccccgccacuguacccuggcagggccaccguggguggcauucugugccagccuugcagccaccagagcggccaguggagggcgccagccugcagcugaugcucugauggcgguggcauuuucugucuuugccuggucacugugccauuuuccccaggauaacauaaagauuauaaggaaccaauaguccagugaaauaaaaaugaguuuuuccugaaaguccuuuagguucuuauauaaaagcacucuucucugucuuggguuuggcacaucuccauucuuaaauuccacugaauuagcagcuuccuaaauaugucacguuucuuaucacaagccuacauacguuguuuuuucugcacaaagcaaauaagaacaaucgcuugauuauuugaagagaaaaaguuaaguugaccucaggcagcugaaaguggcaucuucuguaggaaccccgauuaaccaucagggggcgcucagacuuuguuaaauuacugguaggccuuuaaaaccuaaaauuaguguuuacagagauuuguuggcauagucauugggauuuuuuucuuucuggauuauuuuuugccuucuguuuuucagaaacauaugucuguuuugaggaacguucaagcugaaauugcuccuuuagaaauuguaauacugauuuccacuagcagucaaaaauuauuacaaauuuuagaauuuggagucuaaagacuaugucuuauaauaaauuagcuauuuucagccuucuaauaagacuccagaacuggaaggauacuuccugcugccgggagccauuccuccuuauccuggacaucauagacagugcuccuggcaggacccucugagucucauugccacacucaauuggugaggccucagagucacaauaacuuggguauauuuguuaaugggccauggcuauuuuuucuuuuuuuaaaaaaaugauaugacaggccaggcgcaguggcucaugccuguaaucccagcacuuugggaggccgaggcaggcagaucacuugaggucaggaguucaagaccagccuggccaacauggugaauaucccuaucuuuacuaaaaauacaaaaaaaauuagccaggugugguggugugcaccuguaaucccagcuacuugggaggaugaggcaggagaaucgcauaaaccugggaggcagaacuugcagugagcugaaauugcaccaaugcacucaucugggcaauggagcaagacucuguuuaaaaaaaaaaaaaaaaaaaugauggcugggugcgguggcucacaccuguaaucccaguacuuugggaggccaagguggguggaccgccugcagucaggaguucgagaccagcauggccaacauggcaaaacccuaucucuauuaaaaguacaaaaauuagcuagacaugguggcaggcgccuauaaucccagccacucgggaggcugaggcaggagaaucguuugaacccaggaggcagagguugcagugcaucgagaucgugccacuacacuccagccugggugacagaacaaaacuccgucucaaaaaaaaaaaaaaaaaaaaauagauauugaccaugaaaucgagucaauguguuacuaacauuagguuuucccucuguucuuuccuccaaauuccacccccugcucccgcccugggccaggaaugaguaucugacacccaccucugcugccacacaccucucaggagacccuuguugccugcaccucugucaagcacggguagucugcacacugcacacccuucccagccagcuccccuugucccccugcugaagaacaguuaacaaccagaccgcaugucaugcccgcguaugacccacuauuucaugucccuggauuuuauuggaaugcucuugccccacucuuuuaccugguuaaggccuucuagauuuuucaaggcuuaaccuucugaacguuuccuaagcggagaccuggcugcacagcaugcccuuccuguggucccccuagcuauuucuguuaucaucuguagucagggcuagaagccauuucccaguacccucccucccgcaguggggcaggcuucguuucauuuauuuauuuauuuagagacagggucucgcucugucacccaggcuggaguacagugacacgaucuccgcucacugcaaccuuugccucccaggcucaagcaacccucccaccucagccucccaaguagcugagaccacaggcacaugccaccaugccuggcuaauuuuuugugguuuugguagagaugauguuucgccauguugcccaggcuggucuugaacuccugagcucaggugauccacucuccucggccucccaaagugcugggauuauaggcgagccaccaugcccagcggcagguuucuuaaucaccagugcuggauagucauugugcuuccugagugaguaagcauggauauauagcuccaccauucacucuaguuuguuuuuuuuuuuuuuaaauaaaagucaguuuguacaaguucccucacuucuguauggcaucauguacuugagcugcagggaaucaugcauuucguacaguuaucugcauaagggugugagagagagagagagagagugugugugugugugagagggugugagugugugagagagugugugugugugugaauguguguguggacacauacauuuucaaagggagacugguaaugacugugaauaugcccucugcucaugcauccccaguuucaggaagcaggaccugggugaacacacuugcagagagccucacugggguucuuuccuggcugcugucuugucugcugauggaaaggugucuggcuucgggcccugaccuugaugagagcucuuggcacaugcuggaggccuggaaugucaucccacaguuccacugucaucaguucucagccaaccccacuguugccuuuucagccaauuucaugguguuuauucuggugucagucuccucaccggagcgugggcaccucaagggcaucgagcgagucugucuuguuugcugcugcagccccagcacagaguccgaugccuugcucugccccugcucuuggaaggccuggcugaggcaguuucccugucucuucccauuucaagggcacccacucaucagguuccucgaggaagaaacuucacgcaucucaggccugccuucccuccaucuguccccaaaccucccauuccuugaccccugugccuaaguacucaucacuuccacuuagaacccacggcugcacaucagcaaacugaguacaugcuuuuguugauccaaaugugcugacagugcaguggcacugcuuacugaagucugcugucugcaggcugucacacaggauugucuguaaauuuaucagaacacuuccaggaaggcauuacuguccccauucuacagacaagaaaacuggugcuuggagagguagggaacuugcccaggaucaugcagugagcagagucuuucuggccccagagcugauucugucucagcuucugaaagcagcucacauagccaggcacaugcuguggcaggguucucccugcccuacuguuuuacugcuucucaggaggcccuguggggcgggugucuacaacguguacauuuguaggagugucccaggaggagcauuuuguuccacuuuugcucuacugcuggcucgcucugugugucuuaggacacaucucuuaaccucucugggcucaaccacugcacagugaaggcucuggauugauaaucugugaaugcuguguucuaauuaaauaguggguuucuuggccuuggguauucugugucucauuuuugucuuuacuuguuggcuccacaaagcaaaaccuauugucaguaauucuuacuaacuuuauauugauguugacuguguagaccaauucuagcuacguuagccuuuuguucauauaaaaugaacaacugacacguaauuguuacuguuuuccauagugcacugugucauccugacuccacguauagaguguucacugugugccagggcugcucucggauaaaaccuauucuguugaaguccuggcuggcccuaacuuuuuaaguuuaacaagguugagaacacaagugacuuugauuagcauuguccuaaucugguuuaucaguagcaggggaauuuauaagcaguuaccaaaaugcauccaaaauaagauggcuuaauggcuaggcagaggggagagaugugaugaagucaguacagcagaaugguaacaagugagcaucucccuaaugggaaugggacauuccugguagagcugggagaaaaaaugaccaaagcuacugggaaauucugcagagauaauugucccauuacuuuuuaauuaauuaaaacuaauuaauuaacuauuuuuuuuuugagacggugucucgcucugucacccaggcuggagugcaguggugcaaugucagcucacuguaaccucugccuccaagguucaagcgauucuucugccucagccucccaaguagcugggauuacaggcacauagcaccaugccuggcuaauuuuuguauuauuaguagagacaggguuucaccauguuggccaggcugaucucgaacuccugaccucaggugaucacccgccucagccucccaaagugcugggcuuaugccaccacacccagccgauugucccauucaaaugagaccggcggaacaugguuauauuuuaauuuacucaguuaaucaucugcagugucuugccugaaaauggcuuauuuugaaguaggaccuccaguccaguuguaaacuucuagggaaaaaauaccaagucugcccucugggguuccaagagucgcuccugagccauggugcgggggaaaggcaggcucucuggcuugcagcaugggccucaugugaggcaguucuuuacaacaaugguggcccuugggccgugcccaggccacugccucaguccauacggcccgcaagcuaagagugguuuucacauuuuuaaaugguuggaagaaaauucaaagaauaauguuucgugacaccugaaagguauaugaaauucaaauuuccgugucuauacgugaaguuuaauuggaauacagccacaucuuuuaguuuacaaauuguccauggcuguuuuugugcuacaaacacaguugaguaguugcggcagaccauauggcccacaaagccugaacuauuuacucccugguucuuuacagaaaaccuuugccaacgucugccuuacaagauggaaacauuacuucuacacucucagcaaacauuacacaguuagauucugagcacauaagaccacauggugaccauaucucauggccuacaaccuuaacucuuugauuucuuuuacuuucugaaaugcaguuuuguuuuucuuucaucuacucuaguagccaaaguaguuggcucuauccagcacacaauagaaaguucucaggcuucuccaucagccuugccuuagcuuuacauauuagguaugaccuagagaaaaaaauguuggccccaagaauucuguauaauaaaaaaucaacuaugaauugcagggucacauuuacuuucagagauuuucccaaaaggaaaaauaauugcuccuuagauacgagaguggagaacaaaacacuggaaaguacgcucugcccuucuccguggguaggccacgcaccacgcacauuuagcucugaaacauguuuccugugagaaaaccaaucacacagacaauuaagaacgauuacacaauuaauucacauuucacuaggauguuuacuggcucccugcauuacacaauuaauucacauuucacugggauguuuacuggcucccuguggcuuaaauguucucaaagcuacacuguguaaccacaggacaaacagaaaaagcaaguucaaguggccucauagagacauggcuucaggaaaucauuuuuuccuagagugccacaugcggaagugaggucccugaaaugcucagugggucaccuccguggugggacucagcauugcuggcugauugcuuuugaugaguuaagugacgacuaacacacacucgcauagauguucucaugugucuguguuuacagccuugugcaugacuuuuuccuuuuuuuuucugcuucagcuuuucuggguuuuuauuuuuuuuucuuugccagcagggaagccaaagaaacuugauucugaagugcaauauugaauagaaauauguaaaucaaguauuauauaauugaauauugaucaaaugccuuuaagcagggcccuaugcuuagugaaguucgcuuguucauuccaagugaacauacucauuaagcaccuguuaagugcugugcaccgccuuacccaggugagcugaaacagguguggucacuacccgcauggaucuugcaguucagagggggaggacuggcacgucaguuggcugcacaaguggaugugaaacagcaacuugacgaggacucagugguaaagauagggagucagaagugggaaggcuccagcaggacagcacgacacuccugggggauccaccuuggaggcacugcuugggauuuaggucuuugugcagaaaucaauggaaaggcauugaagaauuuuaagcgaggaaguggagcgaccagauuugcauuucagaaagcucacucucauugccuaguggaaaauggauaguaggggacaagaugagugugugucaccaguuaggagguuguugcagagagagaagcaagagcugauaguuuuguugaccaguguacuggcagugcccagggaacuggugaggacugcaggaaguauugcaggggggucgagagggguggggguggaauuggcaggaccgagggccagacuggaugugaaggaaagaggaguggagacuggagaggggcuuggggagacuagugggucaggggugccauuugcugagacgggaggagcugagcucaccugccacuguguccuuucuccugugucaggggcucccugcugccccaccccgccacaccuuguuccccaguccuguccugugaaggccucugccuuuggaggugccgggcuuccucugugguccugcagcucccccaaucaccugccacagugcucuccauccacccagcuggcagagaucucuccugcucccccuguggcucuucuuguauggaccgcggcuggcaaauuagccucuuuccaccccuccuagcauuuuuauaauccacccuccccugcagcaccuagcccaguguccucagguagggggagguggggaaauaauagacaucccugcaguugcauuuagugugugugugaugugugugucacuuucuguaaaauggguucuugcaggcucaccucacugacagguccccacaauccuggcagcuccaggacugucagucagcugcuggccuuuccagaugcucguaggggucuuccaugcuucauggagaaauggcugugagcacuacucagucauggcaauuaaagaaacaggcacuaaauuuaaagggaacacugaaagguagccuagaaaaugauaccuuaguggagcauguuuuucugaaaaaaaaaaguaaauuauagcaaaacguagauuuuuaagccaaaagucaaccacacuuggcccaaagggaaggaaaagauauauuugcaggguuuccuguguccagaagaacaaggcccuggcugugagaagggcggugguggugcgugggguagggcaaagugucgagccaugcaccaagaaugguuucucucccaacaucuccugugaccauucaggcaauucugaaagaaucucagcaucauaaaacauucgagugacacucccugaggagacuuuuaaauucauuaaaauugcaaaagcuccugaaaaggcacacagagaaaucauaucccguggagccaguuuucuugucauauuggccucagucgagacgguccuggacgccacgaacacuagcauuuaugugacacuugcagggcccucuaccagguguuuguuuugaacuccuuucuuaacuguuaguauugcugccacugguuugacuaaguauuuuaacuuccuuaccaacaucuugaauucccuacugcaaguguuucauuuuuagcuugccugaaagcacugaaguuugaugcaucacugucuuccagaagacuguugagggaaaccgguccccugccucaggggaacaugcgaucauccucccccaagaacacguggccccacacaggcacagcucagcagggcggggugggccaugcagaccugccgaggggacacacgcaggacgggagcaaugcuguugaguagcgacccucccgacaaggccacgcugcaucccgauauuuucccuuuacuuuuaaacucugggaaguaaguguaaaguucuggccuccagugaaucaaagugcuucuucucuaaugcguucauuaugaaaauauuagucucauugucuuuucuuuuucagaacuuagacuguuucuuuauuuugcaggcaugaaaacaaaaagaaacccgugaucaauuuaaaaucuaauggugagagagauaaucggacacuagauuuucuuuuucuguuuuaaccaaaaaacucugugacaugcauuuguuguuugcacccucaugugaguccugaagcgggcaugcucacagggacugccauugcagcugucccugggguggaaccugagggcuucuggaggcucaguucuucacagacaggaccacacgggugccauggaccacaggggcagagcauuguaauuugcaaguaugaauuugcaggggauccuggccuccaugucuaauuaauuaucagcacccuguauuuuaccaaugaaauguuucuugccucucuccucauccucagaagcacccauugcucaugaccggacaggcucuuggaguaacucuaacugguuuccucauacccaguuccucccagcuccugggaacucccagcuccuccaccuggccaccagccuccaaacccuggcuucccccgaccuuccuguguaaggacggccaaugccuccccguaccuucaggguagagucugagcuuucuccauuccugggaggccccagcccugcucuccagcuuauuccucccaaggucgccucuuugggucaagccacagucagcuuuuuucagcuguagcacaccuaugccucuguaccuuugcccauguuguuccuucuguagggaguuccuuuuccuuuuccucagcccagugagcuccuauucauccuucaacacccaacucacgggaaaaaucuagcccuccuaccauaacacuguggcauauccccugcccagcuugggcucucucaccuccugucuccuuaaaccccuuauaccuuaaauuaaagguauaauuugauuaauaguuuuacugacaauaacaaaaauauucgcuguuuauuuagccccaguaugucccacuuugcuaacccaguauggaaacugauucagagcugcuguagaaccuaggccuaggaaucugccuuuuuagcaagcaccccacugugaaucacucuucuagaaggacagcuaccuacugugggggagacaaguacccaguggguugugauggagaguaugggcuugagucagaugacuuggaugggacucccagcuuggccacucacuggcauugugauuguggccaauuucuuaacccccuucagcguccguuuguuugcacagugaaauggaaacauuaauacuuaccuugccaggcuggugcgaggaugagaugggguuguguaugagaagucagcacagagcuggcagguggugccaugcaggugucagcagaguuaagggauuguugauguaguagacgugguccgcuccacuacaccuugccagaccaccugcagggcaccucagcuccaauucacagacgcgccuacagcuuccugcaccaagcagcugugucucucugccugagggcuuucucuggcugcaggagcgugcucagcccucacaaggcagcccaaaguaccagggaguugaugcccuggguugagagcaacccucaaccaacagaggcaaguugguggaucaguaaccccacucccuugcucuucacugggacaaucuggggagaguucugcagucucucagggggccccagcaggcugagccuugccuguccacucacugccaggcacccacucgucaucauacccuucauuggcuuccugucuuccuugugucacuguccccaugguuccugggaucaccucucaaguaaaugauguggaccaaaguccugucucaggguaaccaucucugcuuauuccucugccacgucuuucccuucuccucucugcucucauaaagaagaaugggagaugaaaguggaggggcagcugagguggggcggcaucaggcugauacaacaccccagggaacccugcuuccauguaacccugaccuuaaaucccuauccuauaauaaagaguugggcacaacagaagggaaaaggaaguauucugcaaauuguuuuccauaacagugcagaggacacacuuugcaauguguaauuugugcaguaugacaugcauuugggugugucuggucagguacaucauguggugucccuguuaugcauuuugcagacugacacucugcuuaaccaguccuuccgugcugugcuguuuuguaagcucuuaaccagaaugcaaaaauguuaaauaacugucugguuuuauuuuccagcccucugggaugagucugaugacaguaacucagaaauugaggcugcuuuacgccccagaaaccauaacaccgaugauucugaugauuuuuaugacuaacgugcugugacauugguuucaaauaaagucuuuaaacaaacuaa

SEQ ID NO: 191248 - RNA, 197333 nt, Homo sapiens
agacacuggccgcgggccaccaucuggacgcgaucccccgcuagggccucccuggucugggccaaaguugguggccaccuucgcgcgggcugcgcccuccuucucuucccugcccuccucccccggggcccgcgcccgcugccuccagcacgcgcgucggcaggcucggcaagcgaagaggagcggcucgccccagggcgccccucgcccagccugccggccaggcgagcgcgacgagagucuccccgcaccccuuccucucccgggggccgagaggguugggcuccgccccggcgccgcagcucccgacuccccgccgcucgggcugccgccgcugccccgcgcccggcgcucggggcagccgggggcgcaggcggagagcgcagggcggggagaggcguggggagcagagcggcgcugaggggagggcagaggaggagagagccuggcagcggaggagcagaggcgggcgccgcaccgccccgcacgcucgcucgcucgggagagucgcgggcggccgcuugggcgcacuugccgggucaccuugucccggagguaaguccagaccucccggccgcgggggcgggcggaggggcccgcagugggcggggucgcggcaggggccgcgagcuggcggcgggagcuggaggcugcccugcgcuggcggguguccuaguccuggcuccgccucggagcgcgcagacccggcggcggcguggcgcccgcgguaaguccggguggucgccgcgacgagacuugggagacacggggucgcagggcgggagggggagcugagccggcagagaaaaugcccaggaaggggucgaugcuggccugggcugcaccuuggugccuugccaccccgggagacgcgaaggggcugcugugcgaauucgaugggagcuggugagaccgagaacugagagcguagcggagccaggcugcccagcagggccaugagggcgcgcggcgggccaaggcucugcggguucgggcugccccucggagugacccgaaggagaccagccagggcuggugagccgggcggccacggagcuggggaccuaggucuguuugggaguaggaagggaaacagacuaauucuccgagcggagcggcaggcaaggugcaagcgcgcuugggauggggaaucccgacgggcgaccguggcggaagcagagacuccuggagccucuuuccucuagccaggacaagaccugccuucaaaagcugucuggccccuggcagccgcgacagccugcagcccugggagccacagcccuggcgccgagaugggagcgagcacauacgcuuuuuugguuccaauuugaaucucgcuuuuuccuagucgugauuucugccucuucaugugcacucucugggcagugaggaggaaggaauggcucacuggaugaguugggcacuuuucuuagggaaggggcuuugucccuaugcgcuuuuugcaagacccuacuagaguggcucuggcagccgagcuuugaggaggcggccagaggggccgcuuggcguuucugaaagacgagaggaaggggucuucugguaguccuguuuuccuuuggggguuucguugcacgcagaggcuugggcgcuuggcacccagacuucaggugcgcacaguccuccugcgacgucagaugcgcuggcgccgcggcgcuccuggcucggaccgaugccugcgccuucccuggccacguccugguguuuagugcagcagacaccggccgaaggcuuggcugauugggggugucgaggggaggggggcugggcguuacacaguggcuccguuuucugguuggaaucaguuggugaggcgugcgcgcgcgaguccguguaucuguccgucucccuccuacagcccagcguguuuggucugaguccaaagaaggagguggugugugugcugcguagaccugcgccuguggggugagcagccucauagcccccagagccggccaacuucuccgugcuaggcugcgaccucaagggcugccgcgucggggaucggaaguggucuucaaagaggggucuaggucgcgaaauccuggcagcagccgaagugaaaaggagcugcuaggaggcgggcggggggcagucugauguccguucuggcgcggacaggaagaaacugaagucgaauuuuuaguugaauugcgugcucuguguuuggcggugguguggcccguucuuuuggagguccacaccacagguaugaggccugugggcccugaggaagcgcgauccccuuaauuccucccuccccucucucuccaccgcccgccccuuugcaaggagcaagccugacaguagcugaucggcgcccucucucacccuguccccauuuccugccugaaaacggaauccucauaaucaagagggccuuguuaaaaaaaaaaaaaaaaaggaaagaaaagauggagaaaccuauuuuuaaacuuuuuuauuauggaaaauuucaguuguacacagugacagacagagaauagcacugaagcuuuguguaccccccacccagucaccaccugcaguuaccuuugguagaguuuuggaggccacagaguuuuggaagccuuguuugaugaaguauuucaaaacucauuccaaaaugcuaaguauuggauaguagguuaauuagcuccauucagucaugacacauuguauacgcauaucacagcaucauuuuguaccccauaaacauacacaauuauaauuuguuaauaucugauaaaauaaaccaauucaguaaaaauacaaaaucacuuugauguaaacuucaaaaaaauaaaaaaaccauuccaaacucacuucaccucuaaacacaucccucuguaucuccagcugaugacauuucauuuuauguucaccuaucagaaaugucaguuuuuaauaaccccauuagaguauaggugauauuaaaauaaaaaugaaggcccccuccauucccauuuuaggguagaaaaggaaaaccugccaacuuuacuugaggcguacaggggugagauauugaagaaggaaagacaaguccggauccugggaagacagauauguuagcaauaggaacagacucauucuaauucaugaagggcgugaacacgauucugguugagccaugauaggcaagagaauuuuuuuugauaaaaacuuuaaaacucaguucaaaaauuauaagcaauuaauuucuuccacauuuagcauugagauaaauuaaaagugcucuaccagacuugaguuauuuuucucauuaauuuuaaaucguauuuucuagggaguuauuacuauuaucagagaauagaaaguuguuuucuuauguaagauuucuaucugaggcacuagucggugcuauucugagguucauggagaguacugaacauuucauugucuaauuagaaaauguuuggucauccuccaggucacaccugcucugcccucugaaaaggcucugugcuugcugagaugugauauucacugugacuucuacugucuggagaggcauggcacgcagggaggcacuggaggcagugggaggggaggcccucccuccaccagcccccucccauucugcacaccucugugcuuuccuguauauaaaagcaguuccuaaaaauugucagugauguucuuagaggagucagucagacuuuugaauaccuuuauaaagugcacuauuuaaagguguccuuaguuaaccuuuuguaagaugaauaaccaucuuguaggugagcaguuuuauguccugucacccauccccaaauaaaaccuugucuuuucaugacuccagcuugacccugugccccucacauuggccuuucagacccucaugcacauuggaaaaugcaggcuccaucucagaguaaauguaccgcuguggcccauaguuugaacagaugucacauuaucagcaaaauucuuugaaugaguggguaaaggugacaaggacugaaguaugugggguguuaauuugacaacaccagcagaacacuagggguaaaugacuagcaaaacagccucuuguaucaguggaaaguugcauaaggucauuuuggggcagugcacugauagaaguuuuuggagccuuagcucuugacccggcaucacuacacuaggggcauggugucaaaaucucuacaaagcaguauucaaaacauuagagauaggcugaccaggucucuaaccacgucaccagaauuagaauaaugaaguugucggcaggagguuugaacaaaugugguuucucagcauucucugugcaagaugcccauuuugaaugauuccugagagauccuaaacuuguguucaaagagcagaugaaguaacccgggcaccagcuaugauucagugcccucaugguugcuuugcuuauguccaggcagcauauuggauugcacggggagugggggagggacgcacuggggagacaggcgugcagagugucuccugucuccaggcuacucccucuuucccccugggccuuucccgagugccaugagcagacauaggcuccagaaucuggaaggucccauuuguuuucucagaaugccaugugaauacaaauuuacccagagaaacauugagacaaugaaguguccucaauccagugucuuuuucauuuaacaagcugugacaacauuaacgcuugguuuucaaaauccuggaaagaauaugguugaaaagaaauggucucagaaaagugacgugguuugucuaagaucauucaacuagcaagcagcagaacccagagucuggagccuacaaccugccaucagcaagagugaggacugggacaguguguuugcacucacuugggguggauggauacaugcacaggaauguacccaggguguguacauagccaugugggcuaaagauuuacaggaauggauaggaaaggcaugugagcaauagcuuaugaaauuuauccuuagcauaacuaaauuagauucauauuauguuauaaaacuuacaugaugcauucucuaagauggaaacauuuuuaaaacagauuaccaacagaccaccacccuccauuuauaauaugugaugauucaagaugcaagcaugguuggaugacaaacuguaaaucaucuuaaacuauuguuugauaaaugaccuguuaaacuaccaaaaacaaaggaaaauagaaacucuaaagaacaacaacagauaagcuucaggaucaaaaauaacugcuagaaccaaaaauaacagaaccaggaaacauuaaacacagguagaaaauaauaaaaauaaaagcuguuuccaaaggcacaacccaggggauaaccuugccuguuuagucgcauaaaaagaauuuaggaguucaguuagcauuauuucagagagaugggccuugcaauccguguucagugugaaaaacuuuuugcuugguuuuuaguuguuaacugaauuuuugucaauaacauucauuuuuaaauacugggguggcauuuagagaaugagucugaaggagagaguacuugcguggauuucaaacugcgucuuucaagaacggcucacuuagguuaaauuucuauuuugaacaauucuuaggucuccaacaaguucaguuguaaucuaucacuuggccucacugggcaggcgcccgcuuucacacguuaccuccaucuguuucuuccuuaccuuuccucuauuucagaaaacuucagugcccaaaacaaaaccagaaagcaaacacauuucagauaauuagaaccacaaaaguuuuauuccauugccucaacuuuaaacuacagaucuuucugaaagggagauacaguaaucuuaccucaaauacacuuggaaccaccccccaugcccccacuuagaaaagcaaauaaaugaaauguuacagaaacucacucuucugucaugaguacaauaggcaguuuuuaacuuccuccuaugaucuugguccucacauguuggugguacagacccucagcuagcaugggucugagaugcaggaguuuauuccugaagaugcuaaugggauuaaguccugggacaguuucccaguggaaacccaguagccaugcuggggaguggccugaggcauuagcuuuaggguagcccccagggaagcccaacucauccuacaaaagauugguaccaauuccauuguuaauuauuugcaguuucuaaaagugcauuuaagaaagccuauguguuucuguagccaaccuucaugucugacaucucagccucagcccaucacccaugugucucccuuauaagaaaccuuguccuuaugggucgagugccccaugggauaauggcacaggaccaguagggcaguugaaagaguugaaaugugauagguagugugcgugguuucugacaugcugucuaagcacaggggcuggccugggcuuguagucauagaugauugacugucauggauugacuguaagaggcacucguuugccucagaucucccauggaaacccuguauuugugaggaccuuggagaggacccugcacagggcagucccaccaauccuaaccuagucuuggaaugcuuucagacaucucuugccuguguacgauucuggcuuuacuuuucucucccaauuccucaccguuuccauagugccuuugugacaaguggcuccacaacagagaacugugagcuaauuaaugugcauaguaucuuuuuuuuuuuuuuugaaaugacgucucacucuaucacccaggcuggagugcaguggcacaaucucagcuuacugcaaccuccgccucccggguucaagcgauucuuccaccucaaccucccaaguagcugggacuacaggcgcacuccaccaugcccggcuaauuuuucuauuuuuaguagagucgugguuucacccuguuggccaggcuggucuugaacuccugaccuuaagugaucugcccgucuuagccucccaaagagcuggaauuacaugcaugagccacugugcccagccuaaugugcauaguaucuuaacaguuuuuuuucuuauauacuaaacccagagauacagcucauucauuucaguacucuaauaauaguuuaauacacuaaauuuccucacaaagacagguuuuuguugaaagcuaacuuugagucaaggggaauaaucuguuuuguuauuucuaaguuuauucucugcccuucauuauuauccugaucuuuaaaagcuguggauauuggccgggcgcgguggcuuacgccuguaaucccagcacuuugggaggcuaaggcgggcagaucccuugaggucaggaguucaggaccauccugguuaacacggugaaaccccaucucuaccaaaaauaacaaaaaauuagccggacgugguggcgggcaccuguagucccaccuacucaggaggcugaggcaggagaauggcgugaaccugggaaguggagcuugcagugagccgagaucccgccacuacacuccagccugggugacagagcaagacuccaacuaaaaaaaaaacaaacaaacaaacaaaaaaaacaaaaaaaaacuguggauauuaaguaucacacacuuuguucacaaugggaucaucaaggcucugcuggaagccucuccuaacugcucuggacuugguaaggacccugcagccugcagcacagcugucccacuaaaguagccuggagcaaggagagucauuuguccagcugcaucucuguccuucugccaucugccauggcccugcuccuguggguccucuuguguaacauucauugguacacuugcuaaucugaauguucuggguguagguguauuagcuguaaaucggagcccuagauauauuugaggacaucacagucuauuuuagaaccauagacaugaaauguaucuguugacucaauaugugcagaauucuguagcuuccuuccuugccuauugcuagaccucgaguuucugauuugccacauaccuuuccaggaaaaacaugcgucacacucuugggacacaaaaaugaguuugcaucccuaaucucagcaacgguucucucuguugcucuucacaugccuacagggcaaaguggcacagggcugcuuagugagugcuggggugaccagguggcccuaccgucucaccauugauguugggccauagcccguccucaaacacacuguuuuguuuuuuuuuucuuuuuuuaccagagcagggccacauggacaccucccuccucccuaagcuuuccugcaucccauugauugucuucagucaccuaucugucccacccagagucuggcacugcaguuaccagcuagucuguucugcuacuucagccuugcccccggugcaccugggacuguagcacccagacucauagacagugggaacaaagggcuuccugauggucucuggaucagagagccaagcuguaacccaucugugauugcccugccucuccaucaucuuguccuccagugauugcaaugcccuggauaccugcagagguuacugaggggaugggguauacagcaccccacugccccuggcuccaguguguccuguacauuaugcagaaggccaggccagugcauggaaguggaguagggagagccauggcucugggagauauuugcccuucaggggagacugaggcuggggugcgauggaggggcugauggaaagcccagcauuggccaaagaauagaccucagucacuagcacuucuacacgguuauagauacuccaaacuccagguguuucugugcugucuggaccuaagacacagacgugggcuuccagcauuaccgaccucaggauuuggcucugggcuggacaagaacuccacccugccaguggcugagcauccucucuugguagaaccagguaagccuggugccucaccacagggccgccuggcugcccuaaaaggguggcucugcucuucaggucuggaugaaauagaggugagcuaaacaauugugaggaaauaaagggagcucaaacccgaagggucagauuaaagcuggcagggccuguuuggauguugucaugaaggagauucaggaagaccaccagcuucaaccauuggugccuuauugcuucggugucugucucagggaccagaguggcagcgccaggcagggcaagggaggagcccuaggagggagggguggagacugagcuuuggcuguuauucugugugacucccucggcgagcuccccagaugccuguuugacacuugguggaaugaagagacccagagggcuuccccaacgugccguccagccucacugucugccagaggcagagccagggcacagggacccaaauuuucagggcuugcuugcuuuuguauuugucucuaaagugcauuuuuucucacccacuguacuuaguuuucuuggcauugcuggaaccuagaauacuguuugggacaaugacagaccccaugcaccguagacaaacagaugcagacagcuccagcuuccagcaagccccagguagaacacaaugugaugaggacauuucuccaucugugcuuuucagugguuuccugggaggagagcgccacagccagucaggggcaccaugggcaaggggaggcccaguuccuaggccaggccaggagucaugcacuuagaaaagucagggagaacagaagccucccacagaacucacaggcaggcagaggggaagcugcauuccuguaaugccagaggccaagacauuuagagagaauaucggauugaacuccgcaggacagcaggucgacugucagaccucgugggcacuguguucuugucucgcucucagcauaaggcuuuucccggaagauggaaauguucuuucuccuuagacacugcccagaaaugcugaucuuccucgaauuucuauucagagcuuuaaauauuacagaaauauauauuuggugaguugggcucugccaacuguuucagucucuccauaagacuaaguuggugccuaauuagaguaaaaacaaggaugcaaauugcuucuuggggacccaaaucagagggucucugucuccaccagagccuggcccagcccuggagagugacuugggagccccguccugauggguucuucccgcuccucugagaccuucuccccgagcccucacccuccuuggauuccgccugccaggccuucuuugucagaauggaguggccccaggggcaggacucaccucuaccaacugagcuuuccuaugugcacaacuggcugcccuagauauuuuccugucccuaccccuuacccaaggccaucucugggauguucucuggggcagcagccucagugaacccauucucuaucugcucccuccagccccucaggcuucccuucccaugccccuuccucugauaaugauacucaguaacccaggaauccacaccagaaacucccuagccccugugcuucuuccucuuccucaucacuagaucuaaguauuuccugccucucucuugcaucuuuuccacccuuggccccauaugcacacucaucucuugccagaucaucucaguaccguccugcaagcucucccugccugcugcauugugccucuugccuccaggacugccaggagagugagcugucucaagugcagauccgccucuggggcgcuccucucgaagcccccuacuggcacuggacaggcugcuugggaaagauacaaggcaaggcuguccugucagucccuguucacccuccagccucaucaccauuucucuaggugcccagaacacugaguuacuccugcccugccaugcacagguacaugugcacacacaaaugccugcacacacacacacuccauggucccacacgugcacgcgcgcacgcacacacauuacauagucccacaccucccccaccugcaguuggcuaccucuugccucuugcuaaucuccuuugagguucagaggcuuagcuugaucaucaccucuucccagcauccuuccuccaaguuuggcauccccgcuucuagguguccuuggcaccugggcccaucccagcacugguguggcauuagcagaacaaccgaagaugaaauaucuacaaguaacugucaagaaauguguaagaccuauauaaugcuauuucaaucagaaugccaauauuauauugccuuuugagcuugacagaauuauucagaaguucaugaaauuuaggcuacaguacuaaauuuuuuucagugaagaaauguccuaccagauaauaaaacgaaguguucaaauuacguuaauugaccucaaauccauuaggauggcuacugucaaaaaaaucacagaaaauaacaaguguugguaaggacguuuggaaauuggaacccaugugcacuacuuggggaacugugagaggacguaguugcuauggaaaauaguguggagguuccucagaaacacuaaacauagauuugccauaugauccagcagucccacuucuggguauauauccaaaauaauggaaagcagagucuugaagagauaugcacaugcccauuuugauaguaacauuauucacaauagcuaaaacguggaagcaagccaagagucuaucagcagaugagcggauaagcaaaaugugcuaaacacauacagugaaauauaguucagccuugaaaagaaaagaaauucugucauaggcuacaacaugaugaacccugaggacacuaugcuuagugaaauaagccagagacaaaaaggcacauacgauaugguuucacuuaucugacauacugagaguucucaaacucagaggcacaaaguacaauggugguugugaggguuuggggaagaggagaugggaguuauuguuuaaaggguauagaguugcauacgugcgagaugaaaaaguucuggagaacccuugugcagcaaugucaauauacuuagcacacuaagaaaugguuacgauuauguaaauuuuauguuguguguguguguguuuuuugccacaauaaaaaaaaacuacauuaauuggaaauguaagauucuaguuacugguauguaguuaacaggcuauucugaucuacuguugcauaacagacugcccccaaaacucaguguucauggaucugugggucaggaauuugaaagggcacaguggggacggcuuaucuuugcaccauggcuccuggggccucagcugggaagacucacauggcuggggcuggaguccuugcccagguugggcucacucgaagccuggaccaggagcaccuacacgugaccucucccuggguuuccucccagcauggugucaagggggccagacuucauaugccgaggcuucugcuccaaaagugagugugaacauggucaagacugcacgaucuccugaaccgucuccacagccacucugggucagcgccacaagauucugcugauuauaggcaaguuucuaagccagcccagaaucaaggaggcaaauuagaccccacuuuugaagggaggugugugaaagaauuuaugaaccauguauucaaucugccaugcagacagguaggucagacagagagcucugaaacagaugccagccccaagagccuaaugaaugugugggagcuggcggggagagcugaauuagucaacauggagcacuuuggaaguagguaguuggacuguaaagucaauuuauaucucccuauuucauaaaaaguucugaauguauauaaaaagcauugauaaauaaauauucuagaagcaugaauaaauucagccugaacaucuuaccguaaucccaagugaaaaaaaauugauaaagauuaaauauauauauauguacacauucuauacaacaggcacuguaaacaaaauuggaacgcauauaauaaucuggaaacaaacauuugcaacaaauuaacaaaugcuuaauaauccucacagagcaaauaagaaaacacaaacaaccuaauuaaaaacugagcucaugccauggagaaaaaggugagaagaaguggaaaugacuaagaaagaaauacauggaaaaacauaugugcauuuuuacuuguuuuuugguuuuuguuguuguuguuguuuuuucugagauggagucucacucugucacccaggcuggagugcaguggugugaucucugcucacugcaaccucugucuccccugaccuugugaugcaccugccucagccucccaaagugcugggauuacaggcgugagucaccacgcccggccgugcaucuuuacuuguaaugaugaaaaugcacaugaaaguuagggaagacacaucuuuccaaaaugauugcccagcuucagagauuccaguugcucaguaaaggcaccugaggcagccuuugggaucacuggggagguugaaucucuugucuugaaaguuucacugaaauguucacugagguccuuccccuauaucuguggccacacaacagaaccacuaaaacauuucuaagauacacgcagaguauguguaucuugcuuccaguaaugaacugucagaaaaaaacuaaaugccugucaaaaggggaugguuaaauaugaugcaacuauuaugauguucuuaaaauaaugauuaaauuauucuaaaucccuuguccauuggccagggcugugcuggguauguauuuacauggaucaauguccaugguaaacuacuaaggauggaaagcuaaaggaaaauauguugaacauuugugugaauauguuauucucugagaguuuaaauauuuauucagauaauucuugaaagcuguucuccacauuguuaaugguauguagccaugaagaguagaauggaaauaggaacuuccaugguuuuaauuuucuaugcauugguaugauuugaauucauaaauauguguuguuuuugcaauuuaaaaaaccuauuuaaacacauaucuauccuuuggaaguaaucagaggucuggauguaauguuucggcuacacguucacauucauaccugauuugggggaaguggaaagccuggagccuccuagaaguugagugaagggugucuuugucaagcaugcagugcacguugugguugcagugugacgcagcaggaguccaagccgugggcacucacacgcaugcagagaaaggugugcauguguggaagggacugcaggagaugccaguacugccacgaguagcuccaggcaugggguuacauguggauuucauuuccuauguuauguacuuuucugauuuucaacuugauccuugauuacuguuuugauuaggaaaaaaaacccaaaaguuuagaaauuguuuugcucucucucucauuugacugaaaaucuguuucuuaaucauauuuuauguucccacguccuaugcccagagcuagcacacauuaugugcucagccaguguuugcucuuccuguacuuccccugggcaccucccugccccuugaaagagcgugcucugcauucccacccaggagucccagccugaggaagccccucuccucugagcacgcgugugcacgcaccugccugcggcugaccgucuuggcucuaagccccacagcaguggauauguuuucaagaguaguucguucaccacauauugaguacuugccauuugcuugaccuuguggcagaccccagagacagagaugaaaggcuuuggucccucauggaagaagggcauucagaggcccugccuagugugcagggccucacuuugcuugacacggugcaagugcaaguggcgauacaggcaggccagcggggaugcugcguccagaugcagccaagacucggaaugcgaaagagugacuagccuggaggaguagaaauaaggggucuucucggcagagggugcaggauagggcagaggucacagaggccuccgcgcaccuaggagguggaaguuggaugugacuucagaauuccgucugcaucagugguguuuacugagauccaggugcccacacgagaaacaacagauggggucagacgaauucaagugcaguccuggcuaccuacugcugcccagauugccccaaaauguauagcaugaaagcugcugaggguugggaauuuuggaggggucggcugggcguguucagccccauucucucaggcaggugcugucagaguguaucuggagccagaagaguggggggccuggggcuacugggggucagccagguaacuguaaccucaggggugcugcacguggucuccccacaugaacgauauuggccuuucucacagcauggcagccuugagguauuaaacuucguaaaaggaaggucaaggcuccgguuugaguuuucuaguaaaagacagguugcgugaacuuuucugaccuagccucagaggucaggucacgucacugucgccacacuccuucuguucagggugagucucaagcccaccuggguucaaggggagggagcagagaccccacguuucacugagaggaguaucagggccauauccaggaauagaugugggaugggaaguaguguuguguccaccuuuagaaacgaugaucugacacagauacuaaaaaacaaaauacuccaauuacuugcccuacacacaauaggucuuuaggucacaaaauaaugaaaaguagagccuuuucuuaccagaaauuuaucuagaucuauuuguuuaacauauggauuuucuagagugcuauggcuugaguaugaauuauuuguucccaccaaaacucauguugaaauuugauccccaauguggcaguguuuggagguggggccuagugggagggguuugggugaugggggcagauccccaugaauggcuuggugcuauucuugaaguagugaguucuuucuuccuugagacuggauuagcgcuccagccagagcagguuguuauaaagcaagguuccuccuucuguuuggucucuuucccugcguuuacacuucccuuuugaccgucucugccauguuaugaugcagcacaaaagcccuuaccagaagccggggccauggccuugaacuucccagcuacagaacugagcuaaauaaaccucuuuccuuuauaaauuacccagucucagguauucuguuauagcaacacaaaacagacuaagacacauagucuuaauuauuuuccaaugucuguauauauucuuagugugucauauuguucuuuaaaaguaucuucuagaguguggugcuauacuugaguccaugaugcagaaucugggacauagauugauagcaccaauuuuguucauuagauggaugcauuugucauuacguaaggaaauuauaggucuuuggaauuuucuucaauuccaucucucuccaauguuuucacugaagagauagaaaggaaaagugggaaaaauuuggaaguuucagguccuuguagaucuagugacuucuccagacuuaugcagaaaucaguggcaaagcuaauuuugauauaauuuggauacagcuuuuuauugccuuacuucuuuuuuucuuuauuucguacaguaauaucuccuuuaaagaaagagcccuuuuagcaaguguguguauacaacguagaaaugguacugcaacaaaugacagaagacugaauguggcugaguguuacucaggagcuaaacaauggaguuuuccauaccuggaggaaucuggaagcaggagcuacugacucagcagcucagugcgguuggagcuggaucucuauaguccuuguggccuuucccuccuggcucccagauggcugcuacugcccccgauaucacaucugaggucaaggcaagaagugagaaagguggacagagacccccccaggagaugucuuuggcccaagcuuugucucguggccacccuugguaauaagaaaguaugggguacaauugaggauuuaaugagaacuuaacucuuccacccuccaggugaaggugggcagggugaagcacugacauccagcaguggguccccuauucagccagggagggucaccccagcucucagugacaggcgugccaaggccacaucacaggguaggugugggaagggaagacuggguguauuuaugaaaucaaaagaaaagucagugguuugcuggugggugugagguuggguguggugugggcaggauggcacaagagagggcagggugggugcuggagagguggcaacccccuugccugggcuggggagccagguggaggcccugggcugaugccauugcugcuuauccauagacuuugaauagcacagguccagagugguucucaaguuuugcugcauguuagauucaccuggggauauuuaacaauugguuuauacacaaauaaugugaagaccaaaaauugaguuuagucuauaauauuaaagcagcagcugaaucaguuuugcuuacugaaaugucuguucaagcaccauuccucaaacucuaaugcacucacauaacaccuggggauuugcaggcaugcgagcucugguccagugggucgcuggaaccugagagucuccauuucuuuuuuuucuuucuuucauuuauuuauuuauuuauuuaauuuuuuuuuuguuuuuuugugauggagucucgcucugucaccaggcuggagugccguggugccaucucgguuccccgaaaccuccaccucccggguucaagcgauucuccugccucacccuccugaguaucugggacuacaggugugcgccaacaugcccagcucauuuuuguauuuuuaguagagaccggguuucaccauguuguccaggauggucucgaucuccugaccucgugauccaccugccucggccucccaaaguucugggauuacaggugugagccgccgugcgcagccgagagugugcauuucuaacaagugccagugaugacagugcugcuagcccgcaggacacacuuugagcagccggggaaucacgggccaagguuggggggagagggucgguggauguggggugggggguauuugggaguaguugucccuggcugggccacaggagggaagaaauggcuucagcuggagaggccagcagcacagagcuugcagacuuucacuuaugguuuaauuugccuuaaguaaacuuauacaaccuggauuuugggucaagaaauauaauaugcuuaaaauuugucuuauguaacaauauaauaaaaaacaaauuuuuaccauccuuuuauuuaaacauuuggagguagaaaaucagugcuguaguuggcaacugcuaugcuucuggguuuacugaggugaugaguguuacaaaagacacagcaagagcccagguucacaagggauggugguccagaugccagcucugucccuuacagccccguggccaugcugaguuaucugcucugguuccuccaucucuaagugagagaugagugcuguuaucucaggaaugugagguaaugccugcaaaggguccagcgcacuuuuuucaugcagugggacuaaagaaaugaauccguguccacauggaaaugcacccccacgugcacacagauguguauguguacauguauauguguguguauaaguaugcaucuaugcaugcuaauauuccuuccuucuggaauauuuggccccaugugauguguuuguaacaggggcugcaacacuuccucucauccuguuucacacagcccagcccuuggcacugugacauugccacagcucccgucaagaagaggagguccugggaucuggauuuggacugaccccauaacuggcuuggagcacuacaaggaagcgaaaguggcgauggacccauucugaggugguacagccagcagcuguccaaacaugucggugaggcuguagugugccgaucuacuccagcugacugcggcuucaucagugaccccaggagagaccagccaagaaucaagcaucccagcgcagcuucaccugucaacccagaaaaugagaugacuccauuuuaacccaccaacucuuagggugauugguuacacaacaaguaauaacacauggcuagaaaaaaauggacuagaaauaucucugcauaauacucuauauuuacacucaacaauauagcccuugaguaaacguuggaagggaauucagcuggucauuuauugcuccugcagagaggaagugugggaaauaauucagccgggauccuggcccugguaaaaggcaaggcaccaugcgaggcacugcauucacagugaaccagacgugagagccaaacagacguuucccauuugugcacacauacaaagugcuucgcccagugccuuguggggugcccccacuucucuucagugcuccacgucuguuuguaacucacuguagcucucacuaccugguggugugccgacaacaaugguagaccagcuggacaagccccagaguggggagcagagggaacacuucaucugcuucaagcccuucugcaggcuccaggcacaaacugaugaaggacagaauucuuuuguccugcuggagccagaggguguggacaccagaggagccgucccugggcaucacauuggcucuugcccaagaaaggugaguccucguuuguucagccuuugccaagaacucuauaccccaggcaggcccacggugucucauugaugagcucagugggaccaaggugugaguguuucacaggacagaaguuaaauauggaauacauuuccugccuggacucucagcugaaacaccucuccaguaucugcugaugucuuuaaugccaggccuggugccagagcauccccgggcgcucggaggaaagggacacgccucgcuccacagcucuggaauggggcauugguccuggggucaggauuuuccuccuguucuaugugaaaagccucuuccccuguuagucaucauuuccccacuguggcugagcccugucccuuggucuuggcaagucuaagcuccuguggaggcugagauuccugcagguguccugacccagaaaugaacauccagcuucuuuuagaaggcaguguucuagaaauguggaggccaccuucccaucuguacgcaugcacacacccacacucaugggggcacacacacauacacaugcacacauacacucacauggacacagauagaugcaugcacaccgacauguagauacaugcacacacacagacacacaugcaugcacacacgugcucacagggacaggcacagucacaugcaggcacacgcagacacauggacacacauauagauucaugcacacacacacaagauacaugcaugcacacacagacauguggacacagauacagacacaugugcacacagacacauggacacagacacauagauacaugcacacacagacacaugcacacagacacauacgugcauggacacacagacacauggacacauagacacagauacaugcacacacacguacacaugcaugcacacacaugcucacagggacaggcacagacacaggcacacaccacagucacaugaccacacacagacacauacaugaaugcacacacacaugcuuaaacagacauacauucaccacacacacuuauauggacacagaaaugcacacacaggcacacuuauaaccugaacaguaaccucccaccucugugaaugucacugcggcauggagggaggagggaguugccacuggggagccaggggccuccagccaaaggacagugugcgguucagggacagacucgagcagcaagucaagaaccagaaguucugaucacagccacuggagugcguuaagaagcccugugggcuguuuugugucaucaccaagcaggccuggccgcuggugcugcagugcauaggagccccagauucaucuggugagggugagggugccaucuguguguggcccccgagcugaauccaccacaucugcucccacaaauaacagaagagagaggcaggggaguaugcagccagggacaggggccagagaggcacccuccaggauaccuuuggggcccugcacccuuuccuguuccauccacaugcugugggcagugacaggggcagggcagaaggcccagcggagugccucugcgggucugguuugucauggagggaucaguguguuuccaugccugaaugaggaacacgcagaucacaguucccagaguacuuuauguaaagcucgucuuugcggcuucuugauuuuuauuuauagagagcuauuucaccuaaaauagcaguuaugccuugccuaugagcccaugaggaugggauuugcucuuggcaguuuggaaaugaggagaggccuagaggaggggaaaccaagucacaguccucaugggaaaggugguuuggggcuggagugggcaguggaaggggcuaggcauaaagaagguuguaucuggggcucugcugccaaugugcccgggcuuggacccuggcucgccccuagcccuugggagaucauucaaccucucugugccucgguuuccuuaugaaugaagcgagcacgccaguuaccccuccauggugucgucggggcaauuaccuggaugagagaugugcagugcucagcaggauugucacgaagcaggggccggcaugacagcuguggcuaggacuccuuauguggggccucagccaaggcuagcaccagggaaugggcugaucggggcccuucauauggcaggugaagcucugcuaggaaccuggaagcgccaggcuccagggcagcacagaggagggcaggcagaugucaaucagcaagccaagccccacagucuggaaauuugcaccagugugaguggagguggagccagggaggaaguaaaucccagaggagaaggccugggccaacauuuuagagcccagcggcaguacugagcccacuuagggaggugccauggagucguggccccuggagcuccucgugcgucugguugcuguggcagguaagggucggccuuugagguccagggucaggaaaggacaggcgccauggcgugcaauaacccuuaugggauugauaguaaaacauacagaaaauauguuucaauagcaagcaccacugccucaguccuuaagaugcuaaccaguuggcuccaaugagugugaggucagccgcgauccauuuugggaauucuuugaaggcacaaguggugacucguggaauacuuaauaaaacaaaguaaggguugccccuggagaacagaggucuguacaggcugggagagcagccaggagaggacaggaugcucaagucuuuuugcagggccagucauguccgaacaacgccaauucacuugccguagguugacaggugcagaagaugaaagaguggcgagccucagaugcuauugccuugauguuauuagcuccugauucugacagcgcagggccuggcccagggcacagcugcgcacagggugagcagcaugcccugcugcaggagggauuugccuugucaccauccccauagcagacccaggacaagguccgucacguuccugaugccaggggaugugacauguaccucccucaguggcuuccaggugcagacccaacacugacacugaccuuacagucaaauggcaaaguagaaaauccaacuguaacaccagcaaaggacacuagcuugacagcacuuuggaguaucuggaggaaauuaaaaguaugguuaugcuugaagacauuucacuaagucauaagucucugggcuccugggcacaucaagauuugugucaugcacuuucugggaagaaaacaaaauggaaaaugaggaccuuccaucaggaagcugaucguuuccuucaaugcaaguacucuuuggaaacaaaagcaaaacaaaacaaaaaccauaaaaaauacaagaacaagaaaugcugaagacagguggaaagaaugaaaauaggacugaagcaggccugugcccuaggcagagccaggcacacgccugcugagaggaccccacuaacaggugacccaggcaagaggcccccggccggcuccgugugaacagauccucccaucuugucgcguccguguccacagugaaacuccaggcaccgcagggacgcuggggagagccuucucuccacacccccuuggaaugugccccccacuuuucgcuguucuggugggcuuuugguuucuugucaggguuggggcucugccaaguagccacagugaacacagaaagcagcccuugagccuggccuucagcgagaguugcuaagggguggcuaggagaugaggaggguaggcucggccccgccgccucugcugucugguucgagaucagcugcuggccaccacaggggacaugugcauugucaucuaucuugggaaagacuuugguaaacauccaaguuucaaaggaaaaacaaaaccucacgguggcuccccugcaggauaaaggacagcacugccuucucuuuucuucagaggcuggcuugagccagguuugcauaaucccccaccuagcccugagguggggagagaguguaagaagagcagcuucaggugggguccuuagauccuuagugcaguccccacaaccgcccccuccaccccuccuucccccgcuacauugcuggagugugaggggccuauaaggccaaagggcugcccaggggaggggcccagcacccagcuuaccaccugcacgcccaucccccuuucuccaucuuccuuccccuuugccuugccucucccugcauccagccaaaguccaacucugcccuucaaccugaaagccaaauccucuaagcaaaagaacugacacauuuuggaaaguggcaggaauucaaggugcugaugcacgugaugcugggcauggcuuugugugagauugaagcauugguggugaugauccuguugugcuaauuucacuaaugacuggagaagagaaaaucuacaaggcuucaggcagguaagggauauugaaauucaaggccaucaaaauauugagaugcccucagaaaauuuagggaaaccuuugaauauuucugcauaagucauucucuuuccuguuucugucaaagucaauuucguuggaaaaauuacacaagcaaaccuaaaugacacuugaucauuuuucacuccaauuagcacauacuuauaauccaaguaaugugaaaagcuaaaugaacucacuuuccuaguuguggguuuccuuuauuggcaugaagcugaacuggcccucaugugcacacauccacaugcaugggcacacaagcaugcacgugcacacacauccaugcacaggcauggaaacacgcaugcacacacacauguggacacacacagacaugcacgggcacacacaugcuuggcacacacagguacgcacacauacaugggcauacacagguacacacacauacaugggcacacacacauccacaugcacacaugcagguacacacacuguggugaaguuugcuuacugguuuaaguagauuuguuuuaacuacaucuuccccaauauuaaauauccuugaagguuuugaguugcaggcuccaugagaggguuuuugucugguuuugucacugcucugucaacugggccugaaaucuagcaccuagaagaugcucaaaugcucaguggaguuggugagcaguggagggugguggaggaggagcagagcucuguuuugacacuguagugugaggagcuuuacccccacccucaggggaccauugggcagccgcaagcucagaggggaggcauggccgggugcuggagucaccaccagcauuggaagagcacugagccccccggcuggccaagcucaguagguagugagagaaggaagaaaagauaaaggaagggucuuggagucaucccaacguguggaggcccagaggaggagacccagcccuggaagcuggggacagagccgcggauacuggccuuuugagaucccuggcucuggcagcucggcugguugcaucccggccacaccccugcucgcuggguauggggagggaggaucugggagagaacuggguuugaacacagcagaggcuucaccagcaaaguacaggggcagggaagagggccgggggcggggcggcgcgcauggccgaggacuggaucacugagugcagauugagaagcacagcagggcaguaugugugggacuugugguguaagggaagauagugaaggauggaggauugagcgcacagugucagggaagcugcugggggcaugagcagggaggaaugcugagaagaguggccuuagaaccacacagcuagaggagcuggcggguccgagggugacugugggaguggauggcucaggaggagcagcaggagagaucaucgaaguggggcgugacgagcucgagaagcuagcacguugggugggcacugaagucacagagaguggcguaggcaguggugggugaauggacagggcgccuggugcugacaucacucauuccugggggacuggugccaccaaacaucugugaaauugagccccgagggaugaggaggaacaggaugcagggaacagacccccccgggagaggugcauguggccgggagggugggcaggacuggaggcagcagggaccggggcccugaggggccacccuacucacccugucccuuugcccugcagaaggcuggccugacuacccagaggaaccccugcugugcuggcuucagggaccucagacgugacaggcaccuccagccuuccccauguacugagagaggaccugguggccuucuuccccucugagggaggcccagaaaugcacuuggugcccuggcagggugcagggccuccucagcccucugaguuuuugcauuaauguaggacccucugucaggagugacuccuacuaccucaguccagguccaggguucucauucaaucuauaaccaugcccuggucaguuaaaaagguagaacucaguuacaagaacagucacuaaugcaucugcgguagucauggucauugacagcuguauuuauuaugcuuaacacuguaaauuuaaacuaagacaaggauacgaugcaguacaauggccauguuccucuacuagggugggauuugccacuuaaacuuugugacccacuuuuaugacauucucagggacaucagaagggaggguggauuucuugucagcuguuucagaagacaggacuacccuccaggcccucagcucacuucugaccugcccucuagucugccccuggcuugcuggaggccagccacuuggcggcuuuuagagggucaccuccccauucacugcacaugacacuuauccaaggccacccgcaccccaguuuaucccucaggcaucaccccaguuaccagucccagcccgcuucauccaguuccccgagcugacggauucucugucaugcaauggcagcgagucugggaauguagccuguggucuggggccaggagggcggcugugcugauccaccuuucccugagaugcugacucgcaacccagccuccagcagcaaugugcauagcuggaacaaacaugccagagaacauccccuuagaaaagugccuuggggauuuauuuggacagaacaaggaucaaguccuagggcuaggacuucacucucuucaugcacaaaacgagaguaauugaguucuaaaguugacgguacucacaugggaucacauuggugaggugggccaacgcccuggccaaaugcugggcaaagagaacugccugagaaauggagguaguuauuauuucuguuuuuauuuuuauuuuauuuauuuauuuauuuuugauauggagucucacucuguugcccaagcuggagugcagcgucacgaucucggcucacugcaagcuccgccuccuggguucacgccauucuccugccucagccucccgaguagcugggacuacaggugccugccaccacgccuggcuaauuuuuuguuauuuuuaguggagacaggguuucaccauguuagacaggauggucucgaucuccugaccucgugaucagcccgccucggccucccaaagugcugggauugcaagcgugagccaccaagccuggccauauuucuguuuuuaaaaacugggguugacugcauguuucaggagcagcaagagagggaacccauccuucgcuuuuccccguaaauguuaauuugacgauacacuuguccguuccgccagcuguggugcugaugggaccgcacugaaucuauggcugcguuugagaaguguugccgucuaaugauacucaguuuuccaguuaaugaacauggauaucucuccauauauuuaggucuucugugauuucuuccaaugagaugucuuguagcucucagcagacaaauguuucauuucuuuuguuaaauuuaauuccuuaagauuuuauccuuuuugauucuaaaagcauggguuucuauaguggaauaaauguggguuuuggcauugggcacaccuggguguaacucuuacugaccagguuuguaaugcagggcaagauacuguuuuguuuuuuucugaacaucuguuuucucaucuuuaaaaugggcaucauaauucauuucuacuuggcuuagugagaugaucacuugggauaacguaugugaaaauacacagcacagugugguaaauacuaguuuccuuucccagaucuacaguaaagcuuauccugacacuaaagcacuauauccccugacacaauauacccagagcugggggagaaaaaaagaucuguuggcuuucacuuuuguacuuuaaauauuuaagauuuuucuuauccuuauuuuuucuuuagugauguaauuuuuaucuauuucuaauucucaauuucuaugccuucccccucaaaauccuccugguaccuuugaguuucuagauccagccuuaguaggcuuauuagaguuuuauaucuucacaguaguacuaauaccauuugcuuaauuuacuauuucauugcuagcucauaucuaucuuaggagauagaauuuuaucagaauuuuauucuucuguucuuacauauuugaaaugagaugauugauguccaggcccugugaaucaaguaaguuuuuucugcuucucucuuuuucuuuucuuuuguuuguuuguuuauguguuuuuuguuuguuuguuuguuuguuuuugagacagggucucucugugcugcccaggcugagugcagggaugcgaucucggcucacugcaaucuucgccucccaguucgagcaauucuugugccuuggccacacgaguagcugggacuacagguguguaccaccaagcccggcuaauuuucguauuuugaguagagaugggguuucaccauguuggucaggcuggucuugaacuccuggccucaagagaucugcccaccuuggccucccaaagggcugggauuacaggugugagccacugugccuggccucgguuucucuuaauuuaguauuuucuuuuaaaucacaaaugggcuucuuagauuucagcgcaguuggggucuuggaagggauugaacuagucuucuaugugcacuguacugcccaugccauacagaggggagguaagaacagauggaaaaggagcauuucuucacgaaccuggggucucugcccaaaguuaaauggauacaagggcuucuaggcaacccuggggcccauugcuguuaaaaagaaaaaccaggagcuagugaagaaugucagcuacaggggcugaagagcagagcuuagcuuauggccccagaguguauuugaagaucaugcacuauucugguuuuauaugugaucuguggauccacuucugccugaaggagauggaaaacaauggcuaagugcugacaguaaagagcucuuucaaccuggauuguccagacccaugaucuuacacuggaaucucaacacaggcugucauauagagcagacuuggccaucagccaaaggccugggcagguuauuuaaauaaacacuagaaucucacagcccucauuccagggugguuucccacaugcugaucucacagcccagccuuuaaacaaaaacaagucagcugacuuuacugaaguuugacugacacacaaaaagcugugcguguuuaacguaugcaacuugaggaguuuggaccucaguguacaccccuggagucaucaacauacuuugugccaucacuucaucacuauucaucacuuccaaaagcuuccucccaccccauuuauuuauuauuauuaguaguaguauuugugauaagaacacuuaacauaaggucuacccucuuagcaaaauuauaaguguauauuauauaguguauauuauaaguguauauuaaaauuuuguccuuuaaauuucuacguuagccauaggcgcugagcugcacaguagcuugcuaggacuuugucauuuuguauaaccaaaauuuugugccucuugaccaacaccuccccauucccaucucccguucccugccucuggcagccaccauuccacucucugcugcugugaguuuaacuauguuagauuccucaugucauauauguagauguguccuuguguguaaccguguuccacuuagcauaauguccuucaggauuccucaugucauguauguagauguguucuuguguguagcuguguucacuuagcauaauguccuucaggcuuguccaugucacagaggucaggauuucccucuuucguaagguugaccaguguuccguggcauguacaccaccuuuuuucccuucauuugccuaucagugggcccuuaggcugcuuccaugccuuggcuguuaugaagaaugcugcagggaacacgggugugcggcauccagaugcacaaccagaagcaggauugccaggucauagggugguucgaguuuccauuuuuugagaaacuguuuuccccaguggcuacaccagucaguagacucucaguaggcacuaguuucuccuguuuuguuuguuuguuuguuuguuuugagacggagucuagcugucgcaagugcaggcuggagugcaguggcacgaucucggcucacugcaaacucugccucccagguucaagugauucuccugccucagccucccgaguagcuaggauuacaggugugcagcaucaugcccagcuaauucuuguauuuuuaguagacaugggguuucaccauguuggccaggcuggucucgaacuccuaaccucaagugauccaaccgccucagccucccaaaguggugggguuacaggcgugagccacugcgcucagccuagugaaagaugggaaucuuuccugauccaguucagccacaaguggucagaggaggaauaggacaugagguuuuauguucucauucucaggcccaguggcacaguuauuucuggcaguguggaaggauaauuaacucauauucaccaccacccuacucugcuacccaggcaaggcugcacugcauacauccauaaaugacaauuaggauguuuaccuaugaacaugagagaacuaccaacaugcgccaaccuuugauggcauaaacacuuacagcaacuaauguggacuagaagugacauguacggacugagucggucgguaccuguccagauucacuggcuuugccaagaaccuaacuguccaaacagccauucuccaugcccugcccggguagaggcugcucacuggugggagagaaagcaggaaagcaaaagcauccuugguaaggcaaggagugaacacgcucccaucauguaaaaauucuauacaacacaaugaaaaucuuuauacauaguucauaucaauauauguaaggcugauuccugauuaucagccaagggagugggguaauagaugccuuauaaaucaugccaguaauuuucacgauucuaaugcaaauagcuacacugagaagugccaucacugcucacuccguacccacucaucuccccggauuuagugagaagugaaauggcccaaaggugggcaucaggaaagggaacccaaaaaaggccacagccagccagccguguccagacuguggguuugcugccaaagacuccagacucaguuucugugcgucugugucgacaaaagcaccagaacuugcuagcaucccuaguccucucggugauggugauguuugauuuaugcauguauaucucucaaauggcauuuuaaaugaugccaaaugugauuccuauguuucuuuaaaagugaauaaauauaauucacagaaaucguugauagaaaauggcagaaaaaauagaaauaccuucuauguugccaaagaaaggauggaguccuuuucuaucgaguguuguuuucauccuuuuuccaugaguuuccacaaaacauugggcuguucaggcauuucaguaucaacuuagagaguuggcuguuucuaguuggaaaacaaaagcagauucuuuucuuucuuucuuucuuucuuucuuucuuucuuucuuucuuucuuucuuucuuucuucuuucuuucuuucuuucuuuuuucuuucucucucucucuuucuucuuuuuuuccuucugucuuaauucaagugaugugugccaugcuuguuacagaucguaaaacccaagcgcacugcugugugcagacaccacagcaucuuucuuuagacuugaccucacgucuggcuccacaacaugcuuaguuaaagcucagcuuuuaaaaugaugguccugucagccauguccauuggaauaucagugaccugccugaccaaggaggacacugcagagugugggauuuauauuuggaagcauguacuguggaagauucauuccucauaaagcaaaauaaauugcauuuaugaucuuaggcugacaagguguaugcagaacucuggggaagcccugagggaaaguuuucuaacuagugaagaaauauugaaaacagaagugggguagcuguccaacucuaccguauaaacacuaaaaaacacaagaaaugaaacuugaaaaaaagauauuuccucaaacuggcaagcauacuaaaauaauuugaagcuuuuaggaaaagaaaucuaccuaucuaucuacuuaucuaccuauguagauaacaucuaucuaccuauguagacagcauauuuacauauuccaucuauuuuuuuauauuauaaagguuauuuuguacuuuacauauguagggugugcuuugcuuugcagauuguacuucuacuuauaaucuacuaaaacucuugaagauggcgauuccucugggaccuaaaugucguaccuguagcuuccauauccucugcagcaugcacagggcaguagccccggaugacagcgaagauagcacgugugaggugcucugagcagcaggaguggauuccauggaucgaaucugugaauccaguucacggauaucguugaucacccuucaagcuuauuucaggcccuaagcugugcugugcccagccguuuauguggcugcauuucugaugggaagcuauauagaguagggacuggggacagaggucccaaggccacaccggcuggguucagauuccagccuugccacuuauuagcugugugaccaucagugacauacuuugccucucuguaccucuguucccucuucuggaaauggggguaguuauagaauguccaugucacaggggguuauuacguauuucaugguaagcuuagucccugugcuuccgauauuauucaucugucaugcacuagacucugucuuacagaguuaaagaagcacccacuuguggugucucauccaggagaguuuuaugcaucagagcaaguaaggccggugccccagguguacccacugggcacucaccucugcaggccccgagcugcuucuggcugacaccuguggccuuuuuccuggggauucuuuuccagcaaggggagacugcucugcccaugccagggcaagcuaagggccgagaacgaauggcccacgagcagcccuuggccaguggcgggcaggacguugcugggaagaugccccuguccugauagcugugagugaauguccuauacaguccccuagacguucccacagggcugagccccagccacuggcagcagcaacuggcuuaaccacacauaccccucaccuucuuucuguucccuaccuuucuugccccuacccagugcuuucuggaaccaccucccaagugcacucagauccucgucgcagggccagcuucugggaggucuugggcaucauccuggaugcaggagucauagccuuguggaagcagcaggccuguucugcgucaucugcuuucuccccaucacuaagugaauccuguccaggacaaguggcgagcagggcuuggagugucacgugggaggcagugucucuugggaagcaucucugccugugcaucagugcugcucugauucacagagcaucguccuggccucuccaggaugaaucauaccccgggcacagacaggaaugaaugucagggagacagaaucucucagaauccucacccuugaaucuucccugcagaguucugggaaagaaugacuuugaaacaaucauuuauuugacccuggcagcuauuucagugacuuuuaagcaagcuauuuuagugauuuuuaagaguuagugucauuccauggaugucccauucaaaucuuuguuaagaacaugcuaauuugcuuuucuggaucaaaugcacauccuccaagugcauugccauuuggcuucugguuaggauggugugaaggccuuggggcuguccucucuguuaaaggaaauaaaauacaaaggucacugaagaagagaagagugacaguacugauucauacagugccugcugacgugucuggaaagcagagcgcugacgugggaguuuugucuuugcauuuauguuaauucugcuuuaaacucugggaaauuaaguagauacgaacuuuggcacaauuauguucagugaucauucaagaugucauagcaugaagcccaucacacuuccaaguuucaagggcccuuuaucugggaugcgugaauggacagauucauggucagggucucagaagcuuuguggucuucagcugagcuugggaagcagacugugcccucauucuucucauuccuucuucucuguugcuccuuccugaggacugugggggaaggcaggcguccccugccagaaggcggcuuguaaugccuggaaauauagcuggggaugcguuccuucugcacgguacuuaucacgcaaggcagggcggacagguggcaauauaaccagcuaacuaaaugcacagaugauccuaacaagguggaggaaaaagaucaggaaaaaugagaucacaccaagagggaggugagcaccucaaauauauuuuggugucuagagcuggcugugugcucagcagcagugcugagagggagacacaaucagcagcaugacucacaguguccacgcgguaaaaauagaccaggggcucaggagaagcucgucuacuuuugcucugauacgggaugcagaguucucauagaagcaaugagcgucacccccaaaaucccccaaugggaaugccuccccagccccccagcgcuccagucccucugacccuuugcuagcuuuccacugcucuuaucugcagaacucauuuauugagcucaugaucucagcccccuggcacuccaaucccccugacccugugcuaacuuuccuacagcucuuaucugcagaacucacucauugagcucaugaucugccucucaucuuuaggucaagugugagcuucacaagaacacaggcuucuucuggcugcuucccugccacccccagcgccuacugcagggugcguacucgggcaugacuuguugaaugacuggauugaagacauuucaugaggauugcugcuuacaaagcagauccgugggauccagggagagcagguuuuuuuuuuuuuuuuuuuuugagacggagucucacacuuucgcccaggcuguaguacaguggcaugaucuuggcucacugcaagcuccaccucccaggcucacgccauucuccugucucagccuccugaguagcugggacuacaggcaccugccaccacgccgacuaauuuuuuguauuuuuaguagagacagggcuucaccguguuagccaggauagucuuggucuccugaccucgugauccgcccgccucggccucccaaagugcugggauuacaggugugagccaccgcgcccagccaggagagcaguuuuaugcuuugcggacuuucauugguguggcuaucugauggcuuguuucacugcaguguagauuguggcauagguagcccggggagcaaugaagucgcacauaauaaagagacccuaugcguagcaaaaaggcuuaaaggaaccccuggaaagaaaacagggaaagacaggacagagaugcagcgaaggaaacccaagcccaaacaagcccgacugagcucccuuggcccucucuggaugccacccucacccuggcucuaggucuccaucuguggcucggaggcugccugggggcugggaccugaggcuguauugucccugugguggagcauggauguucuuaguuuucaguuuucuucagaaugaauccggauccaaacuuuaaaaucuguagcucaugaagaacagcuucuacuucaaagaaggccagucacgagggaacauagagaguugggagaugucagaguugagacggagacuaaacggggguuggcauaugcuggcucucaugagcuacgcaaaagccuuuggucugugccccgggagcugggucacugaagaauuccugcagagcugucacagaaucaguuccccaucugaaagacccugugacugcugcaauagcccaguaaggauguggggaagcaacuaggaaaucguugaaguggccugggugagaggaugguagcuugguccagggugacaagggggaagaaucaguaggacuuguugaugcuuugauuuucauggaggagguggugaacagaucccagguguggggcaaggccaggugagccgcggcagggcuguucacagacguggugggugaggagccagcagagggucugugcguguccagcuugcuagcugaguggucaucggcacaggguagguagguggcaccgcgggcuacagggagaugagcuggaaaaggcugaagagaggaccuggcaaagagucauugagaagucauugggaagcaggaaaaccagccaagggugcgcagccaggggagcccuggggaaauucucucaaggagaaggaagaugcccagggugucauauuugucugaggucaggccuggugggcagaggcggucauccucuggacucacuggcguuuaggacccccucagcggggaagaggggggcucagaguggcuccuacauauccaaaccccagaucugccccccuuacucaaccuagcagcuaaauugggguggauuuuaggaauccacauggauuguucccuucugggguuuuuguaaauggcacugcaacauuuuuaauaaaauuuaaauugcagagcagacuggguccucauucuuaggcaaucuuagguggcuuccgcccauauuugcugucuucauguuuacuccacucgcccaggucagcuguuuaugcugucuggaugccucucaguguucuccuuaggagaccaaguccuggacaucagggcacaguggagcugggacuuauuuuagaagaucagaaauccgaauauagaaagugggaugcuagacuuuccccuugcagcacuugaagcaaaguugcaaaaaauccugacaauagagacaugccauuaaaagaguugaagcauuuucaguugucucauucucccuauucugccaaauucugugguuugguaguagcuagaugcagucaugaaaacaacacugcuaaggggaaaugguuucuuuguaacugguccagaacauaggugccaggauggcaggaaucagagaggagucacagcaaaugcugaaccuccagugccgaccccaagaguaugacuuagcucccaccaacucucaaguccuggccccaguuuauccuaagugccuuaauuuggcaccgccaggucugguucauaaauaaucuccgggaggaauuuccaugaaugugaacucagcugcagcugagaacauacccauugcccagguaagagucugucuguccagccauccauauccuuagcaaguuauaagacaaggggcauguggaauaagaugaggugaaaccucuaucuaacuaugccacaugccagguggcagcacacccacauacccaaaaagggaaagugugacugugaugccacgucugaguugucaggaaaccacuccagguuuaggagacagaaauucccccaagcgccaaagagagggagagcauggccacagucccccuggugccaccacagcugaggguggacagugcuuuggggauuggcacuguuauuuuuuucuuucaaaacugaagcaauaagaucucagacucugaaguuucucuugaaguccuauuaagguccaccagaaaagguccuucucuggaagcccagccuggcccugcuacugggauggaacuguggcccugugggccuaaucugggaugggccacaucuaaaauaaaagcucccauggguucccucugguuuauuucaaauccgcugaugcagugguguccggggcaguggcuccuccaggaccuggcaagccguguuauuguggucccaggcagucccacaucgguucccaaagccaggcauaccugagcccugugggccccagucacaugugaggggcagguuugagucacucacacaggcagagaagcugggcagugggcaagaaagccucggagcucauuuagucaugaggggauucuagaauaaaggaaggauuuggcaagagugcccagguaucuuagaugggcuccccagaagcccccugagauaaggauuugggugauuugggugcauguagcuugcaugggaagugaugccagaaagcacuggaaguggagugggaagugagcuuuuagggaggcuggccaacacacacuucgucaucagccguucccagcugggcaaugggccccaguccaccucugaguuacuggugguccauccuccaccucuguccauuaaggcugcgacugcuccugggcucugaccuccccccacagccugccaagccuguugcccacaggagcgugcugccugcuggccagaggaugcugccagggcuugcccagggaugagagcugagacacacagccgggcaccaggaaugccugaaccuuucugauucaucaucuauauucucacgugguuccugaaggaggaauaaauaagacucaauaccaauuugucccuggcuggugagaaccagggcuuuuccggaaggagcugugaugagcucagcacaaggccccuccuuuguuggaagcucuguuccuagcccaucccucuccagcuccaggaacccagcccuugccacacucugcugcgcgccuggagccgugaauguggccugcagaagaguccccuugccugcaccugcuuaguaggaagguggcagcuuccuccuuuggcugcugaaggucugugggugugggggagccuucccugcuagagauaagaaacugagcaguaucgggugugagcaaggcaucugagcuaggccgaggcuccuccuccauuuaaccagaagagaagcaggcagcaggggccuccugcggccaucuguuuccuccuguccaggacaugcuaauggguaccauuugcccagaauccauggucccacucaaggagcucaucuccgagaagugcuggugggacagccaggaggugcgcuguuccacaacccaggaaccugcgcagggaagcugccuuccugcagggaagcacccucaguggauacaacagugaccucucagaagagccuggggcccaagaggaccacugcaggccaaacuacgaagaaguguucuggaucuccccagguaccuaauguggucuuaaaagcauaaaccaauaaaaaaagaaaugaaaaguaaauuccugaggaaaagagaagauaaaacauagauaagaaaggugagaagguuaagagauuaacacaaaaacauuaaccaugagguaaguggaaaauuaaaauuaaggaggauaauuuuuuuuuuuuuuuuuuuuuuuuuuuugugacagagucucacucuguagcccaggcuggagugcaguggcacaaucucggcucacugcaaccuccaccucccggguucaaguaauuguccugccucagccucccaaguagcugagauuacaggcgugcaccacuacgcccagcuaauuuuuguauuuuuaguagagacggaguuucaccauguuggccaaacuccugaccucaagugaucugcccgccucagccucccaaagugcugggauuacaggcgugagccaccaugcccugcccaggaggauaauauuuaaaugucagauaauuucaaagccccagugaagaaaaacauaggugaaauaaaagagauuuuuaaacaaacguuuaaaugaacaaacaaaaaaacuagagccaaaaaauucagaggaaagccuagaaguugaagaucaaauuuuaaaguaaaaauaaaaaccaaaugagcaggcaaaaguuaaaacaaggcuaggaguuggaagagcaauaaauauaguucuucagacugauaaaaaccaugagugugcaccagcucccacuccacuacccugcaggcgcaggcuggagucacaugagaacugaagaaaaggggaauaaauagagguggaagcgggaggcugaagaugaaaucgaggauguuacuaccaggucaacaagaaauaaaaacccaauugcccagaugccaggucccacaacccaacacauucauggcgauuuaagaaaguaacauggagucaaaagaccaucaguaaaaaauguaaagaaucccacaggccuuaaacauaaaccucccugcaaugagcauugguuuacuguuugaugucccuuggucccuguaauuuuagcagaaaccccugaugcagacaccuuagugugaguuuacaaccugauggguuaugggcauguuuuauuuagccccuugagggauuuaguguacacacauguguguauguauguauauguguguguguauuucaauuauuugugauuauaaaauaauucuggagcuccaguuucucugaacuguuuuucuuuucucugucuacuggcuuauauuuuauuucuaucauuagauguuacccuuaaauuuuuaauaugcauuucuuaaugugcaaauucuggaguuaauauuguccauccuucuuccuaacaauacaaggaguuuagaauccccuugcuuucuuaugcuauuguucuguauuucaguuccuucuaacuuuuguuccaguagaauuaaccauugugagugugguuaguuuugcuguuguuuucuauagucaaugcucauuaaauaucacucguguucuuuacuuacuuuccaccuugcaucucauuuuuacuuugucugaucaguuuucuuuuuuucuggagaauaugcuuuaguagccuuaaugaauggcuguuagugguucauucaguuuuuguacaaaggccuuaaguuuucauuugugaaugauaguuuaaauagguguagaauucuaggauaaaauguucucucucacaaaugcugaaauuauuuuugauuuccuuaacgguuucuaacauaguuuggauguauguccccaguccaaaucucaugcugaaauguaauccccaauguuggagguagggccuugugggaggugauuggauuaugggggugguuucuucaugaacgguuuagcgcugaccccuuagugcugcucucaccauaaugagugaguucuccugagaucuggugguuuaaaggugugugccaccuccccgcucacucuuguuccugcuuuggccaggugaccugccugcuccucuuuuccuuccaccaugauuggaagcuuccugaguccuccccagaagcugagcaaaugccagcaccaugcuuccuguacaggcugcaaaaccaugagccaaauacaccucauuucuuuauaaauuaccuaguauuucuuuauagcaaugcuagaacagccuaaugcacuuucuguugcuguuguugagaaaccuacucuugguuugcuuuuuuuccuauaggaauuugaaauuauuuucucugggcugggcgcagugacucacgccuguaaucccagcaguuugggaggccaaggcgggcagaucaccugaggucaggaguucaagaccagccuggccaauauggggaaaccccaucuguacuuaaaaaaaaaaaaaaaguuaggcaugguggugggcgccuguaaucccaacuacuagggaggcugaggcaggagaaucucuugaacccgggaggcagagguugcagugagccgagauugcgccauugcacucuggucugggugacaagagugaaacuugaucucaaaaaaaaaaaaaaaagaaaagaaauauuuuucucuguuugagaucauauuuuugucuuuuguauuguauaguuacuacauuuagugugggauagcuuuaauuuaccuuguauuauguaugucugaaucuguaaauucacaucuuuuauuaguucugagaaauucucagauaucuucagauauugccucuuccccauucucaauguucucucagucuagaauucccaaucuauucaucuggauuuucuauuaguagauugggagaccuucucauuuuuaucuuccuaccuuuuaauaugucuuucauaauuuccauauuaugcugaauucuagguaguaucaucaguuccauauuccaguucaagucccucaucagauauuucaaguuugcuuauuaacucauccaucgugucuuaaauucaguaguuauuuuuauuucaggaaauuccaauuugccuugucucuuuuaauaauguauuuuucccuguguggauuugguuucuccuugugugcuagaauaucuuaaaagagacuuacuuuaucuaucacuugaaauucuuggaaagaugcuuucccugcugacugaggcucagggcaggccauuucuugguaaauuuuaaaauuuugaaugucaaccuuucuccaugacacuuuaacugaaaacugucauuaugcauuuccugaagugaggaugcaguaccagguaccccucggaaucacugacaugucaccacuuuuuauguuaguuccucaguguaggaguuuccuagcugcacaaauacuaaaaucccaaaccccggcuccacauggugcuguguuuucagcauagaacuuucccagcaccaggccaaugggaccaccccauguuuucccucacugaacugaugggcagggugauucuggauucugaguuuucacuggauacguuauucucugagcuucccgucuuuguuugggggucugauuuccacucccuucuugaggggacccaggcccugucuccucugcccccgccacuaaacacaugcccuguugccaggacuggcuucucuccccacacugcggcaguaucagcuugggcuuaaggcuucauaucuaacuuuccuccuuaauucuagccccugaagauuucccuugcuuuccuaugaccuuagcuguggcuuaaaaaaauugcuauguuaugcagcauacuuacaugcuuuauugcaggaaguguuugaagugagucuggcaccagguuuaaaaccaguuucugcugagaaauuugaagaucuggcaauaugacgucugucuuucagcaggacuaaaauuggcuagugucagggggcauguacucucuguucagucucuaacucaucaccuguaauauuauuuugacuccuguguaggcauuuaugauucagcauaauauauuccaccuuuuacccuuuuccacaaaauggacccuaacagcauccaguucauaucccaguucuguaccacaagccuuugcuacugauauaggagaauggcagccaugaggcaccauuggucuuuaaaauauauauauauauauauauauauauauauauauauauauauauaugcagugguuccaagauggccgaauaggaacagcuccagucaacagcucccagcgugagcgaugaagaagaugggugauuucugcauuuccaacugagguacuggguucaacucacuggggaucaucggacagugggggcaggacaguggguacagcccacugagugugagccaaagcagggcgaggcauugccucgcccgggaagcacagggggucagggaauucccuuuccuagccaaaggaagaggugauagacagcaccuggaaaaucaggucccucccacccuaauacugcacuuuuccaagggucuuagcaaacggcacaccaagagauuauaucucgugccuggcuccgagggucccacgcccacggagccucgcucauugcuagcacaguagucugagaucaaacugcaaggcagcagcgaggcugggggaggggcgccugccauugcugaggcuugaguagguaaacaaagcugggaagcucaaauuggguggagcucaaagaggccuaccugccucuguagacuccaccuccgggggcagggcauagucgaacaaaaggcagcagaaaucucugcagacuuaaaugugucugucugacagcuuugaagaaaguagugguucucccagcacggaguuugagaucugagaacagacagacugccuccucaagugggccccugacccccgaguagccuaacugggaggcaaaccauaguaggggcagacugacaacucacauggccggguaccccucugagaugaagcuuccagaggaacaaucaggaagcaacauuugcuguucugcaauauuugcuguucugcagccuccgcuggugauaaccaggcaaacagggucuggaguggaccuccagcaaacuccaacagaccugcagcuaaggguccugacuguuagaaggaaaacuaauaaacagaaaggacuuccacaccaaaaccccaucuguauaucaccaucaucaaagaacaaagguagauaaaaccacaaagauggguaaaaaacagagcagaaaaacugaacauuuuaaaaaucgagcaccucucccccuucaaaggaacgcagcuccucgccagcaauggaaaaaagcuggauggagaaugacuuugacaagcugagagaagaaggcuucagacgaucaaacuucuccaagcuaaaugaggaaggucgaacccaaugcgaagaagcuaaaaaccuugaaaaaagcuuagcugaauggcuaacuagaauaaccaguguagagaagcccuuaaaugaccugauggagcugaaaaccauggcacgagaacuaugugacaaaugcacaagcuucaguagccgauucgaucaacuggaaggaaggguaucagugauugaagaucaaaugaaugaaaugaagcgagaagagaaguuuagaggaaaaaaaguaaaaagaaacaaacaaagccuccaagaaauaugggacuaugugaaaagaccaaaucuacgucuuauugguguaccugaaagugacggggagaauggaaccaaguuggaaaacacucugcaggauauuauccaggauaacuuccccaaccuagcaaggcaggccaacauugaaauucaggaaauacagagagugccacaaagauacuccucaaaaagagcaacuccaagacauguaauugucagauucaccaaaguugaaaugaaggaaaaaauguuaagggcagccagagagaaaggucggguuacccacaaagggaaacccaucagacuaacacggaucucucggcagaaacuccacaagccagaacagagugggggccaauauucaacauucuuuaagaaaagaauuuucaacccagaauuucauauccagccaaacuaagcuucauaagugaaggagaaauaaaauccuuuacagagaagcaaaugcugagagauuuugucaccaccaggccugccuuacaagaguuccugaaggaagcacuaaauauggaaaggaacacccgguacuagccacugcaaaaacaugccaaauuguaaagaccauugaugcuaggaagaaacugcaucaacuaacgagcaaaauaaccagcuaacaucauaaagacaggaucaaauucacacauaacaauauuaaccuuaaauguaaauggacuaauugcuccaauuaaaagacauaaacuggcaaauuggauaaagggucaagccucgucagugugcuguauucaggagacccaucucaugugcagagauaaacauaggcucaaaguaaagggaugaaggaagauccaccaagcaaauggaaaacaaaaaaaggcagggguugcaauccuagucucugauaaaacagacuuuaaaccaaugaaaaucaaaagagacaaagaaggccauuacauaaugguaaagggaucaauucaacaagaagagcuaacuaucuuaaauauauaugcacccaauacaggagcacccagauucauaaagcaaguccucagagaccuacaaagagacuuagacucccaugcauuaauaaugggagacuuuaacacuccacugucaacauuagacagaucagugagacagaaaguuaacaaggauauccaggaauugaacucagcucugcaccaaguggaccuaauagacaucuacagaacucuccaccccaaaucaacagaauacacauucuucucaacaccgcaccgcacuuauuccaaaauugaccacauaguuggaaguaaaacacuccucagcaaauguaaaagaacagaaauuauaacaaacugucucucagaccacagugcaaccaaacuagaacucaggauuaagaaacucacucaaaacagcucaacuacauggaaacugaauaaccugcuccugaaugacuacuggguacauaacgaaaugaaggcagaaauaaagauguucuuugaaaccaaugagaacaaagacacaacauaccagaaucucugggacacauuuaaaacaguguguagagggaaauuuauagcacuaaaugcccacaagagaaagcaggaaagaucuaaaauugacacccuaacaucacaaauaaaagaacuagagaagcaagagcaaacacauucaaaagcuagcagaaggcaagaaauaacuaagaucagagaagaacugaaggagauagagacacaaaaaacccuucagaaaaucaaugaauccaggagcugguuuuuugaaaagaucaaaagaaagcauauucaauuaggaaaagaggaagucaaauugucccuguuugcagaugacaugaugguauauuuagaaaaccacaucaucucagcccaaaaucuccuuaagcugaugagcaacuucagcaaagucucaggauacaaaaucaaugugcaaaaaucacaagcauucuuauacaccaauaacagacaaacagagagccaaaucaugagugaacucccauucacaauugcuucaaagagaauaaaauaccuaggaauccaacuuacaagggaugugaaggaccucuucaaggagaacuacaaaccacugcucaaugaaauaaaagaggauacaaacaaauggaagaacauuccaugcucauggauaggaagaaucaauauugugaaaauggccauagugcccaagguaauuuauagauucaaugccauccccaucaagcuaacaaugacuuuuuucacagaauuggaaaaaacuacuuuaaacuucauauggaaccaaaacagagcccgcauugccaagacaauccuaagccaaaagaacaaagcuggaggcaucacgcuaccugacuucaaacuauacuacaaggcuacaguaaccaaaacagcaugguacugguaccaaaacagagauacagaccaauggaacagaacagagcccucagaaauaauaccacacaucuacaaccaucugaucuuugacaaaccugacaaaaacaagaaauggggaaaggauucccuauuuaauaacuggugcugggaaaacuggcuagccauauguagacagcugaaacuggaucccuuccuuacaccuuauacaaaaauuaauucaagagggauuaaaaugcuagaccgaaaaccauaaaaagccuagaagaaaaccuaggcaauaccauucaggacauaggcauggguaaggacuucaugucuaaaacaccaaaagcaauggcaacaaaagccaaaauugacaaauggaaucuaauuaaauuaaagugcuucugcacagcaaaagaaacuaccaucagagugaacaggcaaccuacagaaugggagaaaauuuuugcaaucuacucaucugacaaagggcuaauauccagaacucaaacaaauuuacgagaaaaaaacaacccuaucaacaagugggugaaggauaugaacagacacuugucaaaagaagacauuuaugcagccaacagacacaugaaaaacugcucaucaucacuggccaucagagaaauacaaaucaaaaccacaaugagauaccauaucacacuaguuagaauggugaucauuaaaaagucaggaaacaacaggugcuggagaggauguggagaaauaggaacacuuuuacacuguugguuggacuguaaacuaguucaaccauuguagaagacaguauggcgauuccucaaggaucuagaacuagaaauaccauuugacccagccaucucauuacuggguauguacccaaaggauuauaaacacaugcacauguauguuuauugcagcacuagucacaauagcaaagauuuggaaccaucccaaauguccaucaaugauagacuggauuaagaaaauguggcccauauacacuagggaaugauaugcagccauagaaaaggauuaguucauguccuuuguagggacauggaugaagcuggaaaccaucauucucagcaaacuaucgcaagaacaaaaaaccaaacaccgcauguucucaaucauaggugggaauugaacaaugagaacacuuggacacaggaaggggaacaucacacacuggggccugguuuugggugggggaagcagggagggaaagcauuaggagauacaccuaauguaaaugacgaguuaauggguucagcacaccaacauggcacauguguacauauguaacaaaccugcacauugugcacauguacccuagaacuuaaaguauaauaaaaaaaaaaauaaauaaauaaauauauauauaugccgggugugguggcucacgccuguaaucccagcacuuugggaggccgaggcgggcagaucacaaggucaggagaucgagaccauccuggcuaacacggugaaaccccaucucuacuaaaaauacaacaaaaaaauuagcugggcauguuugcaggcuccuguagucccagcuacucugaaggcugaggcaggagaauggugugaaccugggaggcggagcuugcagugagccgagaucgcgccacugcacuccagccugggugacagagugagacucugugucaaaaaaaaaaaguauauauauauauauacacauauauauauacacacauauauauguguauauguauauauauauacacauauauauguguauauauauguguauguauauauauuauauauguguauguguguguguguguauauauauauauacauacacacauuuuuuuugaaaaaauauuuuuuauauauauauauauuuugagagggagucuggcucugucacccaggcuggagugcaguggcacgaucucggcucacugcaagcuccaccuccuagguucacaccuuucuccugccucagucucccaaguagcugggacaacaggcgcccgccaacacacccggcuaauuuuuuguauuuuuaguagagauggggcuucuccguguuagccaguaugggucuugaucucuugaucucgugauccaccugccucagcuucccaaagugcuguuuuuuaggacuuugaggcucacuuucauugaagcccacuagccaaagaccaauagaaacacacuuauagucaaaugaaauugguugaauuuagcugcugcagcaagaaaauggacuacauggaauauugggaacaucuucaguaggaggagaagguucuucaaggaugggggccugugcuaaauaauauucucgggagcaagcaggggaguggccggcucuggacugguacuagggagaagcaucgacaccuagcaauggggacucuuugcagucucuacaggcaguggaggagcugucagggcugggacugccacugugagaaagggcauggcucagaagcagggaucgagggcagcuuuguagcugcaggaggguucugcuguggaaacacgguauaugggcauuauccuugucccguuggcaacacugucaccagcagggcuaaauugcacuuuuugucuggggguucagcuaaucuuucagaaaaguauuuuuguacaagagaaauuccuuguuucaaaacaaagcucacuucuugugacgcucugggcagaaggugcugggagcagcuuccuggguggcccugcucgugucccagccucuggcuuccugcuaguauugauucacaagggcccuaaggccaucacagaggacguaucuccauauucaccacuugagcauaccucccagcuccauguuucacucgugaaaccauggucuucaaaacauaaaauaauuuaccaagagaaaccaguuucugucuguuggcauccuggugacaacaacgaggaccaucaccaccugucuucuggcaaccacagacacaccccgaggaagcagggugcuccagcagggucucuggagugaguacccucuuccaauuuggguuucuugaccuugcuagggcggcgcagcccauuacuagcuggcagagaauaacucaagagcaaauggccccaggaauaaacuugagauauuaacauggaaaugcuggauugaaaugugacucauuuucucaucagucagcacgcugauuaacuaauuucagcuacugauauuuuuuauguuucccagacugagcuguugcucuguuucucauccacagguccaggaggcagugugagaguuuaugauguuaauuaauuacaagauggaccacgauacuguccgugaaauuguguagucauuucugaaccuuuuguaauaaagaaacugugcuuccauauugaagaagcacuuaguuauaggaaaaaugugagaaauagucacuuuuuguuuuuaugcuuuugguuuauuucagcaaaucugagguuuaguaaaaaccaauggcacaggaaaaagcaagucacuccaccauuuuguuuuuguggguacuuaagaucucauguugcacccuaaggauuuuuaaauagaucauuuaugaugugaaugaugagcuggccauguugucacuucuggguucacuucugugaacuugggaagguuagaagcauaguauucuucaaguuucuuuuuuacccucuuccacaaaauggauccuggcaacagccaauccacaucccaguucucuaccacgugccuuuauuauugauacagagaauggcagccauguggcuccuuugaucuuuugguaaaguuguauuacucaugcaacccucagugcauaguggauuuuucucuuucucuuucucccuccuucuccuucucccucucucucucucccuuagacagacagacagacacacgcacgcacgcgcacaugcacacacacacacacacaccccaccaccaccgccaucacgaaaaacacagaaugucaucacuguagauuaaacucauuuaguaacuaacccaugcuaaggaauuuucugaguaguguugcagucuguggcucuuucucucuuaguuuauuuucuauuuaauagugcauuucuccaauucuaggauguacauuccuuucuuuucauuuguuccuauuucugaaauucugaaacagugaugcaccucgcagucaguggcuucugacccuugauggaguccgacggggcuuuucccugagcaugcuuuuauguauauagguaaaucuaaaugaauacugacugaauaaagaaaaaacacuaacaaaauauuguggugcuuauauauguuuaauauauaauuuuauauguuuuuauaucuuacauaauaguauauguauauuauauauaauuuaaaauaaagccaacaauaguacuacaguacuaaauuuguagauuguaaucagaauuaauauguuugagguucuuauauuuuccagaaaguguagaacuaacuuacaucaaauuccaguaaguucaggccaggugcgguggcucacgccuauaaucccaggacuuugggaggcugaggcaggcggaucacaaccucaagaguuugggucagccugggaaacauggagaaacccugucucuacuaaaaauacaaaaauuagcuugguguuguggugugcgccuguaaucccagcugcucaggaggcugaggcaggagaaucacuugaaccagggagccagagguugcagugagcugagaucaugccaguguacuccagccugcguaacaagagagaaacucugucucaaaaaaaaaaaaaaauuacaguaaguucaaagguacuauacuuguguauacuugcaccuaacaauguuggcuuguacaccaacauuguuacuucuuauuuuuuugagaaaaguccuuuuuuauuguaguaaauacauauaaaauauaccauuuuauuccuuuuuaaauguacaauucaauggcauuaaauccaugcacauugcugugcagccaucaccaccguccaucugcagaacuuaccaccauccuaaaccaagaccuuguccccauuaagcaguaacucuccguucccucccuucugcagccucugcagcuguguucugucugugagugugacuauucuagguaccucauauaaguggaaucauacaguauuugaccuuuugugacuggcguauuucacuuagcauguugucuucaagggucauccaugcuguaacacugaggaaaauuugcuucauuuugaaggcugacuaauaauucaggguagcauaugccauauuuugcguauucauuccucugucaaugggcguuuucauuguucccaccuucugacuacuucugcaucaugaugcuaugcacuucaguguccccaaaucuguguuggagucacugcuuucaauuuuuuuuaagagacagggccuuacucuguugcccaggcuggaguacagugacacaaucacaccugcuuuccauuuuggggaguguauacucagcagugaaauggcugcuguaugguaacucaguguugaaucuuugaggacccaccgucuugucuuccaccguggccacuccauuugacauuuucacuggcaacgcacaggguuccaguuucucuacaauaauaugaauuuuaaaggcuauuuucauaugguuauucugcuaguauaauaaaggcauauuuaaaauuuaaguaguaccucgccacacacaguggcucacacguguaauccuagcacuuugggagaccgaggaggguggauccccugaggucaggaguucgagaccagccuggccaacaggacaaaaccccgucucuacuaaaaauacaaaaaaauuagcugggugugguggugcaugguuguaaucccagcuacucgggaggcugacgcaggagaaucgcuugaacccaggaggcagagguuguagugagccaagauugcgccacugcacuccagcaugggugaaaaagaaagacucccucucaaaaaaaaaaaaaaaauuaaguaauaccccgaaauaguaaugaaaguuacaaaccuuuccccuuggccccuaacauaucacuucauuugcccagacacuucucagaggcagcuccugcccaccuuccucuuuugacuguuauugccauacccugacagcuguguucauccuguucuaucuuuuuuucuuuuuagagauggagucuugcucuguuuucuaggcuagagugcaguggcaugaucauagcucacugcagccucaaaccccugggcucaagugauccuccagcaucagccucagcuuccugccuuagucucccaccuguagcuaggacuauaggugcauaugccuggccagcuuuaaaaauuuuuuguagagauggggucucauuguguugcacaggcuggucuccaacuccuagcuccaagcgauccucccaccuuugccucccagugugcugggauuauaggcaugagcccauguaccuggccgcaucaaguuauuucuugauccguuagcuuuaaauucuaccaguggacucccugcuuugaaaggguagagauuaguucacuuaagguuagaauuuaguucacuuacacuacugccuaucuccuccccacuucucccaacuucuuagggauguauuauuuugaguccuucccuugguuacuguuguauucauuucacucugugggaugaggcugugguuggcaugcuuacccacacuguuucucucuuccccauuggccuucuguauuaguccguuuuguguugcuguaagggaauaccagagacuggggcauuuguaaagaaaagaggcuuauuuggcucgugguucuguaggcuguacaagcauggugccagcaucuacuuggcuucuggggaagcuucaggaagcuuuuaaucauggcagaaggggaaguggcagccaacaugucaccuggugagagggagcaagagagagaugucagggucuuuuaaacaagcagcucgcauguaaacuaacacagcaagaacuuacuccuugccacaaggauggcaccaagcccuucaugaggaauucacccccaugacccacacaccuccuguuaggccugccuucaacacuggugaucacauuucaauaugagauuuggaggggacacacaagcaaacugugucacuuuccuauugagguuggcugugucuucaauuguacaugagaaugagugaguccagcuuacuggcuaugagucagacccugaagucaggcuuccuggcugugaaauccagcucugcagcuuauaggcgaaagaccuuaaacagguugcuucaguuuuugaugccucaguuuccacaucugcaaaagggaugauaauaacuauaccuacuuaaugggguuguuauaaaaauuaaacaggauaguccuuauuaaaaguuuagcacgaugcuugggauuuaggagaagcugaacucuuggucaaacugaugaugaugaccacaacaacaaugaugucaacuuggucagggugaggcaccuuuaaauuuugguuuucaguuacguuggguuuauauguagauucuaaauguuaaauuacuaaacauuuauugucaagauucuguaaauguuauggcuauaaacccaaguuuugguaauaaguuaauauugccucuguauucagcuccugaaucauaaccccugugccagauaaaggaaaauauaguguccaggucaaacggauucugucuuuuuaaauuccacagcuguguaaaaugacgggaaauuuuguuuugcuuuauauuuggaccgauggaguuccuauacaccuauucuggcuguguguguuuuucuggaguuucuaaaugacauucuuuucacauugaggaaagaaaccugugccuuccucacagcauccaucuuaacuuccagcugugcaugcgcgcugccguucuugcucacaaagauggucuuugugaagcccacggguguuuguuauaaaugggacagauugcugcuggccagcugccaugcagagauugcuuuuuauucauuuaagcuauucacugcuuuccccuuauccucuauuauccacauccaugguuuucacugccauuuguuucuggaguaaaucucuaaguuacuuauucagacaggcugcugugagcuacaucuucugacucuugaaaauauuuauugucauccuuguuuuguuuccuuuuuuguuuuuacucauccuuggaggagugcuugguagaguacauacuuuaaagguuuuucucgcaacuucgaaggcgcugacccauugccuguccaugugcaugguuuugaugaaagguccucugccagcccauguuccuguguccucuuggccaucugcgggcuccaaacauaaauuccuggcugcagcuucuguccacacuccuucuucucgccuuugguuagauuccucaucuacuguuacgcuuuaaaauuauuuaucuuguuggccggccaggguggcucacgccaguaaucccagcacuuugggaggccgaggcggguggaucacgaggucaggagauugagaccauccuggcuaacaaggcgaaaccccgucucuacuaaaaauacaaaacauuagcugggcgugguggcgggcgccuguagucccagcuaccccgggaggcugaggcaggagaacggcgugaacccgggaggcggagcuuacagugagcugagaucgcgccacugcacuccagccugggcgacagagcgagacucugucucaaaaaaaaaaaaaaaauuuaucuuguuaaggaugauuuuuuccauuuucucuuccauuaagauucuuuuugcucuuucacuaacauuuuaacggggucuuggagagaggggaagagugaugugaguccacuucuucaucuagccuagaagcaggcucccuggcucucucuuuacacagccucaucagagaguugucuuugcagggaagagacuuggccuuguggauccucugugugguaucuuugcuuucuguuucacuagcuucugcucuuaccuuauuaacaccugucauguauuauuugccuuuauuauuauuauuuuggugaauuuauuaauuuagauggggcucauuaauuuuuaaccuuuuaaaaauaauauaugcauuuaaggcuacauauuucccucuucuccugcaucucuagguuucaauaauuuaguuucucaaugauccugaccuaaguauuuuuauauuuuguuaugauuccuuuuugaucaaaugguuauuaagaaagcauuucuuuuccuucguuucuaaaugaacgugguuuuuauuaauuguaucaacuuuuauaugauuugcauuguggcuaaagaaaaugaucuguaagauacuaauguuuuauacauacuucuucuucuucuuuuuuuuuuuuuuuuuuuuuuugagacagagucuuacucuguggcccaagcuggaguacaguggcacgaucuuggcucacugcaaccuccaccuccuggguucaagcaauucuccaccucccgaguagcuggaauuacaggcacacaccaccaugccuggcugauuuuuuauuuuuaguagagacgggguuucacgaugugggccaggcuggucucgaacuccugaccucaggugauccaccugccucggccucccaaagugcugggauuacaggcgugagccaccaugcccagcauacuucauggccuaauacuugaucaauuuuugaaaggaagaaagagagagaagaauggagagagagugagagagacagagaaugagagagaaagagaacacguaugccuagaagaauuuguauucucuguuggaugccaaguuuuauaugugcauuuuugaucaaaauuauuauucaaauauucuauguuuuucuuaauuuuggccuguuuauuucucagcauaauugagagcauacuuugcagucuccuguugugauggugaaaauauuacauuauccccauaauucuauaaauuuugcuuuauauaaugugauauaaauggauuauguacauggaauuugagaauuguuguauacgguuaauuggaucucucucuguguaacuauguuacuauauaauaauacuuucuacuccuuaauaucuguuuuguauucauuacacugugccagauuucuuauuuguugccuaggauuuuccuuguauauauguuuuccauccuuuuacuuuuagcgauuccauguccguaugcuuuaggucuaucucuuauaaauaacauaugucuggauauuauuuuaaauccaaacuaacaauuuauuuuaauugacaauuuaaauuaauuuguaccuauugugaauacugauauguuuggaucugcuauuauccuaguuuucuauuuagaauuuggccaacuuuuuuuuuauguuucauuuuuuucuuaccucuuuuuauuugauugagguuuuacuacuauuuucauucuuacucauguacuucucuccccugguuuagaaugauuagaaauguuuccauucauuugguaguuauccuugacauuugccuauguauauuuaaguauaaagcugaacauguucacacacuucuggaacauuaaaagaaucuuagcucaccuccugauuuacaugcuauuguuuuccuguguuuagaguuuuaagaauaaaucuaaugauuuacauuuauauauauagagagagagauauagauauagauauauagauagauauauaaucaauguuuguuuggauuuauaaguaugucgugaguuugugugcucauaaguccuuguaucucaggucaucacccagcauuauuuuucuucuuccuaaagugcauccuuuagaauuccuuuuaguuuaagucucuaaguagauuuuuuauuuauuugcaaauggauuuuucacuuggcucuugaaagauaauuucauuauguccaguucaagguugagaguuaauaucucucaauauauugaagauauuauccucuguccuuuugcuuccauuauugcuugauaugugucuugccauucuaguuuuuguugcuauguagauuauccacuauuuuccuuugacugcuuuuaagaccuuuccacuuaaucuucagcaguuucauguaaugugucaaugugguauuuccuggaucagugaauuuguguuucucaucagugcugaacauuucacagguagcguccuuugaggugcggcuucucucccaggaguucugucuccauuucugagacucccauuagaagagacugaucuuucucauucuaccugccaggcucuuugcugcuuauugcugucuccuaucuuuuuuucuauucgugaggcauuugggguauuuuucucagaucugucuucuggauuacauuuuuuuucuuagcugugucuauucugcuguuuagauuccauaucuuccguuguguuuuuuacuccaacaaaaauauuuuuugcuuuuugaaauucacacguuucauuuuucuauuuauucugguagucacuugucacuugcuccuucuuguguuuuauuuauguaaguauuucaugaacaauuguucuauacuuucuucucacuauaaaaauauguaaaguccuugaugguccagaguuguucuuuucuucucuucucuuuucuuuuuuuuuccuuucuuuucuuuucuuuccuuccuucuuucucuauagacucucacuuaugguggcauacagucuuuugugcaugaugaucuuucucagcucauuauuugaccuuacucuguggcuaaauuggggagggggucuuucucuuagagauguuuguuucuauucugccuguaaugaggagucgucacugaauuggcucuauugcaaucgacagaacagugguucucagaguguggucccuggaucagcugcagcagcgucaccuaugagcuucuuagaaauggaaacuuggguaucccuuuccacccugaguaaggaacucuguagccuggcaaccuggggcuuaacaugcccuucaggugauucaaaugcaugcuuaaaucugagaccacauccguaaagaaucuuagcuuagaauaagguucagccucaacuucucuaucuugucuuucuacaaggcuauauaacuuacuauuacuguuacuguugaugccuaaaucagugcagcucugccccuucaaguaaucuuccauggaagaguggugauauuuggagauuuuccuucgcaaucaguaaugucucaaaguguguucuaauccugaaucuaauuuuguaacaagagaaucucucagagcaucuagucaauucuaaugcuagaaauaacaguuuguccauugacuuuuaauuucacugauguauuuuuauuucuaaaaguccuaaaucuuucauuuguaaaguauccuaaguaugguuguuuuauaaucuucaucugaaaguguuaauaccuacauucacugugggccagauuugugauauuucugcucacccuugcuuauuucuuccuguguuuagugcuugucuuaguuugcuucugcuguuacaacaaaauaccacacaguguaauuuaucaauaauagaaauuuauuucacacaguucugaaggccgggaaguccaacauugaagugcuggcagauucagugucugauaaggacucacucucuucuucuaagauagcaccuuauuacguguccucuggaggggaugaacacugugugcucacauggcagaagcucaagaaggggcuaacucucccccucaagcccuuuuguacaggcacuaauccuaugggcgagggcuuaaucaccuccaagggcuccaccucuuaaugccaucaccucaggaauuuaguucccacauauuaauugcaaaggaauauaugcauccaaaccauuagcagugcucauuucccucccuugaaucccaaacucagguuguuuucugagacuauccaugggcauuuucuaguccugucuuuaacauacauuauccuagaggacauuugcauuugcuucugccaagaaucacagugguggauucccagccccaaacacuacaaacuaaguguucaacuguguuuuucaaggcacauuaagagugugaaaucucagagagagugugagugcaggcuugugguuagaaauucucagagaugaagccccucuggcccuccuccaaaggaaaaaaaaacaguuuuacccaaaauaauuuuagaggugagaaugcguucaaggcuuucucuuucuguccuucaguggguggggaggaagacgucuuggcugagucuguguccacauucacaaucuuaucaguuaaaucuuuggucacaugggagccucugcaucucuaaaccauggacugugugugugggaggacaucacuguugaugguaaugaugacaaugguacuggugacauuacuuguaccaacagugauguuauuguuaguaguaguagugguggugauguaauggugguuguggauuucugguagugaugguggugguggugguggugguauggaagggaugauggcuaggaaucaguaaaauuuuucuguaaagagucagauaauauuuuaggcuucauggacaauauggucucugucacaacugcucaacucuucccuugucaugaagaagaagccauagacauaugugcaugaaugguuguggguguaguccaauaaaacuuuauuuauggacacugacauuugaauuucacauaauuuuugugugucauagaauauuccuauuuucuucaacuacuuaaaaaugugaaaaccauucuuagcuugugggcuguacaaacgcagguguuagauguauuuguucuguggccuugauuuuccaaauccuggcaguagugucagcaguggggaugauggugguaauggugaugguacuccuauugacaguuucagugguggggacggugauagugguacuccugcugauggugucagugguggggauggugacggugguacuccuucugacagugucagugguggggaugaugguggugaugguggugagggugaugguaguacuccuggugaugguaucaaugguggggauaaugauggugauggugucaguguugggaauaaugauggugauggugguggugauggugucagugguggggauaaugauggugauggucguggugauggugguaauggugagggugguggaguugguaaugguggacauggcagugucacaggggaagaagcuuccucccuccacauuauccuuaaaaaugaaguggagacuuacaaagcuaaagggaguuggcacaacuuuuaaaagcagcaauggucugaaucugcagguuuucuuguuuccaaaaucacaucauaucugcuauauaugucugacugcuuauaaaucagauuuggaguuccuguggauugugacccaguggugcugugcuaugacaaagcaucacucaccagcagaaguuuggguuggcuuugugaacaggaagucccaggccaccaaaaaugauacauaggaugauguagcauuuugcaauuguaaugugccauuuaaaugcuaaauaguaauaacugaucuggucccaaauguuucauuaacucucuccacugccaaaucacaggcuuuucugugugugcuaaaggcaaauuuuaauuguuuuaaugaggguuugcaagcagcucuuuucucuauacacuugggccuuggugaauuacacguaucauucgcuuagcaguagggaaguuuuacuauuuacacaaaaggcuucuaacaguguuaggguuugggaaagacccagcaccuggugcccuccuaaugccuugacaaauugagcuguauaagaagggucaggagcagccauaccugucaaacaugccaaacacucuggcuaaaugaaacugcaauuaguuuugugggggguuuuguuuguuuguuuuuuggguuuuuuguuuuuuuuuuuuucggagacggagucuuguucugucgcccaggcuggagagcaguggugcaaucucugcucacugcaacuucugccuccugaguucaagcgauucuccugccucaggcuccugaguagcugggacuacaggcgcaugccaccaagcccagcuaauuuuuuuguauuuuaguagagacaggguuucaccauguugaccaggcuggucuugaacuccugagcucaggcagucugccugccucagccucccaaagugcuaggauuacaggugugagccaccgugccuggccugcaauuaguuuuauuuucuccuucaguugcauagguagcugacuucauucuguuucuacuuggagaggcugcuacagagauggucuuauauguuaaauaugacugauacugcacaauauaaucggcauucgaguuuucuaauuagccacacagggauggacauggaauacuauguugugaaguuccuuccacucuauacaguaacaaaucauaaaccaacagugcagaucuuuaagucauucugugaaaggaguagguauguuuaagaaagggagaugagugggugguagggugggcgagacauagacuuuuaaaaaaaaucuagacuuauucguagguucagaaaaaaaggaaaacuaguaagagaaaguucugauucuccaguuuuucuguauuucuuuauucaugcauuuguuugaaaauaauugcacuugcaauccugguucccaaaacauucacuggauuuuuucuagccaauuccucagagcaaaaccaucuauuaaacauuagagacaauuuugaaaaaaaaaaugcuaccuguaaugaguaaucaaaauuucuucauggauaggaccauguauaacucugucacuuuuacaaugcauaauucccccuggagcaggcuggccuucuucacagaaggugugugcuaugugugcuacgugcagguggagcaugaaauugcucagaucccauuucugguggggaagauggcuucugcgugugcugguuuauucugcugggacacucggcaugcaaaagcaucugcuguauuuaggggacugaguuuuucuaucucacagugaguaagcaggcccagccugcagcauuuucuuccauugguggguaacagaggcugccuccagcaggauuugucugguccaucuaaugccucugcuuccugaacaucuacuauguugucacuuuguguuccaggccauacacaaaaugccauucccucaccccagagguacucuaccacugagggcuuuguuuuuaagguaguuuuauucucacuauauaccugccagaaaaagaacacacugucuuaucaaccauucagccaaagagcuguaaucauaauuagccccguauuacacaagagcuaaaggauagcaaccaccauuuccccccacaaugaaagcacagugaagguaaacacagugcagugcuuccguaccauggaauaugagcccgccaugagaagaaaugaccucaaacacaucaugccaagugaaagaaggcagucaugagaggccacauaguguaugauuccaguuauaugaaauguccagaauaggcaaauccauagagacagaaaguagaucaguguuugccaggggcuggggaaaggaaccacaucaugggcauggggugacaggaauguucuggaaucagauagugaugaggguugcacugcacaacuuggugaauauacuaaaucucacucaauuauacauccuuaaauuuggaugaauuucauggcaugcaaaugauauuucaguaaagcaauuauuuuaaaaaaugaaugaaaauacuaauuaaaguuaaagaaagcaacagaguugggaucuuccugcacucccagccuuucagccgugagcauccaugcauggccccacagccugagcuguuucgccagcuuuccaacagagaccuggggucuucugcuccaugaggacuguaagacuuggagucagaaacuccugggcucaaucuccaccuauuucucuucguaucuuuucuaucugcauuuagaucaacaacuguuaggauuuaggaccuuguggaauccaaaagacaucaccagggcacauccuggagguugcuggagcagucauuuucuuggaaagggguuggggggucugagucuuccuucuccugggucucagaagccaggaaagcuaacuguuccccagcacgugggagagaauccgucuuuuaggggcaggauuagauuacuccgccuucugagacugcucuggaggaccagaaugccauugagcacugaggagucauucuccuaggaacugaggacaccgagacaugcucucccugcaaucaggcagcuuauacgcuugcagaaagaauuaacuguccuggccuuuuucuaauuuuuguuguaagacguguuuguccacguaggcacauuaccuuccuccuugcaggcugggaggccuuccagcucuuucuggugguuucugcuuggaccugugaaggcagauauuuacccccuucuccaguucugaccacagaaacaaacugcagucgucuaauaauauuuacagagcuguggguuuacagacauacaaguuggccugcuuaguuuucuuguccauacagaaguugugauaacaccucgcaggcuuguugacaauagucugaugccuuggguuuguccccaagaaacaagccuggggaugagaauuugggagaggaggggaucccgggaagcaccaccgaggaccaaggagggaaggccauagacaaaugcuguguuguacagcaaguugaucucuggggggcgcuggggaagugucaaacaccagccuccgagcugucccaccccaggacaaaggugcugggugcugauccaucagcuucucacugucacuggcugaggcugcaccaggugccauagccccuuuggccuggccugaccuguaugugagccgugauagcaccaucaaucccugggaugaugggagccagggcacggaguagggcacccacggauucagccccuguguuaguccauuuugcauggcuauaaagguauucaccuaagccuggaugguuuauuuuuaaaggaaguuuguuugggcuuacgguucugcaggcuguacaggcacggcacuggcaucugcucagcuucuggugaggccucaggagguuuuuauucauggaagaaggugaagggaagcaggcacaucacaugacaaagggggagcaagagaaagaggagggggucccagucucuuuucaacaaccagcucuuacgagagcuuauuacccuagggagggcaccucguucccggccccaccuccaacacuagggaucacauuucaaccugagauuuggaacccacaaacaucuaaacuguaacagccccugguugaugugacuuugucaucaucccuuucccuaauccgagggccuaagcuagaagcagggggcccccuccucacagccuccaccccuccccuccaucuggggcacucagggaagccccaggagccuguagaucccaccuggacuccugagguugucagcacaagcuccggggcuccugccuggccaggccugugcccucccucucuucuuuucugaaccucugcacaggucccucugcuggccuuugccucagggcccagugugcugggcagggauuucccccagccggaacagugccccucggucuggcccuggcuaacuccucaccccguucagggcuugccgucagcgggucuucacaggagauugugcccuguguuucuuccuucaaggcagcuuugucucgcccacugguuacacguuggcgcucauucaaaaaauugucuuucuccugugcugcgugcagggucccugcugguggucaccuagguccccagcuacacccccgcacucaacacacuacacacugccugcacacgguagguacccauuaagugccugucagguggaugcauggaaguaccugccacaugcucguggugugguaggggcuggacacggugcggcuuccuuuauucccuggguuugagggagggaguucuguuuugaaacuuuuauuggugacauugcauuaggacuugcggccaccucugcucugaagagcuggcuuuugcccagcuggaguauuauuuugucaccaaccacuggaugguuuucacuugcauugagagaugauugucacuugguguggggugugguguuugcugguuuagguuuaggaagcuuccaacaugcagagccauaagaaaacagugacucuuuaccuguuaugaucuugguuucaguaggccauuaccuugaguuaagacagggaugagaugggaaccauugccaguucugaagcagcaccauaguuguuugccgauguuuucugcuggcuuguguguagacaccuccuggugagagcauaggaguagcucuucaugucaaagggaagaugugggaaauugcuugaugaagauccaaaccucaucacuaaauguacagcagugugcuuucuuccuaaguacuacugaauuucuggcuagaauaguuccuucccaaauggaagguuuauuuacaaaucaagaaaagcuacuagcguucaauaacuuaauccaagauagacgggcuuuuaaauuacacaugucucuaggugucaaccuuaaucauaaacagagagaagcucucuaaaagaaaagauguuuaucugggcauaaagcuuugcaaugggaacacacaugccauaguaaacugugugcacauucagggagguaaaagaagacaaagguuuuucaugaaaaaaaaagggugaagauugcacaauuguuuugaaauaauuauccuuggcuauaaagauuaauaacaagggugacaccacucugagucuggacgggcaguugcugggcagaugaucucgcagaaguguuuuuuguguaaaaugcuguggguuuuguagucuuguuauuaagcauacaagcaugagaccccucucuucauggccuccccuggcucuauuugucaggguuuucuuaacguuacugacuccauuuugauucugacaacuuucacugggguacugacuuaaacaaguaauuuuuccucauugauggagaguucaucuguuuucaucagugaaguucuugacacacauguuugaggauucauuugcggcugcuauuggcaaaacaucacucaguuauucaucaagugcuaauggaacagaugaauuguacaggaugcaucaucagaacugcaaggaugguugagaucauggcugugaugggagagccugcagugcagccgcgaugacuuguccccagcagaaccagaggggcguggccaugcugucauccaggccugagcugggcagccugggagcccagaugaccaacucugcuccagaaagaggugauaucugaguguggccacgggugaaauuaccggggagccacauucccgugggugucagcgcacucaaaggccaauucagaauggacauuugucuccagaggcagggaggaguugggcauccugagucuugcuguguuccucaaacacucuccaagcaagaaaggccccacugaauaugucauugccaccccauucaggagacccggcugccuggaucagcuccuucaaggcacuaagaagcgcugucugucugucugggagcucucccugggcauauuggagauagccucaggccccauagccaccucuguguuagaaaccgggugugcccuuccuaaauauccuccggguuacgccugcuuacucaggugagccaagcugaacagccuuccacacacagccuggagaagugucuguaccugagagggacaagugagagccccagcgcacuuucauucaucacuccuacugccagcauggucucaggccccccaugucucgcagggaggacccugugaucugagcugcugaauguggaauccuccagcugugggaugaggcuacacauuuugccucuucaugacccauuuuucaaauaaaauacauaaagcagggaaccaucacuggggcucuguuggguccuggaccccaaaguuuccuggagggcaucacacccuucuuacugcccaaaagcacuuugagcaguagaggaccaccgcaucugucaguuguccacaccaccagggcuuauugugcuucuccuuguacccauuccucaugcuguucacacauccaucugccugaacugccucuaugaugaucacaucccacuuaagccuuucuuccacaugccuauugcuuacuaugagccucuaaaugagacccgccccuccuaacuuuaucucuccagccuccuccucugcuuccuaaacacuaccuaugcuguucccucugccuggaacaucuccccugcacagcuuaaccuguugauuuuuucaaaccucucuauuacagaaaauuucaaacacacaugaaaggagagaggauucuauaaugaaucacaugcacccaucaaccaacuuugguggucagcccacagccagucuucuuuucucaguaugguauacacuccuccuucaguggucaguccacagccagucuuguuuucucaguaugguauacagcacaccuucauucaucacuccugcugccagucuuguuuucucuguaugguauacacuccucccucaguggucaguccacagccagucuuguuuucccuguaugguauacagcacaccuucauucauaacuccugcugccagucuuguuuucucgguaugguauacacuccuccuucagugaucagagauggucagagaugaccacagguaauggcugucagauggggcuccagauggcacugcugguggguucaucggggaucccugcugucccacaucccaugagacagagaggucauuggcaagaugaaagagggaugccugauccuagagccucaugaggcuggaaguguacuugaggggguacacuuugggagguguuucugccgucaccugugguuccuugacuuucugcugucaucugugguuccuugacauccuaggaugugaaggaggaggaggaauuccagaugagaauuccaauugagaugaucaguggucagcgcacagucuucuuuucucgguauggugugcacuucuccuuccuauccagaugauuuuaaacaagucccagacaguguaucuuuuauuucaucuguaaauacuuuagcaugaaucuccacauagauagcucuucuuuuuauguuuuauuuuaguucaguuuaauugaguuugucuaauuuuuuauuauguuagcauaaaaucuacaaucuuaacaauuuuuaaguguacaguucggugguauuaaguacacuuauaauguguaaccaucaccaccaucuaucuaccaucuaucucuauaucccuuuucauuccauaccuauuaaauaauaacuccucacaccacucccauccccuggaaaccacacuuuugauuacuuuugaguacuuuugaugacucuaaguaccucauauugauggaaucauacagcauaugucuuuaugugacuagcuuauuucacuuagaguaauguccucaagguccauccaugcuguggccuaugugagaauucccuuccuuuuuuaagacugagcaauacuccauugaauguagauagcacauuuugcuuauccauucauccacagacacuugagaugcuuucagauuucaacuauuaugaauagugcugcuaugaacauggcaugcaaguaucuccucaagacccuguuuucaacuccuuuugguauauauccagaaguggaauuucuggaccauacgguaauucuauuuuuaauuauuugaggaacugccauacuguuuuccaaagcgacugcacuguuuuucauucccaccagcagugcacaaggauuccaauuuuuucacauccucaccaacacuuguuauuuuccguuuuuuuuuuuaacaguagccaucccagugaguaugaggucauaucucauauguaguuuugauuuucauuucccauuauuagugauguugagcaucuuuuccugggcuuauuggccaucuguauaucuucuuuggagaaauuucuauucaagaccuuugccaguuuuugaaucagauuauuuuuuguuguugaguuuuaaccauucucuauauaucuuggguauuaauuccuuauuagauauaugauuugcaaauguuuucucccauucuguggcuuacuuucuuacucuguugauauugucuauugaugcacaaaaauaucuaaauuguuaugaaguccaacuuguuuuuucuuuuguugccucugccuuuggugucacauccaagaaaucauugacaaauccaaugucaugaagcuuuugcccuguuuucuucuaagaguuuuaugguuuuagauuuuacauuuaggugauugauuuauuugggauugguuuuugaauaugguguuagguaaggguucaacuucauucuuuugcauguggauauccaauuuuuuagcaccauuuguugaaaaaaaauguccuuucccuauugaaugguguuggcacccuuguuaaaaaucauuugauuguauaagcaaggguuuauuucugggcucucuauuuuauucacuuggucuauauguguguauuuaugccauaucacacuguuuugauucuagugccauuguaguaagucuuaaaaucaggaggugugaguacuccuacuuuguucuaaguccagccugagcuccuugagauuccauaugaauguuagaauggguuuuucuguuucugcagacaacauuacugggauuuugcuacugaucgcacugaaucuauagauaacuuuggguaguacugacauccuagcaauguuaagguucccagugcaugaauauggaaugucuucccauuuauuugugucuucuuuaauuuuuuucagcaguguuuuguuuguuuguuuguuuguuuguuuguuuuugagauggagucuugcucugucacccaggcuggaguccaguggcacgaucucagcucacugcaaccucugccuccuguguucaagaaauucuucugccucggccucaugaguagcugggauuacaggcgcccaccaccacgcccagcuaauuuuuguauuuuugguagaaauaggguuucaccaugauguuggccaggcugguuucgaacuccugaccucaagucauccacccacuucagccucccaaaguacugagauuacaggcaugacccaccaugcccugccucagcaauguuuugaugacuucuuuguaugaguccuucaccucauugguucaauuaauucugaaguauuguguucuuuuuguugcuauuguaaaugaauuuuuaaaaaauuucuuuucagauucuucauuguugguauauagaaaugcagcugauuuuuuguguauuaacuuuguauccugcuacuuugcuaacuucauuuauuaguucuaauagauuuuuuuguggaaucuuuaggguuuucuauaugugagaucauacuucuuccuuuccaauuaagugccuuuuauuucuuuuucuugccuaauuucucuggcuacaguuuuuaguacaguguucaauaaaagugggaaaagugggcaucuuugccuuguucuugauguuacaggugcuuucaccauugaguaugauguucacuguggauuuuucaaauauagcuuuuauuuuguugagguaauuucuuucuauuccuaguuuguuucauguuuuuaucaugaaaaggaaaagcaucaaugcuuuuccagaaaugcuuaguagaaaggcauuaaauucuuuuucuaugucaauagagauaauuacguauuuuuugucuuucauucuguuaaugugguguauuacaaugauugauuuucaugauuuuaacccuccuugcauuccagaaauaaaucucacuugaucaugguauaugauuccuuuaauaugccgcuuaauucaguuuaguaguauuuuguugggaguuuuacaucaguguucauaaggcauaugggucuguaauguuccuauggugucuuuucuggcuuuggugucaggguaaugcugaccucauggaaugacuuaggaagugcucacuucucuucaguuuuuuuggaaaaguuugagaaggacugguauuaguucuuuaaauguuugcuacaauucaccacugaagccauuuuguagaaaaucucuaucuauugccauaaaacccuaaaacucuuugacuaagacagaaaaaaucagagcugaaagggaccugaaaacuuuccuugcucaaucaccccauuaauaguuccacuuucauaagccacuugccaacagucagauauuuaguagcaaaacuagggcugaaucucuggccucgugacuuuuaguaaaaaguguucuuuauaccgugacagucuccaaguaaaaaaauguauauguguuuauguagaauauaaaacuuguauagaauauguuguauaccuacuuucugacuuauauuuuucuuucacaaccccucaauuuucccacucaccugauauucaccacgacucaugguuagcugugcauguuaguaacuccccaggagaguucuuacaauaguguuauagaaagagauuaagaacuagggacucaaaugcaaggccacagaggccccucuucauccugucuccuccuccagcugccuuccucuauaaggaagcagguggagcaugauuggccagugaugcauuuaaggcggcuuccucugccaagcucaaaaccagacucccagucuuauaagaugaugacacggggaacucagugguugaugcagcccagaaaguguuuggucaagagaagggagcauccuagacauagcagagacugcuuaugcagaaauaaagagucaggcaggaggcuuucaucucuguagcuacugguucugaguaucaucgacugagaaaaaaauaaauaaaaaaucccacaaaaguuauaaagggaauuggaagaacaguagcacuguccuggggcaagacuccggagugcauugguacagagagccauguggauaacccuagauggcagccucauuagaggcauucucucuccucccaucaacccaguuucaucucugagcggaugaacccaggcccagggaaaggcucugagcagguaggaguggguaccagcaaacguggaaggaaaugagcuaaugggaauuaugaagcaaaggcaauauauaugacaaaccagucuguguugaaagagauaucgaaggaugcggaaaugacaaaauaaaauuccacuaauuuugaucccuuucauucauacuuagucauaauuuaugauacucaaaauugaaaaaauucacuucaauaagaaaaaaaaguuguucuuuuaaaaaaauaaauuguuugacauaauuugaguacauuuuaaaauuuaguaaauaaucaguuguaaaaucaacuuguucagcaggccaaaaugugcacuguacacuguagcccagcaccuccucagcuuuaaugugcagacucaucagcugggaucguguuaaaaugcagauucugauuuaguaggugcaggugcuacucaagauucugcauuuccaacaagcucccagcuggugcugaugcuucugguucucagcaaauucugaguggccaacuauagagagcacccuaggagaccaagcugugccucucucaagaugccucaguagcagauucguguuugggacuugacaccucaagaucaucacuaaguagagauuauugcaaucacauaauuuccugcuugaaugaacagccauguaccugggaagagcuaaucgccuuuacagauuugcaguucuguuuuccuauggacuugucagaugcuaaugcgauuggguuuaccuguggguuucaggaugucugcuagcaaucaaagguuccucuaggcugcaagggagccaauuccugcagucuccuucauuuggaagcagagacuuuauagagauucagguaaucaauuucugcuaacucuggcuagccgcccccacagacccuuuuuaacauucacugaauagguaggacugcauuuuaucuaacucucacaguuacuaugcguuuaucagcuggcugguacagucugaaacaaugugggucugggugauuagcuuguuuucaagugugauucucuugucucaucucuguuuucuccuccuccaggagaaauggcuucccugaggcaaguguaaccuacauucccagcccaccagccugacgcccagccagggagagaguaccauggauggcaucauugaacagaagagcaugcuggugcacaguaaaaucagugaugcuggcaagaggaaugguuuaauuaacaccagaaacuugauggccgagagcagagauggucuggugucuguuuacccagcgccccaguaccagagccaccgggugggggccagcacagugccggccagccuggacagcagcaggagugagccgaugcagcagcugcuggaccccaacacccugcagcagucaguggagucccgcuaccggcccaacaucauccucuauucagagggcgugcugcgcuccuggggggacgguguggccgccgacugcugcgagaccaccuucaucgaggaccggucgcccaccaaagacagccucgaguacccggaugggaaguucauugaccucucagcugaugacauaaaaauccacacccuguccuacgauguggaggaggaggaggaguuccaggagcuggaggucacaggauguguuugucagaggcccucuaagaaugugugauggggauucuagggagggcaggagccaugaaugccuggcaaaaguuagggaaugaaacuagugugcaaaaaugcagaaaccaaaggcagucuuggugcccuucacucuugagugcuuauggaagauagaaggagaggaaagacuuagauuaacagaaacccaggggcgcuucaccggugauucugguaugagaugaccccagguaauggcugcagauggcagugcugguggguucaucgguuuucccugcucucccgcaucccaugagacagagaggucauugacaagaugagagagggacaccugauccuagagccacaugaggcuggaaauauacuugacaggggacacuuugggaggugcuucuacugucaccugugguuccuugacuuugcauuccacaguuacuacugagagauuguugauagagcugaaccgugcuggaagaaaguguagguacugauagccugaagggaagauaaguugacuucuuagaugacucgcuucuuuaauggacuggagggcaggugacagcauuugaauuacaugcacagagauguacacacugcacguuggauauagugugguaggcacagugguugcugaguguguggcacauuguccccccaggacagcaccggugagagggugagagcagcugcugcaggccauggacuagcgguuugcugcccaugccucccaagucauuccacugcagugaggccagggguguuuucccaggacgcgaugucagggaaacacgugccaggcuuuccgucaguuugguggggaaggaaaccgccgagcagguccaaccuucagaggcaguguguggccaaaaggggaagggaugucuguuuuucacuaagguaggcgagaacauuuuuguagguggagaggaaauguucagaauggaaaauucaggaucguggccagcagcuggggaguggucuuggggaggcaggagcugaacuccaagcauguaugugugagagcuggccucucagaagaaguccacaugcuggccugggagagaagagaagggugggguaagggaaaguuugaagggcucuggguugaagaggaagaaaaggagggguucguguuggcugagcaucagcacagccagagaagcuccuggggugugaggagauugcagacagucuagagcaaugaacugggggaagugcccauucuagaaaagacuccuggagaaacugcccagcugcaguaugaguuugugugaagaucuggucagacccagggcucugugacuuucugcagccaugugggaccaucuuuagcaggugaggcucccuuggcaaggugcacucugccuggaagguggaggaggcaggagaaagcaauagggaggaaguuuggagcagaaucagacccacaaccaugggaccccacacuugauagaaaggccggagaaauugcaagggaaugacaggccaaggagaccagaggaucaggauuggagagaccccauugagaaccaggagcugagagauccagcguuagucaggagggaggauuagaaauggagagggaaacuuuggugcaacuccagccgguggagcccgggaagcccacuggcagggaguggagagucguggcauggaagaggaccaagacgugaugccugggcaucugcgcaggccccaaugcccucuggugacaccugugaagggagggcacucacgcugcagcuguggaaaguugggagcaugcuuggcuucuguucagaagccucugcccugucuacuaaguuuuccaagaucugagggcuuugcugacagcaaagcguaaaugcugcccgacucgcauggaguggaauuagagaggcagaugcacgaaaaugcagccccaggaguuaugggaauggaauaccccaucagcucugaagagggucuggggcccugagcucaaugcgggguucagaagucaucacacaggcaggagcccucccccggcugagucuugaggaugaguaagaggaggcuugaggggagcuuaaauaaaagcuaggaaugggugggggcagacacagacuugucugucuuaguagguccaaggcucugacaaguaguauagacuucuggggagguaaccuuucccacccaguccugcuucucugaucuagcagcagaaguggaagcccaccagaaacaauucuuuuaauaauacagcaauaagaaucuuuagucauaauaacggugccuacucuguauuaauauuucuagugacuuuugaauauaacguaagauggagcauguuggcauuuauacuaaaguaacaucgaugaaacagcaaguuguuuacuuaggcacuuuagugagacuuucuggucggcuuccaaggagcucaccuggaccaagaaauggccccuuccacaggcucugagcagaaggaauggagacacauuauggcugcugcugcuucuacaugcggcucaggaugccaaggaggauuucagagccucaccacggugguuaacuucguccuuuuucucugaaaacaaagauuuucucagaaacauucuuacaguauagcuauggugcuuuucauucccuucuucgguaauuaacaaaauacuaaugacugguuagaagugucauugaacaugcaguagcuguucuuugguuuacuguuuucuccauuccauuaaauaauaaagggucauguauugguuagcauuugcugcauaacaaaucacccccaaaacacagugccuuaacaacucuuucuucagcuuaugauuucugagggucggcaauugagcugggcucagcugggugauuguucugcuggucucaccugggcucacucacuuguccauagcuagcugugauaggcugggaagccagccucuggugggcuguuggcugcagugacagagguaacugcaucacccagcugucacccauccugucccaggcuucauuuugcggcagccagagagguggggcccacuuugugagggcuugucaagucuuugccuguguccugcauguuacuaucucauugaccagagcaggucccacagccaagcucagucagugugggagagacugcuuagggucacaauauagggaagugauaacaaauugggugccaguacugcaaccacagagccaaaaaccauagacuuuuggcaucauuuuuuuuuucagauggucuaacugaacagaaugacaacuacugaaacaaaagaacagugaauacugaucugagcucuuuccagaaggcaguucuacucagccaaaaaagaaaaaaaaaugugauuuuuaacuucuuugaguauuguauagcuucacuugguuuauagcaaauggauacuguuucccaaauaaugccguuuucaaaaagccauugcccugguucagaauggggcccccucauugcccuuguucagagggggccaccucauugcccuuguucagggccccucccauugcccugguucagaguggggccuucucauuguccugggucagagcagggcccccucauugcccugguucagagcagggccccucguuucccugguucugagcggggcucccuugcuggagcuccugggcacuggguggcuggcuguguuuuccccaaucacuuucccaagacaggugcaucccuggcauuuaugaaggagccucuccagguccgaagaggucggccugucugacauauguuugcaagggcauguggagcguucaguuugccuucgagguugugguaguaacaagaacagguucuauggcuaacuuugagaauauuuaugggagguucucaacuauucggcaaguguuuaugaucuguccugcuccaccuuaagucgccaaguagagcauggcuugacauuagacagguagauguaggggaccucuggggcuuugcgggagugcagaggugccaugccgcucauuaucuagugccacugcgcucagggugacaagacaggcauccugugggggugcccucagggcauccuggguagugauaauugggccugauguccgacagcccaggccucuucccagguaugugaacacugcuucauccacuucccagccaguagcuaaaaacugcugucucugggaauaccagcagugggaagccacuucuccuuucacacaaauaaacucagagagacuucagggacaaguaaugaaguaggucuacaaaauauacaauuugaguuuacagccaugaaaugaaguggauggaguccaggugcagaggccugaccacccuccugcccuuagagauggugaccagauguugaauggcacuuaccuguggcaaugcaaaaccucucagaccugaaguacaugacggucaccaccuagaagcggugcccaugggggcugagccuuuucuucacugaaggaagaagggggaagggaacgcucaucgauggagcaccuuuucugccacgcccuccaagugcacuuggccaucgaauccucgaagcgcuuggggaugggucauggugcuguccucauccuacacguggagagacagaaacuugggguguuuccaagaucacacacguggcucugcugucagcccuuggaucugagacagaucuccugacuuuagacucugucuccucaugaugaugcuguucuuucuacauuagggggaaaaauguguuccaguaaacuucuguuucagcauuaugccagaguccaaggacaaagcaggaagagacggcaccaggacuucacuucugugaacucuccgccaagcuuuccaaggccuuccagucugucuucccauguaaaaacuugaaagcuguuggaggacacagaauucuauaacugcaauagagcacuuuacauauaccucagucauaaguauggaaagaggggcgaggacucaacacacaugugaagaaaacccaaaagcaugaaugagacagaacaacaacaaauagaacaguugacccagaggaaagagaaagaguucagaaaauaauaaacagcauuuugaaaauuauuuuuaguaucuccagagagauuugaggugcugcugauuuggguggaaggaaauuuggggguuuuguuuugcucauuuguuuguuuaccucauagcacuggccagaaccucaaauacauuguuuagugugagugaacgaacauccuugccuugcuccugaucuuagggggagcuuuuagcuuucaugaugaaaggugauguuuuuguaguucuuuguagacacucauaaucagguauaggaaguucccuuugucacuacuuuguugaagagguuuuuuauuuuauuuuuuauuuaauuuuauuuuuuaauagacaaauaaaugggauauucauauucaugggguauauagugauguuuugauacauguaacauauggugaucagaucaggguaauuagcauauucauuaucucaaacuuugaucauugcuuuguguugggagcauucaauaaccuccucuuagcuauuugaaacugcauaauauauuauuuuucaacuguuuucaugcuacagugcuguagaacacuggaaguuauucauaucuagcuguaauuuuguauguuuuaauacaucucuuccuaucucucccuuccuccuacucugcccacucucuacuauucuuccuucuacuuuuacuucuauaaaauuaacuccuuuuagcuuccacgaguggaacaugcaaugcuuaacuuucccuccugacuuauuucauuuaacauaauguccuccaguuucauccauauuugcugcaaaugacauaauuucauuauuuuuuuauggcugaauaguauccugugguguugaaaugggagaguucccugauuccccuugcaggacguggggugggugugguucaccuguucuguugcugcucaaaccccuugcaggacuggagcaugcagaagggcaggugcagaggcuggggcgagugcuuuaugcucuggccuugcaguagugucuaggggugggugacugcaaccccacuguuacaaagcucuuucagcuuugcuguccacagacggcuugaauacuaacaggcucaaugggcccuuugccuuuucgcaaggacagagggcuggauccagagcuguugcccagcauccuggaaaaaucaggucacauacgggcuugaaggaugaaugugaaguuuuuuugagugguagaggugguuuucagugggauggauguggagccgggaaggauacuggagugggaaggugauccuccccuggacuugggccacccaguggcuggacuccucucugaccauccccaaccaaacuccucucggcauucagauguuccuccucuucucccuuucucugccauguuguucugccaucugucuauuugcuggucuucuggcuugcuagucugcuucuggguccuggguuucaggguuuauauggguguaggcaugcgggccaaaauacaacuuuuuggguacaaaaacaggaaugccuuuucucacuuagggccacagauauccaggcuugaggauggggcuuugccaggaaacugcccucuucuacccaguauuucccugauuccuguccuaucaguguacaacuaccccauuuucuuuauccauuuaucuguuuguuguuggagaccuagguuaaucccauaucuuggauauugcgaauagcacugcaacaaacgcaugguguagaugucucucuaauauacugauuucguuuccuuuggauaaaugccaaguagugggguugcuggauuguaugguaguucuauuugugguuuuucuagggaguugcauauggguguucaauucgucagguacuacuuagguaaucaugugugguguuucuuuguuguccuuuauuuuuucauccuuuaaucaugugguauauuacguuaacugcuuuuuuuuuuuuuugagacggagucucucucugucgcccaggcuggagugcaguggcgcgaucuuggcucacugcaagcucugccucccggguucacaccauucuccugccucagccucccgaguagcugggacuacaggcgcccgccaccaugcccggcuaauuuuuuuuguauuuuuaguagauacgggguuucacuguguuagccaggauggucucgaucuccugaccucgugaucugcccgccucggccucccaaagugcugggauuacaggugugagccacugcgcccagccuacauuaacugcuuugcagauaacagaccauccuugcauuuggggguaaaucccacuuugucgugguuuauaauccucuuuaagugucacuggaucuuuucuaauccuuggauaaggauuucugugccuauauucaugagggauguugaucugcaguuuucucuucuugugccaucuuuucugggcucuaguaugaagguaauauuggcugcauagaauaaguugggaauuauuucucucuuuauuuucugaaagacucuguuuaguauugguaugauuucuuuuuguuuguuagaacucaccagugaaggcauuugggccuggccuuuucuuugugggaagauuuucaauuacugaacugauucuauuacuuuacuaguuuaagucucuuguuuuaaagaaaaucugaagaucguccuuuauucuugucccaguuuuaguauugugacaccuaauuuguuggcaugaaguuguucaucauauuccauuuaaauccuuuuacuuucuguaugguugguaauauuuacucuuucaugccucauuuuaguaauuuaaguuucucuauuucuuucuuggucagucuagauagaaauugaucauuuuuuggaucuuuucaaauagcugacuucugguuccauugauuuuucucucguuauuuaguuuuccauuuuauuaauuuuuuacucagauauuuaugacauccugcccucuguuuccuuuggcuuaaauuuguucuuuuuuaccuauuuuuuuuuuuaggcgugagcugggauuacuuauuugacauuuguuucuucuuauaauguauauucaaggcuaucacuuucuuucaaacacuguuuuaacuguguccuguaaauuuugauuuguuguguuuuaauuuuuauauaguugaaaauacuucuguagccauugugauuuuuuauuuuucuaaugaguuauuuauuaauguguuguuuaauuuccaaauauucagggauuuuguuguuuccuauuauuuauucuuaauuaaaucucauuaagguugaaggacauaguuuguauaauuucucuuuuaaauugauugagacuugauauguggcuuagugucugauauguucuggggaauaugccaugugaacaaggaaagaaugaguguucuguccugcaaaguguuuuauacagauucgcaaggucgugugaguuaauuccuguucgugucuccuguucuuucuguuugucugccuaguugucacaauuaggaguggaguaucagaaauauuuacuuuuagggaauugucuauuucuuucuuuuauuuugucaguguuuacuucauguguuuuggggcuccguuguuaagaguguguacauuuauaauuguuauaucuugcugaacuguuggccauuuuauuauaaagcuucugucacugaaacaccagggguuccaucuagaaccugcugcuccacacacagaaagccaaucacugagacgauuauugccaaggaagagggcuuuuuuaaaaaauuauuauuauacuuuaaguuuuaggguacaugugcacaaugugcagguuaguuacauauguauacaugugccaugcuggugugcugcacccauuaacucgucauuuagcauuagguauaucaccuaaugcuaucccucccccauccccucaccccacaacaguccccagagugugauguuccccuuccuguguccauguguucucauuguucaauucccaccuaugagugagaacaugagauguuuguuuuuuuuuguccuugcaauaguuuacugagaaugaugauuuccaauuucauccaugucccuacaaaggacaugaacucaucauuuuuuauggcugcauaguauugcaugguguauaugugccacauuuucuuaauccagucuaucauuguuggacauuuggguugguuccaagucuuugcuauugugaauagugcugcaauaaacauacauaugcaugugucuuuauagcagcaugacuuauaauccuuuggguauauacccgguaaugggauggcugggucaaaugguauuucuaguucuagaucccugaggaaucgccacacugaaauccacaaugguugaacuaguuuacagucccaccaacaguguaaaaguguuccuauuucuccacauccucuccagcaccuauuguuuccugacuuuuuaaugauugccauucuaacuggugugagaugguaucucauugugguuuugauuugcauuucucugauggccagugauggugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugagcagguugcgaaaauuuucucccauuuuguagguugccuguucacucugaugguaguuucuuuugcugugcagaagcucuuuaguuuaaugagaucccauuugucaauuuuggauuuuguugccauugcuuuugguguuuuagacaugaaguccuugcccaugccuguguccugaaugguaaugccuagguuuucuucuaggguuuuuaugguuuuaggucuaacauguaaguccuuaauccaucuugaauuaauuuuuguauaagguguaaggaagggauccaguuucagcuuucuacauauggcuagccaguuuucccagcaccaguuauuaaauaggaaauccuuccccauugcuuguuuuucucagguuugucaaagaucagauaguuguagauauguggcauuauuucugagggcucuguucuguuccauucaucuauaucucugauuugguaccaggaccaugcuguuuugguuacuguagccuuguaguauaguuugaagucagguagugugaugccuccagcuuuguucuuuggcuuaggauugacuuggcaaugcgggcucuuuuuugguucauaugaacuuuaaaguaguuuuuuuccaauucugugaagaaagucauugguagcuugauggagaugccauugaaucuauaaauuaccuugggcaguauggccauuuucacgauauuguuucuuccuacccaugagcauggaauguucuuccauuuguuuguauccucuuuuauuucauugaacagugguuuguaguucuccuugaagagguccuucacaugccuuguaaguuggauuccuaaguauuuuauucucuuugaagcaauugugaaugggaguucacucaugauuuugcuguuugucuuuuauugguguauaagaaugcuugugauuuuuguacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauaccccuuauuuccuucuccugccuaauugcccuggccaguacuuccaacacuauguugaauaggagugaugagagaggcaucacugucuugugccaguuuucaaagggaaugcuuccaguuuuugcccauucaguaugauauuggcuguggguuggacauagauugcucuuauuauuuugagauaugucccaucaauaccuaauuuauugaguguuuuuagcaugaagguuguugaauuuugucaaaggccuuuucugcaucuauugagauaaucaugugguuuuugucuuugguucuguuuauaugcuggguuacauuuauucauuugcguguauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucaggaugaugcuggccucuuaaaaugaguuagggaggauucccucuuuuucuauugauuggaauaguuucagaaggaauaguaccaguuccuccuuguaccucugguagaauucggcugugaauccaucugguccuggacucuuuuugguugguaagcuauugauuauugccacaauuucagauccuguuauuggucuauucagagauucagcuucuuccugguuuagucuugggaggguguaugugucaaggaauuuauccauuucuucuagauuuucuaguuuauuuguguagagguguuuguaguauucucugaugguaguuuguauuucugugggauugguggugauauccccuuuaucauuuuuuauugcaucuauuugauucuucucucuuuucuuccuuauuagucuugcuagcagucuaucaauuuuguugauccuuucaaaaaaaccagcucuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugacguuagggugucaauuuuggaucuuuccugcuuucucuugugggcauuuaaugcuauaaauuucccucuacacagugcuuugaaugugucccagagacucugguauguugugucuuuguucucguugguuucaaagaacaucuuuauuucugccuucauuucauuauguacgcaguagucauucaggagcagguuguucaguuuccauguaguugagcuguuuugagugaguuucuuaauccugaguucuaguuugauugcacuguggucugagagauaguuuauuauaauuucuguucuuuuacauuugcugaggagagcuuuacuuccaaguauguggucaauuuuggaauaggugugguguggugcugaaaaaaauguauauucuguugauuugggguggagaguucuguagaugccuauuagguccacuuggugcagagcugaguucaauuccuggguauccuuguuaaauuucugucucguugaucugucuaauguugacagugggguguuaaagucucccauuauuauugugugggagucuaagucucuuuguaggucacucaggacuugcuuuaugaaucugggugcuccucuauugggugcauauauauuuaggauaguuagcucuucuuguugaauugaucccuuuaccguuacguaauggccuucuuugucucuuuugaucuuuguugguuuaaagucuguuuuaucagagaguaggauugcaaccccugccuuuuuuuguuuuccauuugcuugguagaucuuccuccauccuuuuauuuugagccuacuugugucucugcacgugagauggguuuccugaauacagcacacugaugggucuugacucuuuauccaauuugccagucugugucuuuuaauuggagcauuuaguccauuuacauuuaaaguugauauuguuuugugugaaauugauccugucauuaugauguuagcugguuauuuugcucguuaguugaugcaguuucuuccuagccucgauggucuuuacaauuuggcaugauuuugcaggggcugguaccgauuguuccuuuccauguuuagugcuuccuucaggagcucuuuuagggcaggccuuguggugacaaaaucucucagcauuugcuugucuguaaaguauuuuauuucuccuucacuuaugaagcuuaguuuggcgggauaugaauuucuggguugaaaauucuuuucuuuaagaauguugacaauuggcccccgcugucuucuggcuuguagaguuucugccaagagauccacuguuagucugaugggcuucccuuuguggguaacccgacguuucucucuagcugcccuuaacauuuuuuccuucauuucaacuuuggugaaucugacaauuaugugucuuggaguugcucuucucaaggaguaucuucauggcauucucuguauuuccugaaucugaauguuggccugccuugcuagauuggggaaguucuccuggauaauauccugcagaguguuuuccaacuugguuccauucuccccgucacuuucagguacaccaauccgauguagauuuggucuuuucacauagucccauauuucuuggagguguuguucauuucuuuuuauucuuuuuucucuaaacuucccuucucacuucauuucauucauuucaucuuccaucacugauacccuuucuuccacuugaucgcaucagcuccugaggcuucugcauucuucauguaguucucgagccuuggcuuucagcuccaucagcuccuuuaaggacuucucugcauugguuauucuagguauccauucgucuaaauuuuuuucaaaguuuuaacuucuuugccuuugauuugaauuuccuccuguagcucggagugguuugaucaucugaagccuucuucucucgacucgucaaagucauucuccguccagcuuuguuccguugcuggugaggaacugcguuccuuuggaggaggagaggcgcucugcuuuuuagaguuuccagucuuucugcucuguuuuuuucccaucuuugugguuuuaucuacuuuuggucuuugaugauggugauguacagauggguuuuugguguggauguccuuucuguuuguuaguuuuccuucuaacagacaggacccucagcugcaggucuguuggaguuugcuagagguccacuccagacccuguuugccuggguaucagcagcgguggcugcagaacaguggauuuucgugaaccucgaaugcugcugucugaucguuccucuggaaguuuugucucagaggaguacccggccaugugaggugucagucugcccguacuggggggugccucccaguuaggcugcucgggggucaggggucagggacccacuugaggagucagucugcccguucucagaucuccagccgcaugcugggagaaccacugcucucuucaaagcucagauggaaaugcagaaaucacccgucuucugcgucgcucaugcuaggagcuguagaccggagcuguuccuauucggccaucuuggcugccucgccggaagagggcuuuaaucaggugcugcagccgaggagaugggagcucagucucaaauccgucucccugcagacuaaaguuagggguuuauauagcagggaagaaguguaacaauguauaggaaaacaggaacucuggagggacaaggaagcaaucgugaugaaugaggggcuuggugucucauagucuggaugcagugauuuggugaguuucgguucuucacuacuuuuugaaaggccuggggguacuuuucugaggaaggaacucagauaaaacaauuuuaaguuucaaucuuuaagaccagaagugucaauuucucuauuuauccaaaaaaaauugucuacuggacuauugguucaguuucaugucccucuuugugucuaauaauauuuucugucuuaaagucugucuugucugauauuaacauagccacucuuucuuaauuauuauuguuugugugauguaucuuuuccuauccuuuuacuuacaauugauuuuuguaaauagaagggacauaccugaaucacauuuucgaaauuuagccuuacaaucucugucuuuugauuggaguauuuaguccauuggcauuaaccauaauuucgaugauuggaauaaugucugccauuuugauuuuuguuuucugcauguauccugguuuaguaguuauuauuguuucucuacuucuucuuacuucuguuuuuguauguuaaguaaauauguuuagcguaccauuuuaguuucucuguugauauuuuaacuguauuguuauuuucuuaguauugucucugcaaauuacaauaagcaucuuaauuuauccaaguuacuucaaguuagugcuaacuucauuccaguaaaauauagaaaccgcacuccaguacagcccaauuguccccauuuuuugcucauacugucauguauguauuucacaggcauguuauaaauccaacaguaguguuacaacaguugauuuauacaauuaugucuuuuaaaaauuauaacaaggaaaaacaguuuggagguuucucaaagaacuagaaauagaacuaccauuugaucgagcaauaucagaaaucaauauaucaaaaagauaccugcucucauauguuuauugcagcacuauucacaauagcaaagauagggaaucaaccuaagugucuauuaauggauaauuggauuuuuuaaaaaugugguauauauauauauacacaauggaauacucuucaucccuaaaaaagaaugaaauuaugucaguugcagcaacauggauggaacuggaggcuguuaucuugaaugaaacaagccaggcacaggaagacaaacaucacauguucaccuccuaaguggguggaaacucagaagggugagagagugggagcagggaggaugaugauaaauugguuaaugggguacaagguauguaauuugggugauggauauucuaaaaagccaugaccugaccacuaugcaauuuaugcaugucauaaaagugcacauguacuccauaaauguguacaaauaaaaaggaaaaaagaucuauaagccuuaaacaaacaaacgacacaggaucacaggagaauaaaaauguauuuauacaguauuauauaguuacccucacucauauuuacuguucccagggcucuccgucuuuuccugugaauucaaauugccaucugcaucaucuacuuccagccugaaggcuucuuucacuguuucuuguaagacaggucugcuaggaacaaauucauucagccuuuauuuaccugggaaugucauucuuuugcucucauuuuuggagagguuguuuuguuggauaucgaauucucguuuggaaguuuuuuucacuuguaacaugucacucuguugccuuccagccuccauuguuucauauaaauaagacaucaguuguccugauauuuccuguucgggacaagucuuuugugguuuuuuucucuugcuuucaaaguuuucucuguuuuucaauaauguaauugccaugucuugguguuggucuuuuccuauuugagguucacuaagcuugaaucuauaacuuuuuucuucuucauauuugggaagguuuuggccauuauuucuuugacuuuuuuuuuuuuuuuuaacauuucucuccucuccuuuuuuuuuuuuuuuuuuuuuuuuuuuugcagucucacucugucacccaggcuggagugcaguggcgcgaucucagcucacugcaacuucugccucccggguuccaguaauucuacugccucagccuccugaguagcugggauuacaggcacaugccaccaugcacggcuaauuuuuguauuuuuuuaguagagacaggguuccacuauguuggccaggcuggacucuccucuccuuuucaaaaucccauagcaaauacauuguuaugcucaauauuccuccacagauauuugagguucuguuccuuuuccuuuaacauuuuucuuucuguucuucagcuuggauaauugaucuuucaaauguguaguucccucugucauaacaaaucugcuguugagccccucuugugaauuuucauuucauauuguauguucauuuccauccaguuacuucuuauggguucuaugccuuuucuuacauugagucauugucaucauguuuuccuuuuauuauuaaauacgguuuucuuuagucugugaacauauuugucacuguugcauugaagucuuuuuuuuacugaauccaacaacugugccccugcccugcccccgagacaguuucuguugacuacuuuuuuuuuuuuuuuuuuuuuaaacuagguaugggucaugcuuuccuguuucuauaccuggcuaguauuuuuuguugugguugaaaacuaaacuagacaacuugaaugauauagcauagcaauacaggauucugauuuuuaccccuaagguuaugauuguuacuugguguuucuaaaaaacaaaaaaaaaaaaguguuguuuugggugucuuguuuuaguuucuuuagugacuuaucuggacuaaaugugcagaaucuuucuccucuguaguauucagccacugaugucuccucagcuuugucuuuuuuuuuuuaacucuuuuuuuauugcuaagccugaccuccugggauucacuucugggucugcauagcuuagaggucagucaguuaauuauuggguagagguugggcucaaauaccucaagcagauaagguuucucugucugccaguagcuccgugugugcuuuggacaaugcauuucaagguucaggcaguuuucaagucugcuccagccccugcugccugucuggcucucuucugccuccucugugcauuuacauugccaccagguccacucaggaugugaggagagcuuaccaagcccugcuaugcuucccucauuuccaggagcuccccguuaaauuccugguuguccuccaauuugccauuugacccaaccagaguuauagccuuagacuaggagagcuggaagcaccuccaccaguagcugggcgugguuuuccaaccucugcucucaagcaauucaaccccuuccagcagugaaguuccugguuuccauggcuaaccccauucuaguagaagcacuucauggaccaagcugauggauggcuuggagcagcccagggcaagaacaccacagacucccacuguuacuacucagaauuuagcaauuuuucauaaauaacacauuuugauauauugcuggcugcuggucaguuugagagccuggcuauggcuguguuugucaguuuuguccaguuguuuccugggcaugagaucggccugccuccugacugcccuagcagaagccgugccaggauacuaucuaagcgcugggcgugcauuucccaacaugcaguaaauauggacaaagaauguguugaugcccacacauggcuugugguuagguugagaauguuaaucaaauuaauuaucuuucaauaauaugauaucuauuugcuuauggcauuagaaaauuaaauuacucauuucucucuguuggagcagucccuaaauagagaaaugcauuuagauauuccagauucuuccagaucugcauguggaucacucacacaaaggaaccaguuucaccuucuuauaguugcaucucauuuauuccagauucuuccagaucuguguguggaucacucacacaaaggaaucaguuucaccuccuuauaguugcaucucauuuauuccagauucuuccagaucuguguguggaucacucacacaaaggaaucaguuucaccuccuuauaguugcaucucauuuugugcugcccaaauugcagcaaccaccuuauucugugaagagccaccagcaugaauaacuggcucauccuagaaauugaauuuccuucaugaagcaaauaugugccaccauugagggcaugccaaauacuuacaauuuucaaaaaugaaaucaaaaauauuuugugaaauaugaacaugauuggaauaguaguauggcaucuaauguuuuaauuuucuauaucaaaaauauaauaacucauuuaaaugugucacucaaggcauguuucucaaaaaauaaaaaucaauaucuuuacacuauuaucuuagacauucucaucuuaugugcaucaauaaaaggcauuggggugugaaauguagccauuuggugagagggaaagaaucucccagauaauaauacaaggggaccauucuucauuuuccucugaaacaaugugauaagaaaaggggugcuggcaucuauccaaaugugugugcugagaaaagaaaaucuuuuuaauuuuucagacuugugcuuuucagaucucuugauguggcuuccaugccacuauguaaaauugugggugaguagagaccuguuccaucuguggcugccuuaauaaagggaacaauggucaaagaauuguaaucuuuuguuacuguaaggcuauaacuauuauaaugaaauccaacuuuucuguauuuacauggagcuaugagugaaauaccuucugacacaaguaauugugacaaauguaguuugaguaguuaagaggcccauaauucaugaaccucuuccacacucaguuuugaacaaauaguaguaaaauguugauucuaaaugaaauuguaguuuaauaaaguugucccaaacuugacugaaggcccucuugucucaaguaguacucacugaaacaaaauccaguaccaauaaaaaggauccuucagaaugcccuauaauguagauguguucgauggcuuauuaaaacaucucucuuuauggaccugccucugucuucagcacuuugguaacucucuaauaugugucuaaaguauauuucugcagugauuagccuugaggcugaaacuggcccaauuaucccauagaacugauauuuaugguuucuuugaauaaacagaaaucgauccucccaaucuuaaaacuugaaaaaguuagauuugucuuaucugaguuccuuucucaggaaaccaaccaucagcccucccagagagcaccaggaacugaaacucaccaaaucacuagaucuggaggaugagacaccggaccccucacccaucacaauugccuaaaugaccacaugcugcguguugaccagcuccucauccuuaucacucccuaaaucuuguuuucccacacaggguuaaauuucuuuccuguuauauaaacuccuaauuaaauuuauuuauuuagagauagggucuugcucugucacccaggcuggagugcaguggcacaaucuuggcucaguuaagccuugaccucccagacucaagcaaucuucccaccacaaccuccugaguagcucagacuacaggugcucaccaccauguccagcuaauuuuuguauuuguuuuuuuguagagacagggucuguguuacccaggcugaucucacacuuuuggacucaagugaucugucugucuuggccucccccaagugcuaggauuacaggcaugaacuauugcaccuggcaaaaucccgaauuuuaguugguuggggggacagauuugaggcugacuucccaucucuguggcugcaacacccaauuaaagccuucucccuggcaguccucauugucucagugauggacuuucuguucagcgagcagcaggaccguggccaaaccccuagcauuucaguaacaaggccuugagaauuccuuucaaccugaccaauguagauaaaaacagcaucuccuacuuaucauaucauaauauuauaaggaaaaaagugaugauaaacauuaaaauuaaacagaagaaacacauuauuugaauucaauauauuggugaugacaguguguugauuuaaaagaguaaagagaaacagucuuuguauuacaauacaguucagauauguauuaaucaugcuacacaacaggggcagagugcacauuaaaauccaaaggugagcccagcuuuuauuucaaccaauaucuuucuuccuuuuucucuagcaaaugauuucacaguauuuccuaaaaacagaagaacccacaucugaaacauugguaguuuggggugcaucacaagcucucauauguagaaagaaacuguaauauguuacaggccaugaggcuguagugauucucagugugcuguacuguuaaaagguagaucuccaaaauaauaaaaagaggugcguuauuuguuggagauguuguggcuguuaaaaucauuagaagggugaggauagucuguccuuacagaugaagaacaagcucaucgaucuuuaauggacuugguacaaaugguacacguggcuggcacucugauucaucuggaagaagcagcagcagaaagaggugagaaggaggcccccacugugcaaagugugcugaaugauucuugccugggcucaucuguauugaagaauguguucucauucacaaguugaggaaagaggaaagcugcugcugugcuguccuggaacuuggagcuggcugaagauuccagaagaaaagauguuuuccuccuggauaaugaagcccgcauugugccccauguaccagaccccggaagaacacgagacuguguuaaugaaaacagccucuguccagcuuaaagaauaaaucuucagaaaaugagguaccugcuauuguucacugguguucauuaaaaaacacccccuugauacgguucaucugaaucuucaguaaguuuucacuggaccucaaauucccauguaggcaaaaaguaagccagcuucagugauaccauauguuaggggacaaguaauuagaaaucccauuuuuggaaaggugagaaccaccggggauauaguggaagucugugccacccugaaacaagaauaugugaaggaaggaacauuccucaguuacaaugcaagaaguaucuuuagaaacggaauguauagcucagaauccuauaaccuuacauaagacauggcacacagaggccgagacuguaaaauacagcuucaagaaucauucagccgagauaacaguggugcuucaaggaggccuggugguggagggugcugggacaggaugggggacggggcaucuguaacuugaggucccagcagacagcuauucucccagcaaagcauguaguguucuucuggcccaggcugggugauguuuggguguuucucaaugugguagaugcuauggaauuuguuucuucuagaaaauagaggggaaagcaagccacuaggacagauuaguccauuguugugucucuuccucuaaugcuuugcuuuagccguuuaaaaaugccccugggcagcagaucacccgacagcucaauaaauccagacucccugugggggaucucccagcagccccaacucccaccuucuccuucccccgcuucacagcccugagucucagccccuuuuucaacuucucaaccacuccaugggcuuuccugucuugggaguccuugcagcccuuccuucugccuggaauguucuuucucuugcccuucacuuggcuggcuucuuaucacccuccagaucuccauuuaaaugccauuauuuguguguguguguguguguacuuguuauuuucugucuugccggacacaguugucuuaggucacauuucccagaagcagacacugaugugggagccaugagcaagugauuugcuaagagauuccucccagggaggagcagugagugaguggggaauucaugcaggggagcugucucagccagagucccacagagggaaucucagccugaccuggaggggacucugccaugcaggugauggcugugaugguugaaggccugcuggcugccaccaccagggagcugugcagggagcagccacaggcucccugaggagcagagaagucaacuccuagacaggucuccagaucuuagcccagagcucgcacacaguaggcacauaauuauaauuaauauuuggcugauucaucuaagauauaaaugaaacuaucagagaaguuugaaauaucugaagaaaauaaaugaaauaucugaagaaauaaaugaaacuaucagagaaauaaaugaaacuaucagagaauaaaugaaacuaucaaagcccugcggguauccugauuucagaagcaugggucuaaggcgcugguguacaccguggucuuaaucacugaagcagucagcuuguugugugaagggcuggacuuguucugauuacauuuggcugcaaucacuaaucacuaaucacugcacacaucccuuaaaguguacuccauggaauccucaucucauggaaagaaaaaugguuugggagcacugaguucccguccccaucucugaaaacucagagugaaggagccacccugagugaugccccguccaaagcccucucccaaguccgucaggcuucagccugugugugaauuaccugggucugguuaaagugcagcucccagggcagguuggggcgggacugagagucugcauuccuacggcugcuaggggccccacccugagcgggaaggacauggacuuuccuaguugaagguccaaaugcauguucucuaaccacuucagggacagaggaggcacgagacugaccuuucuugggagcauaacccuucucuagccacauggccugaccccuuguagcuccuuauggaagccccaagaucacaccugcccucuucuuguugcuggacuuuuccuuaguucagcuaaagacaggguccuugucugucucacagccaugaaaauucaggcuugcggaugguuugaagggugaguaaagcaggguuuuauugaguaaaaaggaagaaaaggaggaaacagggacucuccagaagcccagagucccugcuggagugcuucccccuggcaguucaaaucccagguuccacacaggcagaguaaacagcacagacuucuguggcuccacaucggugcacacucucuccagugugcaggcugcuuggaguuuuuccagggcccccucccaccuggcugucucauuuuaaggauggcccauccagugaagacaacucucacaccugcacuuccugcccaggggagcccucugaaggacauccccagcaucuccacucuccccaggaugguaagccacucuccugggucccccgucacucuggggcccucuugaaaagagccuugaaaaggagagcccaaaggggcucugaccugugugauguggaacagagccuccagccuccuccuuucuggagacaucccugcaagucuuagcuuccaagcaccgcuccucuaacuccugccccauauggaguccauccagcagggccugugcccaccugguggcaucugccuacugccucccugaaaacucaggaggcuccuuccaggaugggagggaggcacggagagcacacugggcuucccacuuggcccaugugaugugcguaugaugggggcaccauccucuccacugugucugcaguugcuagaaaugcugggccaggcgugguggcucacgccuguaaucacagcacuuugggaggccaagacaggaggaucaucugagguuagggguuugagaccaaccuggccaacauggugaaacccugucucuacuaaaaauauaaaaauuagccggacaugaugggugauggcaggugccuguaaucccagcuacuugggaggcugaggcaggagaaucgcuugaauccgggaggcagagguugcagugaguugagaucgcgcuauugcacuccagccugggcgacagaaggagagucugucucaaaaaaaacacaaaaaagaaagaaaaagaaaugcagcagcugguccaguuuugugggagaaguaggggacaucguugcacugcagcugcuggaggcaugugcuuucuuuuuguuucagguaaugagcugaaagaaauaaaugugcucauaaaagggacuauuccuuucccuuucccuuuccuuucccugguagcagaauggaccauuuuguuucagcuggaguuguccccuuguagcagccccaucugucugucgugagcaugggcuguggagaggugugagaauaucagacuccuagggcuggugaccucgggaggcgucugucauccucucauuuuuauucccuucucauaacaccuggagucaagucugaacacacaggacuucaaugucugggggaccagaaacugagauaaaaaugauacuaaccuugaggagaguuuugaaaagccagcggccaaaccaaugagagguauggcgcacauuguccugaucaccuccguggaucuguaagcagcagacaggauuuccaaaacgugaggaaugaggacuuuauguauucauauaagcacucaaaaugugcuaucugagcucaaggcaagagguagucacagcauuugauguaacaauuagggccgaagaaaggcaggaggcaacauuuucuugcaguccucuuuuggaagauucacuucugcauaaauguguucaccugaaccgaaggugguccugugcccccuguucauacaugucaccaccuccacucaucagcugggcuucucagagauggugcacguccguaaccaguucugaaggccugagggacucugggagcaagguggaauucacaucugcuagcucaucacgccaaccuggggaaauugucccacccucugugaggagacagugcaggugucccucgagagcccgcccauuucaagugacaugacaccuuuuggugucggaaauacgaacucaauaaaucagucagggacugcuggaauuucugcaaacugaaaacuguucccccucuuuagccuuuacugugauuugaccacaggaggagaauuucuguaugugaccaaaaaggcaagaagaaaauauucaaauccaggcagcgugugacaggagagugacucguguguccaugucuagugcuuuuccucgcucaaagggguggcaucccuguuuuacaugugaugaaucugagguuccagcugcugguuuuccaucuggucuuauguuagaaucacauaugauuaauucacuuauaaaguuccacaugcccagagagagcaucagagaccugggcgucaggaguguugaagccccugagugagccccgggguagcccaccccaaggacauuggugacuugcccaagggucucagcuaggaagggguaggucaaaauuuaacuccaaaucucaugcuuuuucuauucuauuauacugacuaaccuguaucuuaaggucaaguggauccaaauuaucuaaaucaaaaccaaaaaccccagcuuucuauuaaaaaaucaauuuuuguaaaguuuaccccagaaaaaagugcaaacaaauacugaaccccaguuaauggugugaugcugaaguguuuagggggaguguccugcugugugcaacucacucugacauggaucagaaaagauaagaugaagcgauggguggauaagaggaugaacaggugcacgaauaaugauaaaguuggugcgguaaagaugcuaguuguagaaccuaagugaugaauaugugaacauucacuauauaauucuuuuaaguguucugucuguuguaucuauuugaagugcagguugaugccaggaguaaaaaagaugucuucucugcaccauuuguugacuuauccacuuuuaaucugcuguuugaaaauggucauauaccaauuucaguauuguauuuuauaauguuauagaguuuauauggacaggcaaaaucuucuggcagaguugauuuacugaacaaauguguagcaacacugcucugaaaauauaugggccaucacauuuaaacguaaagugcuuagcuauaaagcuuuuagaagaaaacagaaaaucucuguaaccuaggguaaggugaagaguucuuagcuaugacaucagaaaaacaaucuauaaaagaaagaauagacaaauuuuacuuaaucaaaauuaaaaacuuuugcucugcaaaaaaacacugucaaaugaugaaaagacaagcuacacaaugggagaaaaauauuuguaaauugcauaucugacaauuuguauccagaauacagaaaaauuaucucuuaaauuuaaauguaagaaauugcaaccaucuaguuuaaaaauaggcaaaauauuugaacagacacuucaugaaagggaauauauaaauggcaaauaagcacacaagaaagauauuugacaucauuagccaucagggaaaugcagacuaaaaccaugauuauauaccacugcacaccucagaauagcuaaaauccaaaauguugaaaauacuagguacuggcagggaugcaaaguaacuggaacucucauacauugccggugggaaugcaaacuggaacagcaacucuggaaaacacugucaguuucaaacaccauaugacccagcaauccuacuccaagguauuugugcuaaggaaauaaaaccuuacauucacacaaaaacccauacauauaugucuauaacauguauuucuaauaacucauaauuggaaaagcaaaugcucuucauuuuuggaugaauggauuaaacacaucguguuacuuauuauggacuauuacucaggaaaaaaaaugaaugaacuauggauacacccagcaaccuggaucucgaggguauugugccaguggaaauggucagccucaaaagguugauauacuguauguuuccauuccuaugccugcucgaaaagacgaaacuguaacaaccaacagcagugcagugauugcaagggguuaaggauggggaaaggugggauaugaaaaggaaaaaugagggaguucuuuggaggugaugaagcauuucuguaucuuggcauacaucuauacaugcaacaaaauccauagaacuacacacugcaaacacacacacgcacaagaaugaggcacagauacacuggugaaauccgauuaaggucugugguuuagucagaaguguuauaccaaugucauuuucuggauuuugaucauugcauuaugguuauguaagaggcaagcaaggguauaugggaacucucuguucuaucuuugcaguuccuacaggaacucuguucuauuuuugaaaauuuuauguaaguccaaaauuauuucaaagugcauauauauauauacacacacacaauauuucaaaguguauauauauaacuuauacauauauacacagauauacauuuauauuauaugaagucauguuuaaugaauuugaauauucuuucuguagucuucaaacuguaacuaaaaauaucacuuaaauacaugcuuuucuuucaacaaagcagaacauuuuagaacagugaagaaaaaaaggaaguuagugauuauuaaaaauagcuaauguccaauuaccuagaacaccccagcccaucccuugauaaauaaccagagguuuacuauaauuugguuuuacacagaggcaaccuuuugaaauugacccauugacaguuuuuuugaagaaacagacauugacccuucugaucuuaaagccugaaacuuacauuuguuuuaucugagcuccuucuucaagagaggaccuucaggccuuucaacccaaaaaaauuaucaaagaacugaaacuuaccagaucacuguauccagagaaggagaugccagaccccucauucaucacuugauugcuuccuuaggccucccugguuccuauuuucuuacacacuguuacauuacuucucugcuauauaaaccccuaauuuuagugggucagggagauggauuugagacugagcucccaucuccucagcuguagcacugaauuaaagccuucuuccuuggcaauacuccuugugucagucauuggcuuucuguguggcgagcagcaggaccuagaccuaaccccugguguuucaguaagacuuuaguuuggaaaauacucaaauccuugcaaccuaggcagcccagcugaaccacagucgcauucuggcgugaggggauguggccagggggccagccaggagagcucagagagacugggcgggaggcuccuggaaucaccugaacucaggguucuccugugccacaucuucggcagcuggcucuucuuguugcagagaugagagaugcagauuuaaggcucucaaacugcagagggcuggugacuuuggccacugccuggaacucuugagagcguggagcgacuggucaggugggagacccacauucuucccacucuggaguaaggugguucucauucaagccgaagaagcuucuggugcccuuggguggaggacaggguugggcaggauauggggaguagagauggccacuggccucuuaaaggaagagauacaguuguguucauaugcaccccucccagagcaagcuggauggaucucaagaguggaaaaggccagacucaaaagguuguauacuguaucuuuccauucccauggcauuuuugaaaagaugaaacuguaacaacugauagugcagugguugccagggguuaaggauggaggaagggugagauauacagaggaaaaauggggaaaucauucuuggugcucauaagaagcucagagacgauucagauggguaguguggauggauggaugucagguuccuccaagcuugcccucuguuccagggaggauuggcacucuaccagccuccuccaccucccagcccccguccugacccacauuagucugaaguuuuacccacugcucugcuguaaguuccuucuggcuccuggcggugguucuguucugcuuuugagagugggcauccugugaagagcauuccuguggcgcaagugagaauuaccaugcaagcaacguacauuguaagcagagguacucauuuaguaacuggaucaacaggcaaugauaacuugacauucagcuaugaaaccagcccuucuggaugggucauagaaggcugcaucccuauuuaugucccagucacguagauugaugugggaugagcucgguuuuguucaggcagggagaaguggucuggcucuccacaguccugugugugugaugcccacucccuacccccagcuuugccugugcugcuuucccugcacccaaguccuuuaaugagucacgggcugccagacccuucuucacaaggccugaaguccaguguacaacacaaauuauauccacacugugaaaauaaaaacauacgagaaugaaaaagaaggagaaaacaguaucaucgccagcuuacacugauggccugcugcgcccuggucacuuugaccugaaucacguagugaucuuucacaccaaguccuggaaagcuuuggcccacccugucauugaagaccaagguaugcaucuguucauugcacccaucuguuuggcagcggugaugagguuucucauccugcaugacguauucgucaugugucugucaccuccucucaagugucccagagucucauggucguguuccacauagggcugccccagggcaguaauggggguauccagcaacccccaguuccuccacaggcucugcagcaggugcucucagcuccccuuaccccacaccuucucagguguuacccuugccugagacaccccugggccugaacuuucucuggagaccugaagucugcccugcaaagggugggagaaucucugcccccaggagaccagggucaguuuauuccagagagauaacucagaauacaucuuacacugauuuccucgaggucccaacaggagcagccuccaggcucccacuucucuuccccaucaucuuugcugagaucaccucccaaaaaagcaauugcaccugaauccuuuauucaagcucugcugcaaggagccaggccucaagaaugcguuuguuaggcggggcacgguggcucacaccuguaauccuagcaccuugggaggccaaggugggcagauugccugagcucaggaguuugagaccagccugggcaacacagugaaaccccgucucuauuaaaaaccuaaaaaaaaaaaaaaaauuagccaggcauggcggcaugcaccuuuagucucagcuacucaggaggcugaagcaggagaauugcuucaaccugggagguggagguugcagugagccgagauugugccacugcauuccagcaugagugacagagcuaggcucugucucuaaaauaaauaaauaaauaaguaaauaaauaaauaaauaaaaauaaugcauuugcuaaagcugcccucccaggccacugagcacuuccaggccacaggaagaacuuagccugaugggugaacucaaugaaggaacuucuuauccuacucuaaccauuggauuaaaugccuauagcuaguuaaaagacaaguauuucaauuaaugcaggaauauggaaaacaaguccucuaauauaaugauaugucuuaucacaucauaaaaccugaaguccaguguacaacaccauuaccuucacaaagacaaaccaggagcuacacacagaggugaaucuuaaugaauuucauuucauucggcuccugcuuccagaacauuacagaucccuagggccgucguuaggugcuaaucagaaacuucucagaggagaaauacauuugugcuuuacccaggacaagcagacauuaacagagacaguucucuuuugacaacuucccuuugugaaugaaugcuugucucccuggagcacgguagauauugccagggaaacccuggaugugcuuccccagccucaucccauuacuucuggugagguuuuugucugacacaagugaaugcagaaugcagccuuacaagggcuuucuucccaaaguuugccuuccaggaccccaucccugccucaaagagcugaacguuuuugaaagggaguucaagucucccacuaaucaugucuauugaugaugggaauugagucuucauggggaugugcuaggagcuaagaccuaaagcacccaucccaaaggaagaaaacaaaauuuaaagaaauaggacggaggugauccauuaaggcaggucuggucagcuucaaccguucugcccauacacacugaacguucauuuauucccagagagucuguuugcaaauaaucuucuucagauauuugcaagcaucuacucuggccccagaaucaaacugggagcuuccaaaagagaaaagcucaguccugaccuccaagggcuggagcguggugugcaccucauuuacagcagucaagccccaaacgcucacaaugggaacuucaucucauuuguucuaggacgugcaaggcauuuguguuuuauuuaauuuaucuugcgagguuaauauauuuuucuguacagaaaaguuucauauuuuaugcaccuaacuggauuauuuucuucuaaaaauaccucccuccucaaagaauauaaaaugauuuaggaauauuggacuagauacuacuaggaggaaaaaucuguuuacuucugaaugaugcauugacucgcucauuuuugagcauuauacauuaauuuauuuauuuuagcugagauccauuuguuuuagaaaagauugccugggaagccaauacacaaaacaggaaaagccugagcuguuugggccugggcagguucagggacucugagacauccaccccacaccccccaccaccacuugccccuucauggaggccccaggcccugaagagcacagugagaaaccacugcaucggugacagcacgaaagucccucuccuucagugacacauggcaucgccacccacauugucuugugcucugugacgucccucaaaaaccaaauggagaccaaaugguuagaccaggcccaccacugauggcagagggcauguuuuccccauuuucaggggcacaaagguacauauauccuugugacuacagcaaaaucuaauauguugcaauuagaaauacuuauuuacuagaaaaucugguguuuuuguugguugaauuaucuggguaauggagagcugauuaacaaagaauaacugaauucucagauuuuaggaauuagaauaaagagugaaauacaguugacauuuuaacgacauugcccacgauuucauuuucuuaugaugguuccgagcucuaguuuguggcugaugauuguugagcguuucugcuguaccugcuuugggcuguugcgaugugugauggaagacaguugaucggggggcacgugccccuggcaucacauaccuggaaggggcugggucaaggcggggcucugagaucugcuuugccccuugucaugguugacuccugaguugugaacucacagaucgcaucugagcacuuggcgcugacgggaagggagucacagacaugaacucuacccaugugcuaaauaguaaugaccacccccgucccuggacuccccagcccugcccccaggcugggcacuugcuccccacccucagcagugccucaggcccugacgccuccauggcccccugucuccuccuccccaucccaucucucagcaauccagcauggacguccguaaggauuccuaaauccucacuucuguugagaaagccauggaucucuucccauccccuuccucaguucucuaccugacccauccaaauguaacaaccugcucagcagacaagcuuuuuaaaaggcaguuuuaaaguggagggguuuugucaguuuguuguugcuuguuucacaccaguaugugaaauauccucuuucuacaaaaaaaaaacugcuaccuaggaggaaaaacuaaaaguaugacagcauauacccaagaugauuggucaguaauuuagggcaauguguguucaaauaugaaaacaggguuuccuaggacucugcacucuggaacccccagaucuccauacagcuguguaugugugagcccugugugcaucacacauuggggguucucaggagaugucugugguuuuuacgugaccugacuucaaguaaaggagagaacaaggggccucgagauguugaagaagccuggugcagagaggaugguuugacaugggcagaaggggucgggucuucuacagccaggcagcccacggaaaaccccugagggacccaaguggaccccuggggcuugccccgauggugcaggugcuggaggauggccccagcacuggcccugcaaggucuccauggcucacaucucagacacgggccucacccacguggcucaugaagacucauucccuucugugggaguggaagcucuugccuggagaccucaaaggcagcuggguccacuuccacacaccugugauguggacagaggguaucucgcuccaggcugucugccaagaccagagaacaugagugcaccucccguagaugcagaggggcuugagcugugucuucugccuacagcuuucccaggugcuguccuugguccuguccucaguugcccuggagccaccauaaauaagacagucuugagcguggccaagucaucauucucacccaacguugaaacccuucucuggaggcacauguaaaugauggugaagauguaugcccuggagagcauaggaaggcauuucagagggugaagagaggaucagaggucaggcagcagggcugaaugcagaguauucauggguaaugauaggcccaaaggaagguggagcugcugguuacuccacuguccucugugcaaauuguaggggcuucaccacuuuaguuaguguuguucauauuggcuuaggccacaggcgaaucccucauucauucagcaaaugugcguggguccuacuaugugccaggcacuguucugggcacuuaggauacagcuuuggauaaaaugugcagauuucugcccuccuggugcuuagaggaagggagucgggaugggcaugauggcucacgccuguaaugccagcacuuugggagaccuaggcagguggaucacuugaggucaggaguucgagaccagccuggcuaacauggugaaaccccaucucuacuaaaaauacaaaaauuagccgggcaugauggcacguaccuguaaucccagcuacuccagaggcugaggcaggagaauugcuugaacccgggaggcggagguugcagcgagccccaaucgcgccacugcacuccagcugggagacagugcgagacucuguaucaaaaaaaaaaaaaagaaagaaagaaaaagaaaagaaaaaaaaaggaagagagucagaaaguagacaaaucgguaucacgugaaugcagagaagccccuagcaggcugggguuagaggggcugggaaggugguggcagcuuugcagcuauguagggaaggcucugaugagaaguggcauuugcgcaaaagccucaaaugaagugggcaagcuaggcacaugugcauccuggcuuaggggacggcaggugcacaggcucugaugcaggcagggcacacacgcaugugggaggagcagcagggagcucccugcagguggaaaacgccaagcccagaguaaagagggucagaucccacgagacugcugugagcgcaaggucagagaucaccagauccucacuuuugugccuuuccacagugucaggcuuuuuauugaugcugcauucuccaucauaaaggccacgagcucccuggaguucccaggagguauucuccuuagugcuuccccuugccucgagagugagaguggccggcacgcaggcuugagccgagccacccgucagucaguauugcaaaccguacaucacaguauauuuaaucaacauauaaauguuauagauuaaacauuccacaacaaacuaaguaacauuuaacaucaagagaaaagggauaggaaaagggguucguguuccaguccagggagaguggcgagaauggaaagaauacacuggccuggcccgggugcuccgucaguggucagugucuugcaaggaauagucuuugcugugggcggagccuucaauggcagaugcugggcccuuaucacaagugauggcaagauggugucuguuaaaaugacuguuuucgagcugcugaagucuugcucuuuuuauggcugcagaguccucuggugaggacuaauaguggcagaaugugcuugguuaaauccuugucugguuggaugcagccuuuauugaucaggcaaaaaaacucuggucucuguuugaaaacucuguugcccuaugaaauauaagauggagucuuucuaagauggagucacuuaugucaaaggugcucuauacaacgaacggcacaguccaauaggaccuucugaggugguggaaacguucugcaucugugcugucccacgugacaggcaugggacacguguggcuccugagcauguggugucacugagggaccaguguugguuguguguacuugugagcacuuuaagcggacacagcuccacguuggccaguggcugccaggcuccucagugcagauguggccauugggaccgccacccuuggauggugcgugagaugcucaccagagucggugagcacagagaagugagccaugggugguguucagcuucccacuccugaaacaggugccucacacucuugcucacaaagcugccaugaaugcugaacauugugaugugcaaacauuuggugucaugcccugcgcuaugauuauuuuguuaaaauauucccaggaagaaaaccccgagggaacugagagcccucucucucuguggagguaaggaaaacugggcuagaacaggcaggcgaugcaguagaaugggcggcccuggagggcaccugccuuucucugccuuggcuuuagcucaaaacuaugggaccucugcaugaauugcagacuccuucgcaauguuuucaguccgcagauguacagauuaaaugacucaugaagaggauucuuuaagacagcugcagugcgugaugagucuuucuugguguuggggauuguguguauuucucugcuuggcuuguugguauuuguguggccucuccuaggccagccucgucuccucuccuuccucgcgaguggcaugaugcccacaaccauuuauacuccagaacauuccuggcagaagaggaacaaagaaaagagcugggguguuuuugucugcccuguaauuugucugagcuuuguuuguuuguuuguuuguuugauuuuugagacggagccucacucuguugccccggcuggagugcaaugaugcaaucuuggcucacugcaaccuccacucccuggguucaagcaaucuucugccucagccucccaaguagcugagacuacaggcaugcaccacgaagcucagcuauuuauauuuuuuuaguagagacaggguuucaccauguugcccaggcgggucucgaacuccugaccucaagugauccuuccaccucagccucccaaagugcugagguaacaggugugaacaaccaugcccaccccucaguuuuuaaaaucuauuucaaucaaaguugacaaauuauuuugaugucaucuagccucagcuugguaauuuacagagugugauuccuuuaugcuucuaaauuaaaaucugcgaagacuggaggagugcccugaaagcuaaaucuuugcuucuuggggacuguguaaugcuaaagcaauuucuaaagauggaaggcaaugccuccaagugccuacgugguccgggucaacgguuccccaagcguugacuaagaucgggaaaaccucacuguugccaugggccucuccgucaccaccaugagacagacuuagcaagaagcagagucaucagaguccuggcagggagaggggaggaagacaccucaucuucucaugagaagcaauggaggcaaagugggguuugugugcagccaaagcagccaugugcaaacccagcacgcagcucagagcccugggugcgcagcuggcaucggggauuccagacuccagcagccacucacaggaugguuugugaguggacguguuuuaaccucuuggagccucagcuuuguccuuuguaaaacauaaacgacaaugacaaugaagauaguaauaacaccaucuguaaacuaaaaauaaagaaacuaaaagauaaauaaacagacaggcggauuuuuuguuuuuuugcaaggauacgucgggauccauggcugccgugcucccugaggucaagggcugagcugcgcacuggagaaauggccauuccccagccuggcucugcugcuuucaggagucuuggacauggguugguuugucagagauuggaccucccgagcaucuccugcagagauagccccuucugaagcucagcaguuccaaaaccagcucucugacacccccgaagccacauguuuucagugagggauggagaguggagucgacagggccgugugugaugaggugcagcggggcagauacccagauuccauggggcaagccuuccacacugcacagccuccauguuacaugccauucauacugcacauccuccccacugcauuuccuccauguugcaugugcuccauguugcacauccuccccgcugcauguccucccaacuggacuuccuccccacugcacguccucaccccugcacauccucccuacugcagguccucaccccugcaaguccuuccaacugcacagccuccucccuucacauccucugcacuguacguccucccaccugcacauccucccugcugcacguccuccccacugcacauccuccccucugcacagucuccauauugcaugucccacccccugcauguccuccccccgcacauccucuccgcugcauggccucccuccuucauguccuccccccugcauggccuucccacagcauguccucccccauguacguccucccccuucacguccucccugcugcacucccuccccacugcacucccucccgauugcaaguccuccccgcugcacauccugcccccugcacuuccuccccacuuuauauccuccccacugcacauccuuccccccuucacauacuucccacugcacggucuccccccuugacguccuccccauugcacgcccuccccucucaugcuguccccacggcacggccuccccccugcauggccuuccccuugcauggccuccccccauauguccucccuucugcauguccuccccgcugcacauccuuuacccugcacauccucaccccuucacauccuucccccugcacgugcuucccccugcauguccucaccccugcacauccuccccccugcauauccuccaaguggcacacccuccccacugcuuguccuucccaccgcacguccuuuuugcagauuccagacuccagcaccugaggcugggaagugagcaucuccaccuggacaggcuggggccucacaacucccccgugaauuaugcaucccugugggcuguuccacuuuuuuucccccuuagccauaaugauggcaauuuucauaucuccuuacuguuuggagaccauaugggggccaaugugcagaauaaagagaagagaaaucucacaagccuggcuccguggacagaggcuucgcagccccagacacaugaagcagccaccacagcagaggcagcgacuccuugaccugugcccagcaggaggggcgaggccaggagcuggcacuguagccugagcaaguugcuugcccuguugguggaguggcacuucaggucccugcccugcaggcuuguuggggggcgaguaaacagugagcccaaguuccacgagaggccaccugggacguccuuauuguuggacugaucccaugaaaauaugccguaccagggagccucaggucucacugcagcccugcggcuggcugcacagugauuagaggcucugauuggcaguuuuacuuguguuuaauuaacaaaaaugggaaagggagccguggucaccugugggccuucccagcuucugcuaguaaggaggaaugucugggggcacucaggcaucgguggcaagcagcgggcucgcagccacgcaagugcugcacucacggggugggcccaccugcacuuuugucuggcuucacagggucugucuggaagccuccugaagaaauggcccugacacugccaugcacugccagucauucucgaagcgcuccagcuugcggcaggaggccucugcuuaacaaccuugggcagcuggcagagagcuaggaagccagggccuccuccaagaggaagugagcgacuacucuccuagaaaacaauaucuggaauaagaugggcgccaucuuuguauaggacaaaugccuaggcaggguggcccuggcguuuggaagaguuggugugagggcuccguauuuugaugaggaaagagcccagccaguggaaugacagacaggaggcacccucugcacaaacaccaaggcagggcccagccauucagccuccuggaggagucaccugcccuuuguggggaggguggggcagugguucucuuugcuaggucagcauuggaaucaucugagcugcuuuucaaaaauuacuauggaaucgcaaaccacauaccccauguucucacuuguaagugggagcugaaugaugaggacccauggacgcaaagagaagaacagacacuggggccugccagagguuggaggguggaaggagggaaaggagcagaaagcauaacugcugcacacuaggcuuauaccuggguuaugaaauaaucugugcaccaaacccccauggcaugaguuuacccauaaaacaaaccuguacgugcaccccugaaccuaaaaaaaacuuuuuaaaauauaaaauuaaaaaguaaauuccugugcccagcuucacccugauucccugcucccagcacaccccuucuccaucagaacccccaggagagucucacucagccccugccaccaggccacagagcagaagggcacagcugaggcucacagggccauccucugcuccucaggaagccacccucgugcuccagguggaaaucaggccccaccugugucuugacucaguucagagucaagagaaacuuaaaagagagauucaggggacaauguccuccgucgauccacaucagccuugccuuguccuuguccgcuagugagaagucucguaauacaaagaaaaacgcgccuggacuaugccuucugagagucuccaguccauccucagaacacaccgacagugcaugguggcaacggggccaguucugcagguggcuuccaggcaggcagucccuacaggcagucccugcaaaguccccagucccauccuuuguccccaccauccaggcacucacaucccagcgaucuuagaaauacugcuuucuguaggauuucuucugcaaacgagugacccaagagccccguacuuggcauuauuauuuuccugcucuuggcaagcauuuccuuggccuggcugcccuuccugggaggcuguguacuugcagcaauaacgaugacucgaacaacgucagcaacugcagcugccucccggggagggccugcgccagccaggggucaucccacaucccuggacaccccaggaugacuccuuuauuaaucuucucuccuguccuguccugcugguucucucuugcagagcgacuacucaagcgacacagagagugaggacaauuuccucaugaugcccccgcgggaccaccugggccucagugucuucuccaugcucugcugcuucuggccucugggcaucgcagccuucuacuugucccaugagguaaggccuccuuggucugucgcacguggugugcagguguucacagggugggggugggggcggcaaucccagccgaggaggagaagcaaggaagcccaaacagcuccugcuacagcugggucggcacuugcccaguuggaggauaggcugggagaagucggggcacccuggggccgggaggaggcauuccggcugccucaccccagaugcagcuguguccucgcagaggugggacugcguuccgaagaggcuuuggaacugaagccggugucugcuggguagaaggcacauggccuuugggaggcugucuuucauuuaggugcugguguuguguguguggggugaccccagugccgggaaacaccaugcccaggugggcuacauugaacuuaaugagagaggagaaaaguaggguucugauuuccuugcuaaaggcucauuccuguaaaauagauuccaguuccacagcagcccccauguaccugccccagguaaacgcccugcuuguggaaauagcacaucucagcaugacaucugccauuccuccccagcauaaggcuucuaaagguuucgauucccagccuuuuucacuacagagcauccuguuuguugccccuuaugcaaccuacauuuugaaauauuuggaaggaauuuucucuagcaaguucagaguacucauucagaaaucagcuauauucacauuuucauuaaucagagaaagacauuucuacuugccaauuacagagugagcugauggcauuaccauggcccacugcuaucugcccaaccaaaacagggagaaagagcacuccucugcuggcccagggucgggguggugcugcgcacccaugggguguucucagggagggcugaagaugccucaaagguacagagggucccucuccagcuucuaggguucaggaccagggcugcacacaacugagccuggcagguccuucgucugaaacagauuuccuggcugagcccagcaguugcuucuugauggcuucuguauugguuggguuuguuggacgagugagaggagaauccgcccugccuuuaugggauuucuguuuuccccugcacaucuugaguggugacuggccccucuuucugacauccaaggaggagcaggggagagugguggguggucugugguccuccugagggcaagcgcuuccugacagggcacaagaaguugggaagcuuuugcaggcagggguguagcuggaggggcacaguggggaaaucuugaucugccggggcuaggcugagcaguuuuuccagacccagcuuugaucuugagcgucugucggagcuucucuugugacuucgucccacaaaugccacagaaccccuucuccaucagcacaagcauggggugggaagccugacuccugggucuggcagggccugguggcuguggaguggaugcaggcaugagugaacccugcuucaggaugaggucccagacugggacacacaggagcuggagaaaugggugugggcacaggcccauggugggcagagccugcugugccacauaaacugcacccugaugcugccaauagacaagagcagucuugcaagggaaggagagauugggcccgggagcuggacaggugacaucaaacgcacccccgaagccucccuuguacacuccagcccugcgucaucuccauguggggaaggauagggacacacccaccaucauggggcccagccgcugaggcaucccuguaaaagugccacagagugcuggguggauggaagcccuggauagauggcaaggggccacagggagaggcugccuacguggccaaaggagagaccaguccuuugugguguccguggucucugcugcuccguguguucagauugaagccccagucucuggugcagggcaagguauggacagcgucucuauccaaaagaucaccauuauaauaauaaagagcaaggcuacaacugcagagacugugucuagagucuuucucagaaaguaauuuuauucugaacacaguaagagccucuuaggcuugggucugaggacucaugguguuugauacauuagauagugaagaggauuucuauuacuuguuuagcugcaaaugggaaaugcacuuucuauagaggcuucugaccacauuuuuuggaggugaaguggaaacauuuucggggguggguguagguguugccuucacuaugggcguagagaggagcucucagggccgcuggcugcagccucccuuuucagugugcuuugagaauguauuucccugugguaaaacuacaacagagaagaggugcuaacacuuuuauaaagauaccuguggagcugaguccccuuggcagggccugugucugcauccgucuccaaucagaacucccaucccaggcagcuccccucagucugcaguggugguuccgggagcugcugcagauccuggaaacaagcagcccugcacaggacgccucagccggcuaccaggcugcugagcauucuguuuacagcccgcaccgcagaugcguggucuccagcaggccaucguggggaagccggcagcugccaaggagagaguguggcacagaauagaacagaugcaaucugagaauccuugcacuaaauuaaaucagugcuuuccuaagcgaggccagcugggagugcgaagcccaggacuggagagggggaagcccggagcccucucugccgcaguggccagcacauccugcugccuuguugggucaaggggaugaugcaccugggcaaagagcauguugguggagcugaggcucuccaggcccucagugccauucacaaggaaaucuuugacaucuaagugugacuuuggguuuuuuuucccuuuuaucucagaucauaucacaguguacucacugacagucaggcugugucugcucauugucaaaauaacuguucagugaagucaaaggaacaugccaagccauuacagaaaaacaaaacaacaucuuaugguggucugauuaaauugggcaguggagaaaaugagggaugccaucucuagaauuaugcaccuccaguauguuguuuuguccuguuguagccuggucccauuuagcaggcagcucucccaugccucuguuuccugacccauacagugauguuaaaaugauuuccagggugugcgguuagcugaggguuagagaugaaggccagugaaaguucccaggaggcaccugcagagcagcugcugcuggucgugcccugcuggaaaccugaguucuccaggugcuggggguccagaggccaaggaacaccuggaaagacacagacacaccuuucccagcagauuuugcuaauucuaaaaauauguucaugaaguagcauaacaguaguaaucaaaguguuagugagguggguaacauuggcugaccaccuacugugcgccagguucagcgcuggagccaugcacccuugcuuccaggaugugguccuggacccccuaggcacuugcuagaaaugcacacugucugguccaccacacaccugcucagucagagucucuggggcaaagcccaggaaucugcauuuugaggaggccuccagcuccucauggaugcugcugccaucacccgggaggggccguggugaccugugcugcagucucggcugggaaucuaauaagaagugggaagcugcgggaugucuuuuggaagaaaugaccccugggcuuugguuguggugugaaaggaagagggaagggagggaugcccuggguucugauguugcucgguugugaauauugcugucuuacaugcauuaucucauaggaacuccaugacaugggugcugaaaucaggguucagugagauugagagaugugccuaaagccaacauuggugagcaguaggcuggagcuagcaggaugugcagguucggaagcaccugccuucucugggggaggcaucuggcuugucccugagcuguggggugggggugggugggcagaugagggcagcauguugucuacaacuucauuuugcccaacaauguuccauccagcccccauugcaagcacgcuuuguaaaccaguucauacagaggaggaugugggugugugcgauuagggugguguggcuucaucuaggaacugacauuugugaaugauacugaggauagacaugaaucccauaauuggcugaguggcugcugucagcuaguuaaugcacacacuuuaucuuauuuaaucuuugcagugaguccagaagguggaaaauuauuaucuccauuuuacagauuaacaaaacugaaguuucaagggauuuaauaaguaacagaaaucacagagguagcaaguaugggcacaugagggaaauauuaauauuucuaacccuuaaagccauauuuucugcaauguagcuuugacuuuuaucuguuugcaaaugaaaauagaaccacaguccuugcuucuaaauucaccauccccccacccugcuuggaaaggcuugcaggggaggaaagccugucugagcaugguguggcauuggucuucauggcacuucacuccaucccaugugaugggggcagccggggaccaaagccagaucccugcccccaaggugggcauugggccuggaccugcgccgggcaggcccgaggguuccuguguugacugugcuggcagaugucuuugcauccaagcauuuauuaugucuugaucuaauuucauuucauaaaauguuucuuuccuuuacuaacugcaacauuauaacaauaauuaaaugagaaaaggguauuaggaagcagauuaugaauuuuaugaauaguaccagcaaagggaauugggcaaacuaggggaaaaaagagaaucuuuuuaugguacugaaaaucuagaagagugcaaccuagcuaauagcaaagccccuuggaauccauucauuuacccacugauuagugaacaccucccacguguucaguaagugccaggcaugcagcagugaacagagcaaaccaaaucccgcuugucagagcuaacgugcucgucgccugccucucuuccuugcaaugucagcuuuacuuuucuccguuuuacucacuggcuauuagcugcggauggacauggggagcguggaacugggagaaacguuuuuaacaggguggccguggcggggcucgcggagaggauggugucuucugauaaagccgccaguugagccagggggagcccuuggggaggagcuuccagacagagaggccugcagugccgaggcccuggggggagcacguggggcagguggggccggcgcggcggggcugggggccgcggguguggaguggggaauggggguagggguaacuaacaaggcggggccaacaggggcagaccccgagacucuuuaggcugugaccgagcggggcuuccacuuugggauaagaagccucggggguuugagcggaggagaagccccuguggccacaugcucccgggagccuucagagaacagggcggagggggaggcgcagggcgacgacggcaguggucaaacgcagaaccguggaguccugugcugcaggaguggcugggaauuucauaagcaguggggagcugcggggugucuucugggugaaugaccccugggcuuagguugcagugugaaaggaagagggaagggagggaugcccuggaccagggguuuccugcagccggauaggcagcaccugcagcggggccucucaacuccaggagcugucggccucugcguggaggcacugaaccaugggggcuccagggagacgucugggccgaggguaggaguguaaggccugagcuggggaucaagcaccggcgcggugaugaggggcccgugggagcauugaccgcugaugagcagcuucaggcaugcagggagggacagcaccgaggagcggacuccagagcaagaggaagggaaccauccagcgaugcagagcugcacugcugggacuuggaucagcaggcacagcagaggggcgcggagggacuugugggugcuggggacauucucuuuccugaccuggguacuggcuguaugcuuguggaaacucauugagcuuuauuuacaccuucgugugugugugugugugugugugugugugcacuuuucuguaagaauacuauacuucaauuaaaacauuuagaaaaugcacguauuugggaggccuagggagaagaacugcuugaagccagccugugcaacagaccccauguauacaaaaauuuuaaaaaaaaaaauuagcugagcgugguggcucaugccuguggucacagcuagucaugaggcugaggcaggaagaucacuugagcccaggaguucaaggcugcugugaucuaugaucccaccacugcacccaggccugagugacagaaugggaccuugucuuuaaauauacauauggaagugcaaagagaguagcugaacauaguacaucuaguuaucuuuuuuuuuuugaagaguuuugcuguaaauggagagugagaaaugggaugcuauuuaaugaggucaugucaagaguguucuuuuguuuuuuguuuuugcuuuuaagugggagaaaugauagcauacuuguucauaaugaaaaugacccaaaagagagaaaaauagauguugugaaauacagugggaaggagaauggggggacaguuaggggagcaauaaaaagcccccaagcaccucgcacauaguugacaucacacacuucuuggggcagaugcagaugagguauuaggcugcgagagucauguagcuguucccaggucaugcuuccaaggguagagccaggauucggugcccccaccaucaaugcccacuucugggucaguggucagugauuaugucacuuagugacagauuccaccaaauacugcccaaguguuagaggaaaucauagucuugcuuuucacauuacaaauacccacauagggaagaacuauagaagucugauauccuugccucuuguuuucaguuaaauagcagcccugcuugcagcucccagggauaagucuguccuucucucucugacuccauuaaaacuggaucauauuuaauuaugggagagaaccaagcuaucuuggguaaugauauauacuaaagguauuuauuauuucuccugaauuuaauguucuguagcagaguagaaguauaagucaaguacaggcuguucuuucuccucugaauaagaugcucugcaaauucugcaaagguggagggaacaauuuugggauuugggugugaaaacuugucacucaaguaagccuuguaggacauuaagggacacgacaccaucauuguuccagcaggaauuaagugcuucccuucucaaucuuacucuggauauuaauucuaauucuuuauggcuggugugugggaugcaauguuuucuauccauuucccagaaagagccuaaaccuuccuguaaccaccgucaagacauugcucagagaguguggggacauggguuccucccagagauccaaacaaugccagcaguuggaauuugcuuucuuaguuguguucuugagcugccaggcuguugaugaacuaaucaacagggccaucauaaucagacuuggaugauuugcccccacuuuccagguuuuuaaaauuaauuauuuaauuuuugagacaggguaucacuccauugcccaggcuugagugcagcggcacgaucauggcucacugcauccucagccuccuaaacucaaccuauccucacaccucagccucccagguagcugggaauacaggugccugccaccacacccagcuaauuucaauauuuuguagagauggggaucucucuuuguuuuccaggcuggucucaaacuccugggcucaaaugauucuccugcuucagccuuccaaagugcugggauuacaggugugagccaccccuguauggcccccaguuuuuuaauauggaaagaacaaguugauuugcccauggaaaaaguugaggucaguaaaucaucugaaaguagggagaaaucaggaaauccugaggacuucagcucaacguccacacucuggcccacugcugcuggaaaaacucaguuugucuuucuuuaaaguuaaaggguagauguacagguuuguuauauaggucaauugcaugucaugggaguuugauguacagcuuauuucaucacccagguaauaagcauaguaccugauagacauccuccccuccuccuuccucaagucggccccauugucuguuguuccuuuucuuuguguucauguguuuucaauguuuagguuccacuuguaagucagaacaugcaguauuugguuuucuguuccuaugucaguucauuuaggauuauggcuuucagcuccauccauguuguugcaaaggacaugaucuccuuuuguuuguagcuauguaguauuccaugguguacauguaccacauuuucuuuauccagucuaccauugauaggcauuuaguugguuccaugcuauugggaauagugcuaugaugaacauaugcacgcauaugucuuuauaguagaaugauuuauauuccuuuggguguauacccagugauggaauugcugagucaaaugguaauucucuuuuaaguuaguugagaaauugccacacugcuuucuaaaauggcugaacuaauuuacacuuccaccagcaguguaaaagcauucccuuuucuccacaaccuugcuagcaucuguuauuuuuugacauuuuaauaauagccauuuugacugugugagaguuucucauugugguuuugauuugcauuucucuaaugauuagugauguugagcauuuuuucauaugguuguuggcugcauguaugucuucuuuugaaaaaaaauccaucguguccuuugcccacuuuuuaaugcaaguguuucuugcuuguuaauuuguuuaaguucuuuauagauucuggauauuagaccuuuguuggaugaauaguuugcaaauauuuucucccauucuguagguuguuuguuuauucuguggaacauuucuuuugcugugcagaagcucuuuaguuuaauugguaugguuuaucaauuuuugguuuuguuucuauuguuuuugaugucuucacugugaaauauuugccaagucuuauguccaggaugguauuuccuagguuaucuuccaggguuuuuauaauuguacauuucacauuuaagucuuuaauccaucuugaauucauucguguauacagugugaggaagggauacagcuucaacuuucugcauauggcuagccagacaguuauccuaucaccauuuauugaauagggaguucuuccuccauugcuuguuuugucgacuuugucgaagaucagguguaugguuuuauuucuggguucucuauucuguuucauuggucuauaugucuguuuuuguacuaauaccaugcuguuuugguuauuguggccuucuaacaugguuugaagucagguaacaugaugccuccagcuuuauucuuuccacuuaggauugccuuggcuauuugagcucuuuugugguuccaugugaguuauaaaauaauuuguuuuccgauucugugaaaaaugucauugguaauuugauaggaauggcacuagaucuguaagugcuuuaggcaguauggccauuuuaacaauaucgauucuuccuauccaugagcaggaaauauuuuuucgguugauugugucaucucugauuucuucgagcagcauuuuauaauucucauuguagagaucuuucaccucccuguuagcuguauuacuaaguauuuuauucuauucguggcuauugugaacggaauugcuuucuugaaucuuggguguuguugguguauagcaaugcuacugauuuuugcauguugauuuuguauguuaaaacuuugcugaaguuauuuaucagaucuaggagcuuucggguagagacuauggguuuuucuaaguauagaaucuuauuaucugccaacagagauaguuugacuucucuuucuauuuggaugccuuuuauuucuuucucuugacugauuguucuggcuaggacuuccaguacuuuguugaacaggaguggugagaguggacauccuugucuuauuccauuucucaagggggaugcuuccaacuuuugccauucaguaugauauuggcuuuggguuugugauaaauggcucuuauuauuuugagugugcuccuucaaugccuaguuuauuaaugguuuuuaauaugaaaggaugcugaauuuuaucaaaagccuuuucugcaucuauugagaugaucuuaugguuuuuguuuuuauuucuguuuaugcacugaauugcauuuauugguuugcauacguugaaccaaccuugcaucccagggauaaaaccuucuugauugugguggauuagcuuuuugaugugcuugugguuuuugcugagaauuuuuacaucuauguuuauuaaguauauuggccugaaguuuucuuuuucuguuaagucuuugccagguuuugguaccaggaugauacugaccucauaggauguguuaaggaggagucccuccuccuccacuuuuuuguaauaguuucaguaggaaucguaccagcucuucuuuaugcaucugguggaauucggcugugaagccauauaguccuuuccaguugcuaagcuuucuauuucugauucaguuuuggaacucauuauuggccuuuucagggguucaauuucuuccugguucaaccuugggagauuuuguguuuccagcaauguauccauuucuucuagguguuauagauggugugcauagaagaguucgugguacucucugagaguuuuuuuaauuuaugauuguguuuauuuggaccuucucucuuuucuucuucauuagucuaccuaguugucuaucaagcuuauuuauucuuucaaagaacaaacuucuggauuuguuuaucucuuguaugguuuuucacuccucaguuuucuucaguucaccucugauucugguuacuucuugucuucugcuagcuuugggguugguuugcucuuguuucucuaguucuucuacguguaauguuaaguuguuaacuugggaucuuucuaacuuuuugaugugggcauuuagcaccauaagcuucccucuuugcacuguuuuagcugugucccagagauucugauauguuguaucuuuguucucauuaguuucaaagaauuccuugauuucugcccuaauuuuauuguuuacccaaaagucauucaggagcagguuguuuaauuuccauauaaguguaugguuuuaagugauuuuccuugcauugauuuuuuaaaaacaacucauuuuuaauguguauuuauguguuuauuuugccaauuacucauucaagagauaauuaaaugugaaaucucuaaaccuuuuuuuuuucuuuugagauggagucucacucugucacccaggcuguagugcaguggcauggucucagcucacugcaaccuccaucucccggguucaagcaauucuacugccugagccucccaaguagcugggacuacaggcucccaccaucaugccuugcuaauguuuguauuuuuaguagagauagaguuuugccauguugccuaggcuagccucgaacuccugaccucaagugaucagaccgccucggccucccaaacugcuggaauuacaggcaugagccaccgggccuggccuccaaaccuuuucuuacacuccugacucgugguguuuuaccuacaaguuguuucucauccucaccccacuuggagcccuuccccugcauucagaauucuucagcagucagugccgggacauauaagcucugcauccucaaucucccccagucccuuucagaucgauucauuggccgucgacuggacaccugccacguucgcguguuuagucccauuggauucaacggauaucacuggucacacagcauccuccuuacucaggcauuugcagccuguguagaugguaaaggggggcacaccccuugcuggugggacgcaaagaggcucugagugcugaggaggggggagugcaguacccugggugugcggaaggccgucugacccugucuuccacugggaguccaugaacagauuucucucugaauucccuccuccuuccuuccccucguguccuuuuccaugguccucuuccagaacacauuuggaagaauugucccaguagcucuccccaggagacagauaauggauguccauuguacauuugucugcacauaaaagugcaguuugggagggaagaaauagagugcagaaaagauucuggcuuugugucauggaaauggcugcguguacuuucccuuguuccugcuauacuauuucaggacacaguuuguuucccccuuggcugccuuaucccgucuugugucuuuuuuccaaagagcucaagacauuaaagaccacagcauuucuuccacuuuuuucguuguucuggaagggaugcuaaggcugggagggggcugcauuuacacagacucacugggugagucugugguggaucggggcuggaauucuggucacuguguuuccuggaggcucugagaucccuaacaugacagcugugugaugcacucagugugguaagcguuggacagaaauaucugaguccaucaacucaacugggcucccuagaacacagaaccugcagcaagguuagaauuccgaggccuuauuuagaagugugauuccaggccagcgaacacgggggaaauggaaaggagguguggaaggaggcagggcaacaucugauauuucucccuuuggaagcaaaagcaccaacugagagucaccucggugugcaagaaucagagcagcaccuuagccccuccauagcuuuggugccuucaucagaaagcauagaagacugccuuuccuccuaagacucaaggaggucaaaacugcagcauagaggugcauucugguccauaccaccucacaucaaaugacaauuuggguuauauaauaagcugacaucaaucguuuuuucagagugcaaccuguguuagccaaauuggaacccagguuaaagaggguaauaacauucucaccaggacagccuuguuuugagugcaguaggggccuguuugggugucagcagcaagccuucgcuggccacagcuccaguucucuguugagccaagaaaugcgcugcugcagacgggcacugugcaggguauggaguggagggcuugccgccaugcacucacgaaacaagaauggcagcaagggcaaagugcuuuagacgcacaauuccaccuaauucccacagcagcuccaugaaauuaguacuaguauuaucaccauuuuacagaugauaaauuuuaugaauuggaauccaggucuguacaaaucagggucugugcuguuuuaaaagccuucagauauacccagagccacuguuucacagaaaguuuacagugaguuuuauuucaucuucaagagaauccugaaauaggaaaauucuauuguacccagcaagugaggaagucagcacccagcaagguuguuuaagcuauucaggaucacacagcagguuggcuacacgccaggacuggguggggcccacagugggugaaacugugaggaaauccacaagcaccucuaggugcucaggaucggcuccuacagauucuaguccaaucucauucaugaccucauuugcuuuucaguuuaacagugcuugguuuugguuuacuauuuuucccauggaaacauuuuuuaauuaugucuuaucaguuauucuccauuuaucccaaagggucaguuuugugauuuuaaaauugacacuauguagaccuuuaucuuucaucauacgcaaaaaucaacucacaaugaguuuaagacuuaaacauaagaccaaaaacuauaaaacuacuaaagaaaaccuagggaaaucgcuccuagauauuggucuaggcgaaagauuaauggcuaggaccucaaaagcacaggcaaccaaaacaaaaauagacaagcaggacuuaauuaaacagaaaagcuucugcacagcaaaagaaauauucaacagaguaaagagacaacuugcagagaggaagaaaauauuugcaaacuagacaucucacaagggauuaauauccagaauaugcaggaaauucaaacaacaggaaaaaaaccuacacauaaucccauuaaaaagugggcaaaggauuuguauagauuucucaaaauaagacaaacugcuaacagauguaugaaaaaaugcugaacaccacuaaucaucagaaaaaugcaaaucaaaaucacaaugagauaucaucaucuuaucccagucagaaugacuauuauuaaaaagacaaaauaacagauguugcuaaguaugcagagaaaugggaacucuuauauacuguuggugagaaugcaaacuaguacaaccauuauagaaaacaguauggagauuucucaaaaaauuaaaaauagaauaccuuugacccagcaaucccacuacuggguaucuacccaaagaaaaaggaauaauuauaucaaauaaauaccuacacccucauaguuacugaagcauuguucacaauggcaaaaauauggaaucaaccgaagugccaaucaguggacaaauggauaaagaaaaugugguauagauacacaauggaauacgauuuggccauaacaaagaauggaauaaugccauuuucagcaucguggauggaacuggagauuauuaagugaaauaagccagguacaaaaaggcaaauacuaccugcucucacuuauacacaugagagcuaaaaagucugaucacauggagauagagaguggaaagauagauaacagagacugggaagagugaguaguugggggacgaugaagaguagugaguuacaggguacaaauguacaguuagauagagggaauacauucaacgguugauaacaguguagggugacuauaguuaaacaaaacucuauuauauccagaagauggacaccuuaaauacccugacuugaucacuacacauuauauacaucuaacacaauuucagagguaucucauaaauuuguacaaauuuuuaaaaaguuaugcuacaguauacagucauuuguuggaagaaucaaguaauuucuuucauaugucuucacaaaaaauaucgagcuuuccacauaugugauauauuauuauacauuuuugaaaguuagaaaaaaggaaaagagacuggaagaaaaucacgccaucuguaggcaaugggugguuuuucucuuccuuccugaaugagucuuuguguuuauuuauuuguuuguuuuagcaccguuaaugugaaggggauugucaaaccuuuccuaguuugaaaauaacagucagaauagaaaccuaaaugcauagcuuaacaaauuauuuuaaagcaaguggccaagucaccaucacccaggucaggaaugucccugggacccccaggguagaaggacuagcaccuuccagccauccuuccuccuuaucgcugcccuuccuccccacccagugaccacuggaaugaccuccacagaacacacuuuucuugcacauuuuuauuauuuuaccaccuaaauuugaguuccuuaaccuucaugucuucaucuuucuuucuuuuuuuuuuuuuuuuuugagauggaguuucacucuugucaccuagaccagagugcaauggugcaauggcgugaucucagcucacugcaaccuccaccucccagguucaagcaauucucgugucucagccuccugaguagcugggauuacaggugcccgccaccacgccuggcuaauuuuuguauucuuaguaaagacggaguuucaccauguuggccaggcuggucuugaacuccugaccucaggcuaucugccugccuuggccucccaaagugcugggauuacagguaugagccaccaugcccagcccaugucuucaucuuuccuuacugcacuugcaaagccacauugcaucugaauggcacucuuaucuuguaucaacggaaaaauuuccaacauuucacuguuaaguaggcucuuuagguaacucauuuuuaaaucauuaauggcuguuggauuuaccgaaagcuuuuugugcaaauggaaaacaauuauaugaauauuuuccuuuaaucuacuaauauaaauuacauugacugguuugaaauguuaaaccaaccuugcauuccuagaauaaacccuaauugaucauaauuuguauauguugcugaauuugugugcucuuuugcuuaacauuuuuguguuucuguuuacgagagagauugauguauauuauccuuugugguaauuucuucauuaaguuuugauaucaauguuacucugguugugaagaguucccuuuuucuguucucugaacauuuauuuaaaacugaccuauuuuucaaaucuuugauagcagucauugguggagcucuuugagccuggacuucucaucauaggaagauuuuaaauuagugauuuccuuucuuuaauaucgauaucucugauuaggcuuucuguuguuucucauaucgguuauggcaaguuauauuuuucuaggauuuugucaguuucaucaaaauaaucaauuuuaauaauauuuuuaaaauaugaauuugggccuuuaagaacuaaagagaagauuaucuuuucuggggauggauggauagacagacagaaagaaauacuucaaaaugacaauguuauuguuuuacauuguugauauuuaucuguagaaaucccuagauuccacuacuuugcuccucauuucuuccuaaauuuuuuaaucuuccagcuugaaugauacccuucugccuaaagaacauccuuuagaauuuccuuuagaguggcuuuucuugugguaaacacucucuguuuuauguuauuggaaaugccuuuuuauuacauuuauucuugcagguaugaucauuagguauagaauucugguccacaguuuccucuguaguugugucucaaauucugccaaacccauuauaauauuguuuuuuuuuuuuauuuuccaguucuagaauucccaugugucuucuuuuucagaucaccuacaacccuucuuguauguuucaaucaccugccaacacuuccaagcuuuguuuuauuuccuggaacauaguaagcagagguauuuuauagucuaugccugaucauuaugauaccugggaucccugugagucuggguguuuguuguuuuuccuuguucucacucaugguauauuuucucagauguuacugauuuuaugcuggucauuguuucugacaaaguauucauaguaauauuuugaagaugaagaugaugccaccuuucuucagauaaguuauuucuuugcuguuuuuccagcacauacggcacaaaaaauucaagaccaucuuaguccacacucaagcuccgaggugaagcagaacugggcuguagcucaugaggggcugguguacuuucaugucaccuuuucucucauggcuuagcucuuuggugcuucauccuauggcugguuuacaggaucucccucuucacugggcucugaaauccaacuuggauuccuaugaucucacaaaguaacccaaaauucacccucucagacaccucuuauggucagcaaacaucccuagggaauauguguccucauaugccugguccacccuucugaauuauuguccucucccuggccuuggccugauaaucccucaucuucuuaccucuuuaaugcuuuauaaaauauuuucuuuaauguuucuuuaaggauuuuuagcugucuucuguagaaggguuaccagucuggcauuauuagaagcagaaaucuauauuucuguuuccuuaauuguuuauacagagaauguauuauuuuuauaacagaaauauuuuuaacuacaaaauuggaagcuugguugaaggaccuagauuaucugucacuugaauucucauuucuucuggugcuaacugaaauucuaacuggcucuuugcacugcaugaguaaccaacacaaugcuaucgaggcuaaugaggagugucaggacaugggacgaaggccauacagcucacuccaaugcaaauaaagaaacaaucuuuauuuaaaugcuacaaagagccacugggcauggaaucugccacauuguaggugcucauuuaaaugcugguuguguuuguaucugaugcaaagaugugcacacccguguucugcuuggucauuucauaaagaugaaccaugugguuuauaaaugcagcauuaccaaaaaguguccggaguugggagagauuguucguggcuaggaucaaaccaugcugccaaauccucugagcacaugccuuuggcagggcuguagacaaguguccccaacccauggggacuucuggggagagcuucauuccuagugcuccaagcucugccauugagcagggaggugagggcuggaggugcccauaggugagagcuguucacaagagguguuaauucccuggucuuucuggcuuguuccugcacgguaaguggaaacaauaaugacaggcgugcccugagugggacacugccucagggaggaaguaaaucgcaggacuucagcuguaugcagcagaagggagacauggacacacgccugggauggcagcggagggucagaagcccugagugcaaagcagggucuguccacuaacagggcauucucagcgaggaagcauugcauugagaguagaguagaccaucaggaggaguugucagaaagcagcauauggaaacgguguguucugaaaacaacucauccuuagcccagaagaauuuucuucacaaggaaaugagcagagacauucgucaggcacuguggggucacaguggauaccugcuccugcagacaaauggggagaagaauaucugaaagaaugccaggggaguucauucuccuccacucaacugcccccaaccaggagcacauucacagucaaccuuugccugacacaauaauugaacugggacuuucccaaacaucugaaacaaaaugcccuggguuucuccgaagcugucaccuguccaucuuucuaaucauuuaucuuaccaaaacaaacaacauuuucauguucucucuaaaccuugucacaaagacagacuucuuuugaaauuuguauuauucuuucuuuuuuuuucaaaguugugugcuuagaacauguacauuguguggaacuggagcuccacggauuccacacacucgaugguuuuguucauaaucauccauaagugugggugucagaggcauuugaaccagagugacuccaucuugaacaggggcugguuaagguaacgcugagaccugcugggcugcauucccagguuaggcauucuaagucacaggaugagacaggagguuggcaccagauacaggucauaaagaccuugcugauaaauggaugcagugaagaagcuggccaaaacccaccaaaaccaagauagcgacaaaagugaucucugaucuuccucacugcucauuauaugcuaauuacaugcaccgccaugcuaaaagacacucccaccagcgccaugacaguuuacaaugccaaggcaaugucaggaaguugcccuauaugguccaaaaaggggagggacccucaguucugggaauugcucacucuuuucccagaaaaaucaugaaaaauccgcccuuuguuuagcaaauaaucaagaaauaagcauaaaaagagccaaccagcagcccucccuuggggcugcucugccuguggaguagccguucuuuuauuccuuuacuuuuuuaauaaacuugcuuucacuuuacucuauggacccaccucaaauucuuucuggcaugaaguccaagaacccucucuugaggucuggaucgggacuccuuuccgguaacacugggauaauauuccgugcaccccgccagaucccacuuuuauccuuaaguucauuauuuuuuaacguccucagauuuauaguaaauugagucccaucuaaugaaugcaucuguuaggcucugguagauucagaaucagcccaaaacccaaguuuucccuugagagucacagggcauccaaggucaugggcagguaguuggggggcaucuggguaaagacaugaaaccugugcugggguccaggagaaaguccuggcaaagggcaucccaaccaagcaggagugauggagccacgcagaaagaaaaugcuacccagggacagaugggugggaaggguuugccgugggcccacaucuaccucccugggugagugacauguaaacgaagguugcaaugagggcuacaagagcccagcuagauacaagcauaacauugacuuugcagacaaaugcauugaaaaacauugcuagaggaacggcuccaauauuacuacauggguuuauuuuaacuuguaucagggaaaugugugagggcaguuaaauagucaaaugguaucucuccucucucucucucccucccccagucuguaucucugucucaauaugcauauuuaauaugcugauuguagcuucugagagcuguuuugcaacuucuggauuuaaacaauuccauauaaauauuaaugaucuggugcagccaagacaaaucagauuucuuauguauuuuuuuccucuggaauccaugcugcaguuaguuacugauuuuaacuuguucuaguguauaaaugaacaaauacaucaugucugcuuugcuccuugcaguggauuggauagauuuuuuuuuccacugauaggugauacauugucuugguaauuagcaucuugauuuugugauuauuugucuguagcagagaaaacaugcauguugauuguccaagggcagagucugcaaagccugugacgugugggacccagaguugacauagcaaugcauuacauuacaagcugugcacucuucccuuuggacuuagggcucaccuccaauuacauuuccaacaugugaucauuuuucuuuaaaugauguaccugaagcuuuuagaauuuagcaugccuccgacaguaaagcuguccacauguuucuuuugcaucucuuuuaagaucgaggacuucugugcagguccuacagcacuaugguuuuguguggugucccucggcuucuggucacuaucuguggccauuucugugacuaccaggccagccuggccagaggcugggaugauccaacaaugugcugguugaucacagaggcacuggagcaucauugcaagugucuccagaacaggcaugugggcagucagugcuggccucagauggccucaagccaagucucaaagcuccaccugucaggggauguggcuaugaggcugugguuagugggaugucccugccuccugaacagcugauggucaggggacugaccccuauugccaugagcgacaacucaugaacaauuuucucugggaaacuauuucacugaauucuaauagauaucuagcagauaauuaccccagauuucacuuuguccccaaaucuuagguucuguugaccucaugcuaaaucaaaagcaggaauugcacuuuaagguaaaaccuuagguuauuauagaauugaauauuauauuauugagaaaguuauuauaaaaagagaacaaaucugaauuagaaauguccaucuggaugcuacuuugaauagauuuaggaaacuuacuguagcccaguuaauccuuacgguauggguuuucuggaaguagagauccggaguuuagauucugugcuacaggugggcagagcgcagcacaagugcccaucccugggguuauguaggggagcauacaggaucagugggggccaggcugccaagcaagaagauuggagucagcagaaggcugugugcuccuguauucgucagaaugauuaccccuggaugcugacuuggaaaguggaugcugacgagcagaagaagcaguguuuggaggaugauucugggaucuucauuuugaagcugcccugggcaguugaggcaguacugucaauagggaguuugaaauaaggaguuugcaagaaucauguguuauaugaacggaccucuuucuuuccacucauuuggccuuuguuugccauugaugaccuggugaaaguucuuuuugaaaacuccaccuuggccgggcaccauggcucaugccuauaaucccagcacuuugggaggcugaggcaguuggaucaccugaggucaggaguucgagaccagccuggccaacauggcaaaaacccaucucuacuaaaaauauaaaaauuagcugggugugguggcgugcaucuguaaucccagcuacuaguggaggcugaagcaggagcauugcuugaacccaggaggcggauguugcaauaagccaagaucacaccacugcacugcagccugagcaacagagcaagacuccgucucaaaaaaaaaaaaaaaaaagaauaaagaaaagaaagaaaacuccaccucguucgggcugaugagagucccaguugggcacccugguucuggccaaagggccguccucaaugccugauucacccgggcugcugggguggagaguggggcuaggaagagccucggcccaugacgaauguucaccccuccugcugccuggcugugacuuuuucuccucaagagcgagacaucuccaugggccacauucacaguggagacggccucgggcucccccucucccugcuucaagggccgaaauucacaggcagcuguggggacagggaagcccaacugcucucucacuagcacacugggacuugaguuggccacaguuggagaaccuucuaucaauuacuuucuuccguuuuuguagacuuuuuagguguacuccauuugacgaaaaccuaaugaucuuuuaaaacucccaauauuuacaguggguaagucaagggcaguuauguguaucucagauacccgaagguaacguuaaugcauuaacauaauguccugcaauuuacuucaaguauauuuaaaauacagguuuauacagaaaucuauuuuaaacacuuuucccggaugagauccucuuaugaaacaagaugucagagcacauucaaaacaucuucggcagcuaaacccucuagucuccagugcugaauuuuaguguuuccuuccaguuguauaccuaauaaaagauauuuuaauuauaaagauaugaucuaucaaugcuuucuagaguauaaacccaugacaaauaauacagaaauuauuuuaaauuuuggcaauauuaucuccuauuuuuuuuuuuugagacagucucgcucugucacccagucuggagugcaguagcgcaaucucagcucacuccgccucccggguucuagcgauucuccugccucagccucccaaguagcugggacuacaggcaccugccaucaugcccagcuaauuuuaguacuuuuaguagagacaggguuucaucauguuggccaggcuguucucaaacuccugaccucaggugaucugcccaccucagccucccaaagugcugggauuacaagcgugagucaccgcgccccaccaauaaaaucuuaacagugacaauccaucacccgccaacugaccugcuucaagugacagcaccgcaaggcccccguguccagaccucuguacauaggaacaugaaaccuguguacuuaacaagaugcuugggaggaauacacaggauauuauguacgcugaucucacggaugagacaauaauuaaaaggugacugaaacuaccuuuccuguugguaagcaaaagcuuucagccacaaauaaggcaacaaguaccucucagaccgcccgauggccgucaguaaggauggggcugagaaguaguguagauggagagaaucaugugaaugauauugauaauauaagcucaguucucuugaccaacccuugcauucuagaauuaaagcuaagauuagaugauguucagaaaaacagcauacaguacugcuuuguguggaggacaguaauuuugugugucuggacucacauguauguuggugcaagccaaaccuacagauuuaaaugaggggugacaaaugagucauggguugaucagcacauuauagauucucaugggaauccagggcuauuuuacguacgucucagugucauggguguuuuaaaggugcucaucacauuaccaucugcacuucugcuguagaaaaaugucauagcaagaggacaggagccaugcuucacuacucuggagguggcaguucucggcaaugucccccuuuucuugccucuuugcuuagcuuagcauuuucuggugcuuagggaguuauaagaaucccagacagagagcauagcaaaugccaaauuuagagcugaaaaaauuaccuugagguugugcuuugacguggaaggcggaugugggaugcucuuugcuuuucuuuuucuguccuuccuuuuagacggggcacucuuuauuuuuaaccugucuagacuguguauaaaguaguaaagggucacugaagcacaguugcagcauucacuuguaucaguccauauguacgucccuggaagcuuugcauuguggcagcacucaagcacacacaggagcagaggaugaugagucccuggacucagcugggagcuggaagggauggaugccucagugaauucggaaauaaaugaugaugcaacaggacugcagauugcucaggggauuuggaaauagcaaaacagacgggcagagagaggugccuuugagagcuggcccugcacuagaguauaggaaacuggaaggaugaguuuauaaccaaagucacuagcacaacugugauucuccagaagcuccaugguuuggggccaccuuaacauucauaucucagcucacugugcaaggcccaaccuccaucuggacaguaucaccccucaagagcccacuccacccaaccugagcuuguguuuuccagacaugccugcaccccaaggcuuccccauuacccccauucugccauuauccuccuugccacuucccuauguucccaggcccaucccacgugcaacacugcucaccaccaccacauggggccucuggucaucccuuuuuggucaaaaggaaaaguacaggagcuuccaggccauccuggaaagguuuucaggcauagaaaacacgaagagcaggugggcaauacuuuguggugcugccaggaauccuaaauacaggugaaaacauggaaauugcaauucucacccagcuaauuuuagacugacacugguggguggagagacgggguaucuugaggcucuccaagcucaguuuuaaaaugauucucugcauuccugugauaauuuugaauaauuugggccuggucuuuauaggcauauaaaaugcuuugcauuccuuugggaaugucauacugagugugaaaaccaaaagggauauuguaaguggucauucuucauuccagagccaccuguguccacgcaacgauuccggaucacccgccgugggcacucggaagcauguuuaugcauguagcucugcacacgggggggcgagugcuaaucagccagaaugaauguacuauccccaucucugauuccacagcaggguuccugagucacacacaccacacacaaaagaagcucagauuuaugcauugccugauuguucugguccuuaagcugaguuuuagguaauuggaaagguaucuugcaaguaacacucucagcaggacacaauuuauuaugcaugaaaguugaaucgugagaaagggaguugccccaaguuggcugaugagcugaugagucuggagggaggcagagcccuucacgaagccaucugaccuucucccugccuggaccaggcacuguguauuugcccagaugcauguaaguguucuuugcuuggugcugcccaggaagacggagauggauccacaggaggaagccaggccacucucggcaccuuugccuugucaagaagggcugggucuucuuugaggacuuugcccugcugcaaugacaggaaaugaguugaacuggcaucuuauuuccuuagucagaggggcaucuucugucuucggccagcucccaggcacaauuccuggcagauucucucaaaucugcuccccuagcugaaccacgcgaugcucaggauauugccucugaguguucgccuuauuucugcugcuggaacuacuguuugcccacauccaggcuccaaaccacggcccacggcucccuccccuagccccaccacauucuccagguugugaaucccaaacauucucucucuaugaaggcuccuggccucuccauuccucuuugcugucccuuugcucuacucugguucucaugaccugccucuuuuuggaaccguuagacuauucuuccagcucacgaccuuguuuucauaccucccuuuucucuugugucagccaaaguccccaaguuaaugcuccuaaggcaguaagcugguaccuguccccagcgaagacuucagcgguuccugauucucugcagagcucacucagagcaccuuugcuggaggcugguggcccuugcaacucagcuuagggcucuacuuccagcacccccucccacccauagcuggaccauccuccccacggggucucgggagggucacacccucccccucccacucucuccugucuucuguacucugguaugcccuugccacccccaccuuucauggccucuccucccaugccaccccuccaggagccccuccucagccucugccuggaggccuucuacccacaagcuuccacuucuuccacaggaaaugggccaggagccucucccaggcccuuccuuaugcagcauggcucugcuguucaguuuuagcccauggugcugaucuccuuugagcauucuaagcucaagaaucauagggaaucuggccagagcccucuuguuguuacugucagaugugaucccugagaaugggauaauccuguaauucagguguucuaaaauaaaauacagggaacaccaaacccugcacugcuuccuguaauugcaugucuuaaugagaguguuccugacauauccaguuccauugcauagcugugcugacagggacacagccacuuaauggcaagagcaagaaaaauauugucccagagaauaucacauaguuuauguaucaaguucucuaagguucugcgugauuagaggcaaacaauucaaccugccaccauugugugcuguucaugagaaaggcugauucuuucuacaaauucuucauuaauucucaucaccacuuaggagcacggacgccucccaagacuuuucuuuucuccaaauaauuccucuuuuuuauuuagauaggaacagugugacccuagcugaaggggcugggaagaugucuuuaauuuuuggacagggcuuaacccuuugguaccaggacagacaucaggugcccccgaguccugagucuacuugggaauauugugauggucccuguugacauaaacauccuugugccuuugucuuaaagcaggagaagaaagcagucugcacuauuauucaugacguggcaucccaagccguaagacuaaagaauggcuuuggcaacaggacuuaaaacugaucuuggcacaaccuuucauuaaccugcaaaagauuaauuuuauuucccaguaacuuaacagaauucaaaagcuaggagaaaaggcuuaaaggaaagucaaccuuagauauguuucuaaauauaucuuaacucagaaauauucccccucaguccuagcauagaauuauaauagcucuucaucuucaaaaagugugcaugaaggguuccagcucuuagugguccauaaacaaaugguugcaggagucaagaacucagggucggagaggcuccuggaucuagaaacaucacugccagucacucaggggcagggacaaaccccagagagggucuaccuuagcaacaggacacauccugugugcccaucucaaccacaggccaucacaugcugagcgcuuccaugugccaggcaccauguugagugcuucaugaguuccaucacaugugugccuccacaacacugaugagaugggaaggaaugcuuuauggaugaggagacugcgucucugggagauggcaccgugggauggggugaaggcagggugucagagcagauccucccaaugcuuggcuaaacugcccaccuguaaggcaaccuagaagauaccagaccucccuguugcucagauaaagggucugggugcuugggguuggaaguuuggaaagcauccuggugacggccauucccagcuaugugacccuggccaacuuacucccugucccagggccucugagauaagacaggauguggugaggcugccagcugcugugugugcuguaugggagcaagcaagccuacucugcaaaucagagagaaagcaccauccgcaccuggacagccgcucucuguccugccgucucccugaacagagcugcaugcccagauuuggugcagucuccuugcuggccucacaaucagcuuuccaugacacagaccugcccauggaccccagcauggaaccaggacugggcgaggacuugcccucaacccacccguugugccuagcuagaccccaagccuccugugucccccauugcgggucccaaagccacccgcacccccugccuuggcaccuccacacagaggcucucccuucaugcuugcccuccugaccgugugccaggaaccccugcucagcccacacagagccagcuccugcggcaucucccagagcccuucuagacugacggccgcgccccugcagcucuucuccugcuacaguggggacuucagggaacauucccagcuuaaaucaugacacccaaaggacaagggcauaaauggcauaaaugggauuuggagccugaauuuucuuagugucuagagacagaagaggaugguaaucuagggcuuugcggggaagcgugaauggagaggccaugcugccucccagguaggggagagaggcuguuaccagugcugggugaggcagaccauggagagcacucugaucgccagcgggguugggcaucacucucagaucuuuuguucuuuuugacaguaucucucucuguugcccagguuggagugcaauggcacuaucacggcucauagcagccuugcccuauggggcucaauugauccuccugccucagccucccaaguagcugggacuauaggcacacaccaccaugcccaccacaccuggcuaauuuuuaaauuuuuuguagagaugcggucucacuauguugcucaggcuggucuugaacucuugggcuuaaaugauccucccaccucagccucccaaauugcugggauuacaggcaugagccacugcacccagccucacucugagauauuaaugugcaugauuagacuuuuuaguauucauguaauuuguggcuugguaagggaauacaauaaauauacuuuuuuguuuguuuguuugacugguuguuguaaagagugaaguagggaggcaacaaccaagggaacuggcucaucagagcacuuuccccaaaccucccguucuucagugaaaacagaaucugaggggaacuaaccuaaaguugcuaauuuaagacucuggagugaucacagcaauauauuaaauuagaucuuagaaacugagacuaggaaaaucaaaagaaggaaggaagggagggagggagggaaggggaggggaggggaaaggagggagggagucauaugggaggaaugagcuaacccuccacacagauccuuuuuggaaguugucaggguauaaauaaaacacaaauacuauuaaagugcuaauuauugacaaauuguugucaagcagaaguccugcuucgccuauuuaaaugccuaggcuauacuuaaaauguuuauaugcauaaauuaauguaauuggugaauggaguaugaaaugaacagaacuuaacaauaccuuauaguuuggaccaggugcagggaaacauucucaaacaucugacuugucaaauauuuuaaagcagcguuauugcuuucaagcaauucuguuaccuugcaauuaacaagcuuauguuucaaaggaguucuuucaguggccuacuuuaauaagugaaagcuaacauuugaaauuaacagccaauuuguacauguuuguugaaauucuuaaggacauuaguaucuuaaguagguuaggcagcuuccuugcuaauguuugaacaucgauguaauugguccacacagcauuuuguccacccuaauagccugccucuccugugugacagucuucuaacgauccucacauuccaacacccaugugaaaugaaaugggcccagggagggguguuacuccaauguugcaggaaaccgggauucugagauucagagaaccccaccauccaccugaaaucccuaagggggugaugagcgagaccuggguucagccugggucuuccaaccccagguucuacgcucuuacagcuccucuagcacccauccagaaccaagcuccugacccagcaagagaggccaccucucucuaacugccaggccccucugugaagacuguagggcuuugcgggagccugggagcacaaggaacccaugcugcacccacuucauccuccccauggacccggggccaggcaggcuuuuuugguguccagaacucacccggguuccuccccaaguggccucuucucacaggcacauuuucagaggggacacacacagguccucaguuuauccccacacugcuguccccgaaacaggcgcccaauggaaggucugcacggucuuucaucuuccaccuccuccucucagcaugcugcugcccgaaguucuuaauguccuccugcagcucagagaacaugggauucuucccucuccccuccccgccccaccucccccacccgccccucucuguagaggaaggaccccuaagagguccagggaaaucauuuagcacauccacgagccuggguggaaaauuaguuacaucauuauuuuuaucaaccucuaccugaaauuuagcacuuccuccaauuaggaguguaagcaacacacggcagaguuuguugugacuuugcaccaggagaaaccacagaugucuucacaucacauaacagcuguugaugguauuuuaaaauauuguuuaugcucaucacuacuuuaaaaaugcaaacccaaauguuaguuauuauuuagugucuuaaaguagcccauauauuucuauauugauuaugauuuuuaauguuuccaaagcucuauuucaauauauuugguuccucuuuuaagccucuguauuuuauuguauacauuuaagaacacuauuccgagacaggggcuguggcucuaagaaggugagguuccccaccuggcauugugacauguuguccaucuggccggcaccuccuucccacccagcucaaggccuuucaccaaggccuuuccaggggcucgcgccccuccuccaccugcauccucccagcucugccuuuggggauuuuaauuugaaggaaauaagcucccauuccagacagggccgagguuggcugggccaaccugccuccccucuggcagugaaaggccugcccucugcacucucagccaccucagggcccagguuucuggguucagcagaaggaagcacaggagcugauuugcggggagcagcagcagcucccaggagaaggcgcaaggaggccccugcaaggcggagcagaaaggagcaggugcagggggugaggcagcuggacagggcugaggcagcuggaugaggcuucagccuucacaccuggagagcaacuggcugagcuuggaggagagaaaaucaccugcuagcuucgcuguuugcugcugcugugaugcccggcugcuccucauaagguaugcacuucccaacccuucacugagcuacugucgccaggcagggugccggcacuggggacacugcacagagcaggaccaaggcgccauccuuguaggguuugaaauaccaggccacguagcagagccccgguggcugcugaccuucagggugugggccaaggagguggcuucgguggcuucuggagguaucugcccgcuuccacagcccucugcggcacccgugcacucucaggccucucccucuuccuguagcugcuuaagucacucaggagguuuacauaacagacagaaaauuuacccggugugauaggugggccgagaagagguggccgccugggugcuguccccaggguucuccugcagcacggggccugcaccccaucgcaugacucugcaaggggcugcucacccuccagccguccccaccgaaccuccgugcuccuggcccgcauccuuccucucccucaccuccuaaacucggucaccgacucugccccaucaggacacccuccucucugcugcccugucaccuccgcacccagcugacugagggacaaaaggggacauggcacugcucugaacccaggaaagcugggaauggacuugcgugccuuccucacagucacagcugcauccuuuggagaugcagcagcaaugccugugagacaagaccuuuaaugagcuucuagacacugcccuccgggugcuccugagaacucgacuuugucagagucuccuccuucugcgaaggggccccagacauaggcaacccauuucacccucagacuccucugccgacccagcaaagcccgggggugcauuuuguccucugagauuuaccacaaggaagccccccaaaagaguaggcgaacccaggaccuucucagcugugcuccuggccaaggagagcccaggggaggcugagggagagcucgggaagcuuaaggagggucugggagaggggagagcccgggaaggggguccugggggagggucugagaguggggagagaccgggaagggggguccugggggaggguaugggaguggggagaggcuggggaggguugagagcccggggagcggggaaagccuggagaagcgggagagcccggggaguggggagagccuggggagggggagaccccgggugggggcugaagucuggagagcggggagagccuggggaagggagaugcugagagagagcccggggaguggggagagcccgggaagcaggaagagccgggggaagagggagagcucggguaggggggaacccggggaguggggaaagcccggggagggggguccugagggagagcccaggaguagggagagcccagggaagggggagacccuggggaagggggagagccuggggagggguaagagcccggggaagggagagagcccggggagaggggagagccccgggaggggggagagucccggaagggggguccugagggacagcccagggaagggggagagcccagugagggcagagagcccagggagcgaggagaucccggggaggggggagagccuggggaagggggucccuggggagggcccagggagaaggguucucuaccaucucugggaggcagagcaccaggccucgugggcaccacggggcucagccucuccuucucuugucggggucauuucugaccagacaaauuaugucccgacuagccugcuauucugccaacccaaagggguauucuccucuauacuccgaggaaaaaaagacaucaucccaacagcagcuucauuagcuuuauauuuuccucucaucuuuugaagcuggaagaagagguucuguguuaaaaauguuccuucccacugugcauaaugcuaauguccuccacauauuaaaguuaauggaguauuuuacacacugagaagagcugcugugaccuuuucuucuuuuggaugagucucuuauuuuuuucucucuuaccucuuccccuccaugugacucuuuuuccuuuuuccuuucuuuguuuuuuauuuuauuuauuuuguggugguuguuguuguuucagauauguaacugcuguagccaagagaccagggcauuagggcuuguauuuccuuaauugcaacaacagcaaaaaauaucaucaaauaauauagagggagacaaaacgcaccuguuuucuuccagguauggccucuguagaaccuccugcucuuauaugagaagacugagguuuacagucucuuuugcagggcaggaguguugaagccuccuggaauuuaaaacugccaaaaggguuaaagaaaagcuguggucuugagucuaucucauuguuuuaaaugcuggaaaaaugaaaaugccuauguuaagccugugugucugacuuaguggaacccucagcccucagccaaacuugacuaguguuacaccucaaggauccuuuaaucgggugcauaacaaggaucuggacuggcugcgcaguguguccacauaagcuccuaaggccuucacugcagcuuuucugaagaguggggacccagggccauuccuccugggcccacuggucauugucaucaucaagucuguucucuuuaaauguugcuguuaugaaaggagcuggaggguagccaaucacuuguacaacacuacuucagucuuguuucacuucucaauauuugcaaagugauaagagagacaagucugccauccucauguuccuguucguagaugauucucaggggagcugguauuuaugugacauaaacaagagcaugcauuugcaagugcaugcacacacauaauucaagaaccuugcuauacauuguauuuauuuuuaauguuuauaauuaagauaaauguaguguugccacuauauaauagcauagcccagacugacuacauuaucuucaugauguuauuagacaacaaagcuccagccauuaaaggaaagucaucuuuuagugaccagaacauacuguaucccagaccccauguggcaugacccagccuaacuuucaugugcaaaaucaggguucuguaucuuccauuugaguggcauugagggagagaaagggugaugcagaggcuuccaaguucagacccugcaugaugcaaggcauguuguggaguucugcacaugaggaaacugaggccgugggaguuuaaauauggacucagcuaaagagguucaaaauccuggccacccuggagagcuucccuaagacccuacaggagaagguaaauucuucuucaggacaacuuugugucaguuccugcaaccuucaagccacaaucuaugugauucuuaucaguuuuaaaggaaaguauuuuauacacaacuccagaucccuguuuucugauaaaccucaaaauuguauuuacaacacugaucuauuuauugcugcuacccauacaugguggcauaaacaacuuuuucauuaugcucaugauuucuuugguugggaguucaagaagcagcaugaggaugguuugucucugcaccaugaugucugggaccucagcuaggaagacccaaggcuggggggugaccugacagcuaggaggaaacaucuggaggugucuuuacucccacauuuggucaucagugcuggcuguuugcagggacuuuaaacaagccauccauaggaggcccaucucauugccuuuccaugugguuucugcacauaggcuaauuugagcuuccucacaacacggcagcuggcuuccucaagcaaacguccuacaucaagguggagcacaagaucugguuaugauccaaccuucaaagcuaggcagcaucacuuguacuggacuguacuggucaaggcauucauaggaggagacauagaugucaaggcucuggaagauuauaagggaugggaaaaauugcagcugcuauuuugggacuauauagucugccacagcuguauuuccaaggaugaaagaaaacuauacacauaacguauuuguauuaauagguucauaggaaaaugaauaaugacggaacaauuguuuuccuaaauacuuuauucaaaucaauauaucaaauuaacaaaaucucuuugaccuaaaaugccuucugucaguucuuauaaguucauggcauuauuucaguaaaagguaaaaggcaauuugacugagaugcuauuauaaccucucaggugcccguuggcauacaaagcaaugaugauaaacacauuaccugauggagauaaaagggcuaagaaucuugugaaucuucagugggcaaaguaaacagcauuauguugauaaugcuaaaugauagcauuaaauauuuuaagaguguuaaaaaauaagcuaaguuagcauauuccaucaaauaucugcagccugauguuuuguauguguacaagaaaggaauagaaacugucucaacaaaagagagcaaccuuaaagcauuugcuaaucuuccacaugcaucucacuuguuauucuaaaaacaaaguguugggaaagcuuaucuauuuacuuuugcuacuuaaguaaauaacuuaucacaucauaagugcauugcacuuugaagguuucaguugguuggcuuagcacaugguaaacaccaauuuggcauucucucuuguuaaguggccauuugcaaaauguauuauuucagauuugcugaaauacugaauuucuaaguuuacacucugcuuauucauauuuuuaaauaacucuuuugccauuuggucccaaacccaugugcugaugugucugcugggucucauuucuuccccuguauuaguaucugaagcaguggcauccuuuuuuugggggaaaacucuacccugggaagggacagaaagauuugaaagucauacccuuuucuggagugcaccccaggccaacuaugcacuccaaagaaugauacuugaucagaucagagaacauguccuucccuaugcccuaccaccaugugaaugagcuuccaguauaauaaccaugaguugagcuugaaaaaccacaagacauauacucugacuuaggugccauauauaagggaauccaaaugccaagagaagaggcaaaaauaaggacauuagaaguuucugacaccuaaaucuacaccaaacauugaauacacuucaacuccuggccaaauuaacaucaauucucacuugaaagucuuauuuaacucaguaucuucugcucuauaccauaugucuauauuucaacauaauauuacaaggcaggccaaaagucaagagaacacugaugagacaaaauaaucaucagaaccaaacucaaauaugacucagauguuggaauuaucagacauguaauuuaaaacaauuaugaucaauaugugaaagacguugauggaagagguagacaacacauaagaaaauggaugucagcagaaagaugaaaagaaaugccaguaauacaaaacagacaaagaaaugaauaauuuuuuauugggcucauauguagauuugacauggcugaagaaucagugaccuugaggauaggugaaaggaaaugacccaaacugaaacacaaagaaaaaaaggauggaaaauaaaacagagcaggacaggaaauccaggaauguggaacaauacaaaauaguguaacacaggggucuccaaccuccaggccacagaccaguacugguccauggccuguuagaaacugggccacacagcaggaggugaguggcuggugagcaagcauuaccaccugagcucugccuccugucagaucacugguggcauuagauucucauaggaaugcaaaccguauuaugaacugcacauguguggaaucuagguugcaugcuccuuaugagaaucuaaugccugaugaccugagauggaacaguuucaucccgaaaccauccccucugcacugauccguggaaaaauuguuuuccaugaaauuggucccuggugccaaaaagguuggcaaccacuaguguaacauaugaaaauuggaauaccagaagaagaaacaagaaauauuuuuuaaaaucauggccaagaauauuccaauauuagucauagacaccaagccacugucuuaagaaucuuagaaaacaucaagcagaauuagaacaaaaaacaaaaacaaaccaacaacaaccaaaaguaacugagauauauccuguuuaaaccauagaaaauugaaaccaaagagaaaaucuugaauacaucugaaaagaaugaggacauucucuuuagagaaacaaggauuaaaacuacugcagacuucucaucagaaacugugcaacucuguaaucugagcuacucgggagacugagacaggagaauugcuugaacauaggagucggagguugcagugagcugagaucaugccccugcacuccagcuugggugacagagcaagacuccgucaaaaaaaaaaaagaaaagaaaaaagagacugugcaacuaagaaugcaguugacuguaaucuuuaaagaucugaagaaacaaauaaagaaaaaauacuggcaaguuagaauugcauauucaguaagaauaucccucaaaagucaaggauaaaauagaaacuaucucagauaaacagcugauggaauucauugccagcaggucugaagucuauaagaaauagcaaggaaauucuucaaacagaaggaaaauguuacaggucagaaauuuggaucuacauaaagaaaaaaaguacagcaaaaaagaauaacuagaagugaaauaaaauauuuuguuuuucuuacucauaauuuaucuaaaagauacuauccauuaaaagcaaaaauagugaugcuggcuuuggugauuagagcauguguucaagugaaaaacgaaaacagcaucccaagaaaugagaagggcauugacaaauacucuguugugagguacccgcacgacacauggagcaguaugguauuauucgaggguaaauuuagauuaguuuaagauguauacuaugaacccugggcacuaaacuauauauuaaaaaagaaguauaaauaauaagucaguagaggagauuaaauggaaucauguaaaauguucaguugaaacuagaagauucugaaaaagagggggaaaaaaccagaacaaauccaacaaccuuacaaagauggcaaccauuaaucugacuguauuaauuaucaguuauauaugacauuuaaaagacagacugucaaacuggaguuuuaaaaaugagacccaacuggcugggugcgguggcucacaccuguaaucccagcacuuugggaggccaaggccgacgaaucacgaagucaggagaucaagaccauccuagcuaacauggugaaaccccaucucuacuaaaaaugcaaaaaaauagcugagugugguggugggugccuguagucccagcuacuugggaggcagaagaauggcaugaacccgggagguggagcuugcaaugagccgagauccugccacugcaauccagcccgggugacagaaugagacuccaucucaaaaaaaaaaaaaaaaaaugagacccaacagaaugcuguuuauaagaaaccuacuuuaaauauaaagauacagauguguuaaaauuaaggaauggaaaaagauguacuaugcuaacacuaaucaaaauaaagcugaaguggcuguauuaauuugagaaaaagcugacuucagaacaacaaagauuaucauagauaaggaggcacacuggauaugaugaaggguucgauuaucuaagaagauacaacaguccuaaacaugugugcuccuaaccacaaagagucaaaacaugaggcaaaaacugauagaaaugaaagaagaagauacaaugguaguuagagauuuucaugcucauuugucaguaauugauagaucaagcagagagaaaaguagugaagauauaaaucauaaaaaaugaccugaauagcacuaucaaucaacuugaccuuauuaacauuaaaagaacauuucauucaacaacagcauaauauacauucuucucaggggcacgugaagcagucacaauauaggccauauucugggucacaaaaaaauccucaaaagauuaaaaacaguagagaaaauaaaaaguaugugaggcagacaacaaaauaauuaagacagaacuaaauaacagaaagauacagguuauuucucaaauauuuggaacuuagaaaaaaacccuucucaauaacccauggucaaagaauaaaucucaaggaaaacuuaagaauauuucaacuuaguguacaugaaaauauaauuuaaaauuugggagauguaguuaaagcaauguuuaaagggaaauuuauagcauuaaaugcauaucuuagaaaaaaugaaagauucaauauguauaaucuaaacuaccuuagggcacuagagaaauaacaaauuaaacaaaaggaaggaaauaacuacaauuagagaagaaaugaauaacauuauaaacgggaaaaauguagagaaaaacaacaaaaccaaaugucaguucuuugaaaagcaaacauaaaaauugaagaaaucaacacaauuaauaaaccucuagccaggcuaaccaggagauaaagacaacacaaauuaucaauaucaugaaagaaagacgggccaucacuccaaaugccugggacauuuuuuuuuuuuuuuuuuuuugaucauucuuggguguuucucgcagagggggauuuggcagggucauaggacaauaguggagggaaggucagcagauaaacaagugaacaaaggucucugguuuuccuaggcagaguguuugugucccuggguacuugagauuagggagugaugaugacucuuaacgagcaugcugccuucaagcaucuguuuaacaaagcacaucuugcaccgcccuuaauccauuuaacccugaguggacacagcacauguuucagagagcacaggguuggggguaaggucauagaucaacaggaucccaaggcagaagaauuuuucuuaguacagaacaaaaugaaaagucucccaugucuacuucuuucuacacagacacagcaaccauccaauuucucaaucuuuuccccaccuuucccccuuuucuauuccacaaaaccgccauugucaucauggccuguucucaaugagcuguuggguacaccucccagacgaggugguggccgggcagaggggcuccucacuucccaguagggguggccgggcagaggcgccccucaccucccggauggggcggcuggccaggcggggggcuggcccccccaccucccucccggacgggguggcuggccagguggggggcugacucccccaccucccucccggacaggguggcuggcugggcagaggggcuccucacuucccaguaggggcagccgggcagaggugccccucaccucccggacggggcggcuggccgggcagggggcugaccccccaccucccucccggacggggcggcuggccuggcgggggcugacccccaccucccucccggacaggguggcugccgggcggagaugcuccucacuucccagaugggguggcagccgggcggaggggcuccucacuucucagagggggcgguugccaggcagagggucuccucacuucucagacaggacggccgggcagagacgcuccucaccucccagacagggucguggccgggccgaggcgcuccucacauccuagacggggcagcagggcagaggcgcuccccacaucucagacgaugggcggccgggcagagacgcuucucacuuccuagauggaauggcggccgggaagaggcacuccucacuuccuaggugggauggcggccgggcagagacgcuccucacuuuccagacugggcagccaggcagaggggcuccucacaucccagacgaugggcggccaggcagagacgcuccucacuucccagaugggguagcggccgggcagaggcugcaaucucggcacuuuggggggccaaggcaggcggcugggagguggagguuguagcgagccgagaucacgccacugcacuccagccugggcaccauugagcacugaguuaacgagacuccgucugcaaucccggcaccucgggaggccgaggcuggcggaucacucacgguuaggagcuggagaccagcccggccaucacagcgaaaccccgucuccaccaaaaaaauacgaaaaccagucaggcguggcggcgcgcgccugcaaucgcaggcacucggcaggcugaggcaggagaaucaggcagggagguugcagugagccgagauggcagcagcacaguccagcuucggcucggcaugagagggagaccguggaaagagagggagagggagaccguggggagagggggaccguggggagagggggaccguggggagagggagagggagagggagagggagagcgagagcgagagcgagagcgagagcgagagcugccugggacauugaaaggagaauaagagaaugcugugagcaacucuguaccuguaaauccaguaacuuagaugaaauugaccagucccuugaaaauacaaaugacaaagcucacuggaggagcaagggauaaccugauugcucuacuucaaugaaaacagugguucucagucuuaucuaccuaaggaaucuggaaaacuugaaugaaaaacuguugaugccugggcccuucugcuggugaauuuugugugacuggucuagggugaggccugggugcuuggguuuugagaacuccuccccugauucugaugaccuaccaaaaggaucaugcugcagucuccgcauuccgauguccguugaacaaaaggauauuuuuccugcacuucagaaaacauucuccguagugcaucuuucaaaggcuaaaagacaugaagccuuccccgguucccgggacuggaacugacacugguuugauucccagucucagaaauguccaucaaucaauucucagcaacaacaaaaugcuuugcuaccaaacuaaaagggaaugcuuuucugaguuuguuugauuacagggucccacugccaaguggagaacaagguugggggaacccuaagaauaagcccccucuucagcacuucuuaaugcugcccuggggcagggccgccucuggagguuggagaaucaagugcucagucacuuggcggagauccucgggccggagagcagcguagugaugaaaacuugaagaggaggcucucugagcuguggcaguaucuuuaaaucuuuuauucaugucauuggugugcagcguggauguuaaaucaucuuugauuguucguacuuauggcacuuagaggagcacaggauggucccccucuaggacagaggaaggaggaagcuggugagcugugaguacggcucgcucuccggggcauccccugcaugcucagcccccuacuuccuuuuguaaaaauuaucugggaagaaaagaaaagaauuagcaaccgcugccaggaagcaggucgaaagcuuucuggcacugccagagccugcgugccguuaagucgacacucuucugaagggaguaccaggggagccccgcaaacuuggacgucugcagcaaaguacuccucugcagucagcagcccugacaccuuccauuaugcagcucugugcuccccauccugccagccacucugcuuauucauccucugauauauuuauugguguguggaccaucaacugagguggccucacuaagggcuuuauagcagagaaaaugaaaagauuuccaagugaagaaggucacuauuacugacuggaggaaagcguggcauggacccugagcagaauuuccacuucaagaaaggcaauaucaaugcauaaugauauacauuuguccucuaagugauggaccuugaaauuucuuuugcauuuucugcuccccacccaaucaaaacacauugugaguggcaguggggccagcagaacccuuggggaggggagucuggcugcagccaagcuggugguccccaggaagcacacaccccugcuccacccuuucccuucugccaaaugcaucgcgcuagggcucugucaccauuauccggaguugcauccuccaccugcccuugaucaucccagaacaggaagugaaggucagccuugcuuuccagucuccacgcuuugcagauugggugggagggaaagcaagcagguuuguaggcuuucuaaagccccccauauggauucuaagaucuagacccugaaaggcaggaagaugaugauuuugagggcauagugauccucaugagaaagacagccacagcuacucuguaucuguccacguuagccccaugcaaauggcuuuguuucaggcagaaugaaugcagagcuuggacaguggaggugaaugcucagcugagaggcuacagauagaacaugugagccagaaaggccggcucuggccugcuacacacaagccaugccaagggcaggcccaggagcccacacacuccucugugacagacguggacaugucggcuccccgcuuaugcugaaguggccucccaacagugaggcgagugugccucugggguucucagaugggucuugcugcugcccuuggggagacuuccucagcagugucuuaggauggaggaaaguccuagguggaaauucuugggcaagagaaucaaaacugacugcuuugacuucagggccuuucaaagaggcauggcaauuaaauaaacaauaugccaagaagaaauugagacaggaaaaagaggaaaggagggaggcagaggaggaggaaggaaacugacaggaagccaaaugaggaccacagagaaaggcacucacagccaccuaggcccacgcagcagacagcagcucuguugugucaagaccauacaaauaagccaaggaaaggaagcccaccacugccugugccacgccgugcuguaggaacacggagaauuggggcccuuccacauguuuauacaccacugaagcuucaaagcugaaagugauuuacaaagcuagccauggcuuacugccagcaaggagaaguaaauguaaugcagguuuugugaaaucauuuugcagcaccauugccagggaggguagaccagagugaggagcccaggcagcuuccggaacugagauauuaucagcugccgagauaacugcuuggagacaggcaaguggucaugugucucugccuccugcugccaaguggccuuucugcugccacucaggauauucuauacuuugaggucaugcacaagugccuggagucaggagcggaguccaagcccagcccugcauggaccaccugugugacugcacaggagaugcaucaucuauaaagugagagauucugcuggugguggugaagaaugccagaacucgauaagaaaaagacaaagaccugaauaguuaauucacaaaggcagauaugcaaaaaucaagaagcacagaguuggugcccaugaucguguaucaucaggggaguacaaaacgaaaaccuaacgagcugccucugcacacacucacaggagugguccguguuaaacaugcugagaccccuggggauugaccgggaccuagaggacugggacacucacccacugcugaugugagggugaaaugccccaaacacuguggaaaugaucugaaguuuccuuagaaacauaaacauguauuucccuccuucccaccuagauauuuucccaagagaaaugaacucagaaauguccacaaagagagauacacaggauuguucaugguaccuuauucaucagggccccaaacuggaaacaacccaggagagcagagaaacagccagagagucuaucucaagggucuuuugaauccagaaugguucaccaggcagguccaugugguggggugggccugagccccucugugucaaaggcagcagaaucccuuacguggcugcagcaacauccacacuccugagguccuggguccugggagccucaugcugcauccucagaacuugucagaccuucguccacugucgccuggcugcccuugggccaccccugcugggaacccugccucucugccauugccccucuacaagaacccugaguuauagaaugucccaucuagagggaaggugacucugaagcaguugguggugagacuaauaccgaacaaagaaaagugaaggcaaaugccuuaggagcaauaaagaacacucucuaaagaaaggaggacagcaggaucacaugaugauuugggucugaaagaugagcuggcuuggcugcugauggaaaugagggagaagaucuuuaacugaggcggucauagacacccuuggauugcccacagggcguguuguuauggagggcaaugacaggaaaucaacacugccccaaaagucccagcuggggagccucuacuuugugacauacaagggaaaccauggaaaucaaggaagaggcuguggccuagaaggcuucaaauugaagucuggggaaauuagagaacaggcucagaauguccugggagcugugggcccagacaagguuggaaaccguggccuggcaucuucccugcuguagaaguggaagaugaaauggugacuccugcggcgggcauugccaugcgucagggugagcuccggggcagguggaggcagcaaaggccucucaggaccgcggaagggccucaucagccaccacauccccaccugcgggcgcgacggccucaucaucuccuccagaaagcaacacugucagccacacaucaggaacugucagccucaaauucaacauuccucauucuugaaccaauuuaccaaaacuuuuuucuucauaaaaaggugagauuuuuauauuugggaucaggaggaccuuuuuaguuuaucagggcuacccugggaaggacuuccagagcagagcuuuaucacguaaaaucugcugaggcaucugagcauugaggaaucucuccuggaaacaaacauaucggaaaaauuucaaaaauucuucuugcugagaggaccuuucuugauuuauauauauauacacacacauauaugcauauauaauaaguauauacacuucuaugcagaaccauauucugugaagcuagcuuuauuuucaaagaguuguaauaaaauaagcuucuguggcuaguucuauacucuacuaucaccuggcuuuguuuuaaauaguagauuugcaguguuggugacuucugaaaccaaggacccaacauuuugauaagagcuuagauugcuuauaguuacaucaaccaagacucaaaaaugugagcaaagcaucacugcuguccagcuaggcaugucccuguagccucauccucugcuccuaacuucagaggguggcacagacuagaccagaacuagacucauucaucucccagaugucuuucuguggaagugggggcugugggcccagggcggugucaggagagggcagggaggaguuuggaagucagccuaucuuucuaguucugugaauucccugcugcguagauuucacacguaauuuacuuuuuauuuuauuuuauuuuauuauuuuauuugaaacagucucgcuccaggcuggagugcaguggugcgaucacaacucacugcaaacucugccccucagguucaagugauucuugugccucagccuccugaguagcugggauuacaggcacaugccaccaugccuggcugaauuuuguauuuucaguagagaugggguuucaccacguuggccaggcuggucucaaacuccugaccuuaggugaucagccugccucggccucccaaagugcugggauuacaggcaugagccaccacaucuggccagaguucacaccuaauuuaauaauaacaccagugaaaaaaagcaggcugccucauuucaaugagaguuuuucaagaccccuggucccaggaccauaggggucccuuuucuuguucuuugucaagaguccagguaacaagaugauaacguggcccugcugucgugagcggggaaacagcaggaagccuugcuucccuucaaguauuuagugccagcuggagggauaaagagaccuguaaauaauuguggcuuuacaaggaaacaagggaaggccaucggggcuuccagacacagggaugacaagcuguuuuccucccuucuggaauaaauucgcgagaagcugaaacagaacuugaaaugaacuuauuuuaugaaggcucuggaggguacugccauagauuaugugaaguuuguuuuuuuuuuuuuuucguuuuggucaauaaaguuaccacaggcuuucauaucacagaauaaccuuucccauaguuuccagugguucuuugugcucuguucuagaccuccucccccgaggaaaaucagaggcgaugggcagaccgugucgaaucugaacaugacguggcuugcugcagcaagcuuacugccaugcuaaacacuuagugaggaagcaugccuggaaacugucccucuggucagagugccuccagacccagaauguccuggccgcaaucauucaggcacauguuacuguccugaguacagacguaggaucugagcccucgcuggcugcagagccaccacugcccaccucucuggcacgugccuuccucccugacaccacccagcccgaaggcccacaguggagugcgugaugccccugcugugccccuccugguuuauccgugccuggcagagucccagcacccagcacgggagcagguguaggggaggcucagaaauaaacauggaucaauauuaacugguaacguucacgggggggaauguuccaaagaaccuuguugaaacccucuaaguugguccccuuuugauucuaguugaucacccuggaagaaauggcagcauucaauuccuccauccuuuuuuccaguucgcaagggcugguucccuggaccagcagcaucagggucaucugggaacguuuuaggaucgugaagucucgucagcucccaagaccugcugacucggaagcucuggggacggggcuggcagucugggugugaaugcccucugagguugcuguggagacuccugagguaacacaugcugaagucagccuguccuaauggaccaggcucuugguuaggagccccagcaccuaggggaggccgugguucaggguuguuggggugugggcacagcacgugacacccgcaccagccgcucucaccuuuucacuccugcccucccaggucaccugcauccgccaaacucugccugggguucccuucguuaucagcagagcacauagacacaugucuggauuuguuuauucauugucuuuucaaauauaguguacucaacuuggaaaacagaaggaggaggaagagaauggagaaagaaagcaugaaaacugaaccucuccuccaugccccuuucucaaagccccuccuccagggggaccccgucuuucugugccuuuaucaaugugugugugggcaguuuugauuuacacguagaagaccaucaaagugcaaugcagcuugcuuuuucacauaauguaaauacuucugguaucugcauauaaacaccagcauugacauuuuuaaugauuuuguagcauuuugauguaugaauugcaauaauuucauuacaguaauguuuucccuaaaaauggacauaucaauuguuuucaacuucuccuuuugcaaauauaggauauccacaagugaaauuccaccaagucaaagguuauucacauguaaauuuagcuacauacuguaacuucuccuccagaaguccguaccaguuuucauuccuauuaacaaaaugugaaugccugucuuucccaccugagcucaguguuccauuuucaacaaucugauagauaaaauaaaagauauugucaguuucaguuuguguuucauugguuacuauaaagcugaacaucuuuauguguguuauuuuuuuuccugcuuuuauuucccguauaaauuucuaguucuacauuuaccauuuuguauuggguguucacauuuuauuaauuuguagaccuuauuuuucugacacaguuuuuagucugcuguucaugagcuuuacugcaaacauguccuccugccagacuuggcugucaguggugccucuugcuguagaaaggaguccuggaguaucuucagugguugcuggagggaagcuuccagggcacuacaguccaguucuuuacagcugcugagcauugguugugcggugucucacagugacucagcagaagacagagccugcacuagugucucccaggcaucaucggauccugcagcucccacacggcagccccaggagcagccuggcagugugacucagcagcuuuccuugccuguucugagggggcgcagcuggggacagcacgggcuucugcccacuccucacccugccagcgggaagccuccaagacuugggaaggaaaggcagugaagaccucacuugucuccugcugggccgugggcccaggugcuggcuucacgguggugacucaugaacacacgaagaauugggugugcagaggaggagaaaccaugcagugaagagccccaucguccugucacaaaauccacugcuaacuuuuuauuucuacaccuaucuccucaugcuucacagaaccucugaccaaagcagcuuccucuuaucauucacagauuuuauaacuuucugccuuuccgaacgcgcucuucauuccuggucaucuugcauaauuucccgcccgugauucuaaagaagagaaccuauugcuaugauaaaagcucacugcagauucagggacauugcaccuuaucccagcggacaccaagggucucugugcugguugggucuugccuccaguucucaucuuucuuauuaaauacuuaaguuucuaaacuggagacuuuucuugaugaggaggccgacuaaaggaguaccuuuuuauaagcuuuuuuuacaauuacauucacaucacaaaacacguaguuuuguaacagugcaguuauucacacaugccucuuguuuuucagagcacccuuuucuccccuucuguguugaggguggaucucacggccacacaguuaaccuauguuaaccaccucgacugcccuuccaguuuccuccacacucagccauuugcauaugcacacacaucuagcacccggucaccaugccaucuaccacuguggggacccucucaccaguuuauucucaugagaguaaacacacuuucuguaucucaauguuuucacugacaauacuuuccaauauucuggaaauuuuguaguuauugucuuuagcauucaugaaauaccugcauaacaaugacugucguugacccagcugucuuuccaacacugcuuguucacuguugucuggacuuugggggggcucuaugaacaauguuccaaucaaauguaguuuuuggugaaaguuuauauccauauuugccgguauaugagacugggcugcaaauaggguacuucaauuuucaugagaaagcuuaacuucuuuucaucaugcauaaguuggaagugauuuucaucuauuauugaagcugcgucauuguuugggguaaauacccaagguucauugucucgugccaagggaauagaggaaauggacauacaagaaguguauuuaagaguggagguuuaauaggcaaaagaaagagaaaagagaacagcucucucuccugcagagagagaggggcaccugagugggucuucuaguccauggcaaaguacaugggguuuuauagacuggcuugaggaggcagugucugauuuacauagggcccaaagauugguuggaccaggugugccauuuacauagcacacaaagaagcuggccaccucucccuaauguuuuacuaugcagauggggucucuaccuggccagugccauguugucugcuccuuacugugcacgugguugacaaggaaaggagaugauggagugccauguugaaccugccuggccaccauguagccuuuuccuauuggcacagcugcuggcauucacccaugcaagcuuccagcuuaucuaugucugcagcucaauuuuacaggcugcucuuuguuagaaaagaagugauuugggggcugcuuuucauuaaaaggaaaaucuuaccaaggacucucuuacccucgcuaucugccuaaauaauuucuuuuuaacugcuauaucauuauuauaagauaaaaucuauauugaucaugucaacagaccuagguucugccuggggcgcaguaggaaaucacaaguugcaauugaggccuugcauaccauccaagaggcuccugagaauuuuccccugcacaugggaagucauugcuugaccuuuucccugugggggauccugcaaggcaguucccugcagccacgggcagggcccggggagggcaggcugcugcagccucagcagcccacccuuccagcagcugaggaggguacauuggcugggaagaggggucuugguacagcuccuacagaaucccacauggaacuacaugcagcauagaugccaaauacauagugaacagaggagugaacagcgagcaagaaacccagcacucuguggugugucucauaugguaauuacaagccacaugguaauuuacgauuccuucccuucagagcuacauuuucuucaagucccuuccacguccccucccuccacucuaacagccucuucccugugaaaagcaguggcauuggagagacagaaagaauaggcccauaaagacaacccucucauucagagacaucagcccucagaggucccaccuagccacuggaucuucuucaugaagccucuugcucaccuagaaaaccccagcaaaaugugggcucuccagacuucugccacagagaagacccuucuaaaaugcugauauuccuagaugugauacagaucaagucacuaaaguccuaaauuucaaaucaaggaaggaagggggaaggugaugccagaaacagaacaggcaaagagcagagcaggugcucugccagcaggcaccagucaaagguccagcaguaaaagguguacaggugucaccaagagccucagucaccacagcagggcagaggcagugggcugcacccaccuaguuggcugguguagaccacccuggcucccuucgagucuccccagccccagaacaccccucaacuaucuguagacuccucuguguagucaagacuucuuggcagaaauccagggcuauccuagaagcaucuuagaaacugcugcgaccuggagggguuaaaugccuugaccaaggccacagcuaguuaauggccaagcugggacuaacauccagucauccaguguccgagagaguguucccuccaaacacugcaucauuuagccucacgcaguccuaaaaaguggaggugaaugaguugcccaagugaagcgggcacggcucaccucucagucacagaggaaaagcagccagcucaaagcugcacugucaacucauaccaaagcuggucaccccagugacagugcagggcugagaaggacagaaaaaccaagauggaugcugcaggugcaaaaucggauuuuuuaaaaaagggaauauaacugacaaguuugcauauauauauuaagaacagcaaugugguauaagguaaaaauagaaauuguuuuauuuauuauuuauuuggagacugucuccagagggucucacucugucacccaggcuagagugcagcggcaccaucaggacucacugcauccuccaccuccugagcucaagcgauucucccaucucagccccuucccgagacgcugggacuacaaacauguaccaccaugcccggugaauuuuuuguauuuuuuuuaaauagagacuggguuucacaacguugccuaggcuggucucaaacuccuggacucaagaaauacccccacuuugaccucccaacgggcugggauuacaugaaccaccacacucagccuggaauuuguauguuuuuaaaugucauuggaugaauaucugugaaugugauugcuacugaaaacaaacaaaaaaaggaauggccauugucaagauaaauggcauauuaaauguggaagcagaggcucgggcucugauuugaaagucugugcaugacucagcuugggcuugugauggcuucugauuccaggcucagagagugagcacacugcacuguuuaagaaauaaacacagggguagcccaggggugccaaaggucauaggccaggcacgcaggacuugugcugagauggcaaccuggacuggaagacaaccugcugggccucccugccagcguggugggugcagcugacaucagcagcaggugucugacaugggggcccaggaagcagagcugaggaggugcugucccaacggcaagacccacaaaggccacacacauuauuauaauacaaagcacugugugcagccuaaaauguggagacaggaggggugcacacagaggguaugaaaugcucccagagugagguaagacgcaggcagggagaacgugacaggcucaggggaggguugucagauggcgaacaaggaaagcacaucucagcagaggcaugaaccaggugcaugugcccacuggcuccagugcuacugggggcuucguaugugacagugaugaugaaggcuuaucagccugcagagacagcagucccugccacugcauaucagagcccagugaggacaguagggucaaggcauauuccccacacacgaaggcuuucacagcagcuccccagaauucuaaaaggcaucucggcaucuccggggaugggagacagccugcugucccugcccuucagcucccuagugugagugauggggacacugccaccacccuagcugcucacacuuggagaaauaaauugaguugucggcgugauguugaccaggacagaauggcauccugcgguaucaaugugguuuauuuguuguuguuaacauuaauacaauugaaauuuuggacauugugauaaacuaugaaaaaacagggugaaaacaucagaagcaauuacacucaagaguuuagccugauucuuuccaguccuguuuucuaaacauuauucucuauauagguaagauuaaauuuuaaagucugccuuuuuguaaucaauaccaugagcauuuuccauguaauuagcacugccuuauaagcauaauugucugugauuaccagauaucucaccauauggacacaacaugauuauuuaacuauucacaaauaaauuuuaaggcauuuagauugccccccaaauuuucauucuaguaaauaacacuacauauuuuuucaguuuugugcuuaaaucuuuauucuuguuucuuaagaaauaagcucuucuggccaggugcaauggcucaugccuguaauuccagcacuuuggaaggccaaggugggcagaucacuugaggucaggaguucgagacuagccuggucaacaugguaaaaccccaucucuacaaaaaacacaaaaaauagcugggggucauggggagugccuauaaucccagcuacucaggagguuguggcaggagaaucugggaggcagaguuugcagagagccaagaucaugccacuggcagccugggugacagugagaaaaaaaagaaggaaagaaagagagaaagagagagacauugagagcgagagagagagagagaggaagggaggaagggagggagaaaaagaaaagaaagugagagagggagaaaaaaggaagaaggaaggagggaaggaaaugaaggaagaagggagggagggaaagaaggaaggaaggaaggaaggaaggaaggaaggaaggaaggaaggaaggaaggaaggagcuuuucuucaaauaauuaaagcguuagauuucaugguuaucuaguggccccagugugggaagaccuuguaaacaaauguguuuuguuuuacuauguaauuguuuuucuaugaaauugacuggaaggaggagauuucagaugagaacaauaggacuaauaugucacccauaauacagcaaaacuuguggaagcucacuggacacaaaaacacaggaguccuaggggugcuucugcagguagcaugggauggauccacacaucucuagaggcaccaaacuagcaacccgauagcauuucacaggcacaaaacagccaccacccacgugucagggagauggcgcacauggagggcgcaugggcaggugccugccagccugcaugcacacaacuguucacuccaaaguguccauucauuuugguugcuaagaauugcucuucguccccgguggguguuuaaaaagaaagaucugcccuuccuguccuagcucuuacaaucuuaaaccuccucauuuguucccaggaacuuuugcuuagagaaugauauugaugacaguaguuucuauucaugagcacuuacuacaauccaagaguuagaagcuguuacucacuagcuaugugaucuuggauaaaguucaccuuccugaaccuuaauuccucauuuuuaaaguagcauuaaugguuucacacgcagacauguuuaggagaacuuacuaugaaauacauuuuggaaaaagaugaugauggauggauggauugauggauggauggauggauggauggagaguuggguagauacauaaauauagcaaaaugauaaugguacaccaaaguggugaguauaugaguguugacuguaguuucuuuuaacuuuucccuauguuaacauaaaacauugcugaggaaaacaguauugauaaugguaccuacuacaugguguugugcaauggaagaaaugagaugaggcaaguaaaguguuguccguaugguguuugacauaaagcuguaagucaguguguuauuguuguuaguauuugucgcaaccagcaaaauagguauuauaacucuauuuuagggagaaaaauaaaacuagauacucagauaaaauaguaacaggacguaaacuaguuaacauacgugcuagacuugagcugggccggccuauaccaaagcugugcccugcccaccucgccaccaggcagccaaggauggagcacggagugugcagcagggugugcagacucacagcuccuggucucucaccuugucccaugccacgcccugauguuuuuaaagucaacuuuuuauuuuagaaugguuuuagguugacaaaaaauuuacuaagacaguacacagaguucccauguaucccuuaacugguuucuccuuucccuaacaucuuauggugugacacauuugucacaauuaaugagccacugcuaacacauuaucagaaacuacacuccauggacuauguaggcucuaugguuaaacaaaaaacaaaaagaaccauaguccauaauagauuccuucaagauuuaccuaauguccuuuuucuguuccaaggucccauccaagaaaccauauggcauuuaguaguugugccuccuuaaguuccucuuggcugugacaguuucucaaauaaguuuccuuguuuuugauggccuugacaauuuugcagagcacugaucggguacaucgugggaggccccacuguugagauuggucugaugucuuuauuagacugagguuauagacuuggggucacaucaggggcaccugcuaucaguguggcuuguugcuguugaugucaagcuugcaccuggagagagagggauugucagggccuccacagcagagucacucuuucccccuucccaugcuguacucugucauaggaagucaccgcacagcccacacucgaaggguaggguggaaaauacuuuaucaccuuaagggcagagcacuuagauaaauguuuuggaacuugucugugugggagauuugucuacccuccuccauuaauugguucauccauuuauuuaugucaguauggacccuuggauauuuauguuauacuuuggugucuaauccaaaacuacauaauuuauuugcugcuuugacccuugggagcucuuucagauugguuucuguguccacuugacauccuuuuguuuuuugaagcacuuucuuacauuuuugcaccgcaagaugcugcuucagguucaucuuguaugcuuccuguccacgucccagaaucagcuauuuuccuauggagcccugguucuuucauuagagaauaggguucgaaaccaagaucugggcacugggugugcuuguggcuucuggggugucauugauucuaggcucucucagugacaaagcuaggaaauaaauguauguauccucaugccauuacuguuagguuaguugcauuuuaauggcaaaaacugcaauuacuuuugcacgaauguaauuaguucuauauagagaguauuucuacuuguuuaaauauguagaaauauuucuauaugcauaauuauuuauguacauauauauauauccaucuguaucuguauuaagcuaaaugugaguucauacuggugccuccaacucuaacucauugucacacaucacugcagccuucuucccuuacuucucuguaaccuccuacuccaacaaugagaaaccuggcuccaaccauccacuauccacuuacuuaauuguucauuuccaguauaaguguauagugucagaacugucaaccuguaucuucaugagaaguaacuuuaucagcuagagugccguguucaugagaaguaacuuuaucagcuagagugccauguucaugagcaguaacuuuaucagcuagagugccguguucaugagaaguaacuuuaucagcuagagugccguguucaugagaaguaacuuuaucagcuagagugccguguucaugagaaguaacuuuaucagcuagagugcugugcuuauguguaguucuuucugccauuaguccugcagucuccacucguuuccaggguuacuuuggucaacacccuccucacccccuucagugagguuguuucauaaauuuguaauacaguuagauuaauccaucauaaucugcauucccuccuggcauccccugacuuccuaaucaauuuuuuaaauuugaauacaauaagauuuugucuuuguguuguaaaguucuguguguuuugacaaaugcgcagugccacauauuuaccaugacagugucauacagaauaguuucagagaugcucuaagaagaaauacagcuuuguggaaagagccuuuaaauaugugauuuccaaccacuuaugugaugcugaguucuccuucuugccccauaacuuggccccagauuucucaauagaaaaacagacacaucaucaaaaagagaaaacugagccuuagcaauaauuagcuugcagcuucauauauuuugaaaugcaagaaguagacuuucuaugccaaagaagaaaaagagaaucaucuagacuagcuacacgcaaacacccacacuuuauucccagggaacuugggagaaaaaucaauggauuccaggauaugacagcuuccaaacacacuuugauuuaggugcaugauuaugagcaaauuggucugcucuauggagucuccaugugcucauccaugaagcaaggcuguugugaaucuucagcccucuauugcugacauagaugaugaggcagagguuaauuaaaaugacaguuaaaacauuauguucacugugguaaauuuuaccucccaaagauggccacagcauuuccuagcacacaugcucuucugcaauguggccuugccccuucuccauuaaggcauauaauuucauucaccucuugacuuagugcuuugcauagcacugggaugcacuuagugccuugcuuguuacaguggagugcaggaagagggcucugugugaccucagaagccaggaaucauugaggccuuguugcuucugccucacucacugggacacuugcucuuggaguccugagcugcaauguaagaaaucuuccucccugagaccuccaugcuguggggaagcccaagucacauggaaaggccacuuguagguguucuggucaacaggcuuagucucuuaguuaucucagcccaggaaccagcuaucugagagaaguuacauuggaccuccagaacagcccauucuccagcugagugcucccugaauucuugacuccagaauucauaagcacccaguggugguugucuuaagccacugggguacuuagccacagaacaauagaucaccagaacacucacuacuguguccuagguacuguucugaagacugguguauauuaacacccuaguacuuucaaagaccccaugacacaguaacucauuaucuucagcuuacagaugaggaaauugaagcacagagaaggaaacuuguagaaagucacacuacagugaagcaauggguuugaaaccggucagucugacccuggaaaaaugcucuuacauuagcaaaaaugcuugagaggcaguuugggaaggaacuguuagagaaauuaaaguuaccaagcgugccuccugggauccaucugcagccaaaugaaugauguggcggugcacugcucucuccugguggugaagugagccuccuguuggaaugaggaagccaaacuguccuuaaggaucuugccacauuccaggcaaaacacccauguuaauuacuuuuuucauaauuauuucaaugggaagcaucugcacccaguugggccuagauaaucugaguaggaacacagcucguuuacccacaacucgagaugagcagaccaaauagcugguuuuccaaccauuagacgagagcccacgcugccggauaggaugcugauggcugcauuggugccacagcuguggcuguggcucucacugaaacagcucagcaaggaaaacuggcacagggcuccagagaaaagagggagagaggacaacggagagugaaagagggaagugaggggggaagacugccucggugugugcagugagcucucagcuuugagcccucugggcgaauccacugucuggaccagcagaugauccugcuguccccucaccucaccagcugcaggucugcacccaggcuauaccugggcugagagaggcggaggcugggcuagggggagacucauacuaccaguauauguggcuaccaucugauuaaucuuguauucacaggcugaaaaugcucagcaaaucauuugauaucaucucaacaguccuaggaaccaaaauauucaaaucuugguucucuccucccuaacacagugggcucuagagagaacaccuggugcuggccagcuacaacaaugguuugcaggagucaaggcacccuucucgccuggauagaagccaagcuugugcuucccgugggaaugugaucauguaaccuugucccacacagagccaccuccauccaccuggagagaggagagcuggagcaugcacuugcccaggaagcccccaguucacaucugagccccucuucagucagauuuuaugucaggguagagaccugcccuuucaaguccagcaucucauuuugaagccccacaugcagcucugaggaaaccaugcauguuccuccaaugccuagaggacuguggacagaccagggaacaugcacacauuacaguaagcaacacugccuauacacaucagugauuucccagugacugcuccagggggcuaggcgacugcuauggcuuagguguuugucaccuccaaaccucauguuaaaauuugaucuccaguguggcaauauugggagauggggccugguggaaagccuuugggucaagggggcagaucucucacgaguagaugaauuccgucccuugggugugagggagcucugucucuauuagcuccuucgacagcugccuguuagaaagagccuggcacaccccacuuccucucucaccacaugaucucugugcaugcauaccgcuuucaagucucuccuucuacuuuuugcagugagucgaagcagcccgagguccucaccauaugcagaugcucaguauuuuuuuuuuuuugagauccacucucacucugucaccgaggcuggaguacaguggcgugaugucggcucucuacaauguccgccuccugaguucaagugauucuccugccucagccuccugaguagcugggacuacaggugugcaccaacacucccagcuaauuuuugcauguuuaguagaguggaguuucaccauguuggccaggcuggucucgaacuucugaccucaggugauccacccaccucagccucccagagugcugagauuacaggcaugagccaccaagcccggcugaugcucagucuugaauuuuccagccuacauaguuaugagccaaauaaaccuguuuucuugauaaacuauucagccucagguauucugugauagcaacacaaaaugggcuaagacagcgacccucacguagucuuuugaaucuuuuucucucgaguucaauacaagagaauuuccugucuuuccuuuggaauucauuccaaacaagcacauucuuguuagcuugcaccugacagucagcacuucauuagaaggucuaaguaaagaagucaauauagauauacuuuuaauuuugcaucuugcucccaaccagggaaccgagggaacuaaacaguggagaaccauaugaacacacaggcagggcaggguacauggcagcacuuucucaguggcuugaaaccuguuucccuggagcugacacagggcagugcaugcggcagaaucgggggaaucugcuuuggguacauaugccaucaagucacgcuucagaggcaaguuucuucucaguaggaaaaggaaaugugguauuauacgaacauccucuuugagccaaacacuuucuuugggaaggggaaugguggauaucccaaagugcggcacaggggaugggggcucacaggcauccauggaaaaggagaggcacuugucaauuucguguggaaauaucaggauagcccugaaacagcagcuuucaaggaaccagauggagcaggugacaccaugacacauuucagagaauaaucccaguuaagaaggcccagcaagcuggaaccuguuuuccaaaggaaagugcccuuuuucauuugagauaaaaagcucaggaaauggguggauuuuuuuuccagcaacuagauacacgcaagggaguauugugaaaaguuggggacagacugagcagcacaucagucagacugagcugcugucacaaguuacuguggacuaggugguuuaagcaguggccaucuguuucucacaauucuagaggcugggcaucugagaucaggguacuagcacggucagguucuggggagggcucucuuccaggcugcagauggccaccuucucccuguguccucacuaguuugcagagagagaacuccugugucuucuguucuuagaaggguacucaucccauccugaggguuucagccucaugaccucauccaaacccagucaccucccaauggcuccaccuucuaauaccaucucauuggaauuagggcuucaauauaugaaguugggggguggggugguacacauacaugcaguccauagcaguuuggcucgcagacaugccucugggcaaugaagaagcaaacucagcuucacugaagccccucucuugaagugggcacuuuuccuuuuaagacaggagguuuguggagguuuaugaucugcugccauugcccugcaggguguguccuggugucaccaaggaucugaggacauacaaagcauguggcaccuucccaguguguccacucugacuacugaaucuucauuucacuugacuauagaguaaguucugaggccugacuuccuuugucucacuguaucaucacacauuucggguuaguucaggccaggaauucuugcagcaggcaaauaaaaaucugaaggaguggaacuaggagugcacaccccugguuuccaguguccagucugaaagcagggagguuccccagggagaggccagcagggccagcagggagcccagcaccagacugacaagggcugccucccugcuucagaggcaaacaguuuuuggaaguugcuaagcaacccaucuucuuagaaggagccaaguguuagaaacgagugcccaagccaagugcagcaacacagaggccaagccacagcagccagauuccauuucagcagucagcauugggaugcuaacagcugguggaggccggcgucugcagaggacacuauugcuauauucauguuaccagcaugcugcuugaauuucuguuggaaaagguacugauucuuauuauucaguuauaucuuggauauauccuucauucaugucauccaggugcaaggugcgauguuaaguguugaaaaaaggugagcaaaaaggugaccuaugcucccuuggggauuauggucuaguggggaaaugaacauucacuuaguaagugucaugaaugcaaaguucugugaaagcauggugcagggaagcaugaccugaaccaggggccaaggaagccucccccagggacuggaugcuugugugagaucaggagacauccuguugaggagaugggcagggugcccuacagcugaaggggagccaccuggaaguaacaguucugcuuuggguggacacucagcugaccaucguuuuuauguuuacuccccucauucaguuuauaauuuucuuuggugguuccauugagaucuaagauuuucuuuccccugcuggaaaucuaugagcucuaguuuaugaaauugucaucauccuuagcaacgaucuuuguguuuuauuggguuugagugcuggauccauuuauaguuuaacuucucagcggggcucuugcacacguguaucuauaaacucagggcccauaccuauaguuagccugacuugaggucucgauugcucacuuacaguccaggacagacacaaagcuuacucgcugguuuauuaauaugggguggagacuggggaauuucuaguccucucucauggaaagaacucuuugaggcuaugggauuuaugcaugaguucuccccugaccaaacaccacguccugucuccccucaaagcauuagaaacucagccacacacccccaguccuguuuccugaaagugaauuacccauggacuacaugguuucugugccuucucagugaaaggggucacccaugucaucccaguuggccaucuugcuggaaugaaagaccuaucauauuucacagauaaacaccagugacaguaccaaauguaaaagacuuuauuuaaaacaggaaaauauuaaaauagaaaaugcaaauaaaacuaauucaaaugcaggaagccauugcucccuauggcauacacucaucuuuaauacauuuugugcaacaaacagauggaucgcaugggcaugggagggccaagaaacacagcucuccugugucagccaggcccugggucacaguuaccuacuaacccaaaauagggguagcaugcaggcagcagggcacugggugugguucagaaagcaaguuccacucugugagugugcgucuguugcuuacacuuucucagucuucguugucuuaucuauaacgugucauccugaccaguccccaaggcuguugugaaagcaaacucauaaagagugaaccagcuagaaagcagcguuuguacaaaugcugugucugccuuccaggaggcaccacguuuauaaacagaaaucugcaaguuugccagcugcgcuagaaauaaauggcccauccaguuugugcugagcccuccaaccauagugagcuguccauccucaguccacauggcacguaucugccugugugcucccacgcagucaucacguacguagucagcaccauggagccaaaugaaacaaaugguuugcagaaacauuuccauucuuuuuuuuucacuugaauuaaaaaagauucaaccuuguauguuguacaaauucuccaugugagaaaaacgucccucucuguaccuuaagcacugggucucagaauucagagcaccagcccagccucccagcuaggacagcguuccagcgugcucuugccagcuguaaugguucugcaguaugcguggaaauggacuguuugaucgugugaaaacaaauguguguuucuugaaaaugcaauguaucuuguacuucuuacagcucacuucuggcucccaagggcucccaaggaccacgcaaugacucuuauuucuuguuucuuucuuuuuuuuuuuugagacagagccucacucuguagcccaggcuggaguguaguggugcgaucucggcucacugcaacccccgccuccagggcucaagcaauucuccugagugagcuucccaaguagcugggauuacaggugcgcaccaccaugucuggcuaguuuuuuuguauuuucaguagagauggaguuucaccauguugcccuggguagucucgaacuccugagcucaggcaauccaucugccucugccuccuuauauucauauguguauuuguuuuuaucauguuuccuuaucacuucagcuuguuuguguuugcucacauguguuuacucuuaaggccaacacucuugaauuuaucuauuuugcuucccugcaaagaggcugacuguaagcauagauccuuaccagggccauuccccaaauaucaucuuagaaccauggccacagacugcauucagugcugauaaaggccacaagaaugucacaaauguaucucuuggucauaaaggggaugaugcaagagauuguggguuaaucacuauaaacuuccccaccaagagccuauccaaauuuccuaaaguugaagucaguccugcuacagaaggaguggcaaaggcagagaaacgaccacacaugagccaaguuugugauugaaucaguaaagcacacauuggaguuguuuucacguauauuuaaaacaaggaaauuuacucagcugugcagauuagaagucuaauacaaaaugagcuaaggacgcuuccucuccugggccaccaggugaaaggggcgucacuggaggagaguggcugucacugcaguacacuaaaggugaccacgcauuucuugaccugcuuccugcauccuuuccccuugaaucugggcuggccccacugagccacucguaaccaguaggacacagcagaagugauguucugagucuccuguggcugauaaccaggagaaacuugcagcuucccccugcaacacucacccagagcccugagcugccacacaggaaguucagcuagcagugaccaccgugcuggagaggccaaggcaccaggugugaguggagccaucucaggcaccccagggcaguccagacaccagugaccccacaucaggugacccuguuaaugccauauggaguagaaaagucucccagcuggucugaucugaauuccugacccacaaauuaugagacagaaaaaaaugguuguuguucaagccaccaggcuuuggaaccauuuguuaccagcaguagauaauuagaagagucacugcuccccacagaggggucaucuuugcagaaugaugcaugagcacucggguugcauccaggaaaugggauugacgggaaagccagacagaggcguugaaagggaagcauuaacaagcugaggcuccccccagcaagugagaugcaaggugaggccaaagacacgccugucccuagucucugcucaaaauucucuuccuccuggaaccuccuaauuuuguuuucagcuaccaggauucaccccuuaucccaggcugccuuaccgaggaacguucacaaaacuuauaugagcuccuccaccauaaccuacaagucagaagggccaucagaagaggcuucugccuguccuacgcugggcucugguccagcccucggccugcucaugguuggcugugacuccaguaaguuuaacaguuuccaagugaccaaaugugauucuucauucagccgacugugauauaggaaaauggaaacaugacaaagcaauuguuugagacacagcagaugacaccagugcugcacccguauucccuuggcacucauggcucuaacugcaaauaccugcccugacucuguuggaggcuuucuccacucacagcggggugcccagccaugugcaggggagggccagaaauguggggaggugaacacacgggagcagcccucaagcagugguggaggagacuggggcuacauaauccagacuccuugcuccuggaggggagccccugggaauacucuuccagaugucugcaguggggcugacacagccacccccugcucauuaacccgcccugcaacagcuccucugccucccuaucucaccucucuaccuucuuaauggcacuucugggaucaccuccaaggaagcugcuugucucccuacccuugucucagagucaccucuggaccccgccuaagcuggaaagacauuaaguaaaaagggaucaguuucuaguggcacuugaacauguguguuaugucaccuccuucauaaaaucuuuauuuaaguuaugguaaaagaauaagaugugaaaccaugaaggaaaagagaauggacguggagcaacaagaaacagagaugucagcacguuuuggaagaugaaagcgcacggaggaguggugaucaugcaguguggcugagucugcaagcccccaugacaacagcagcaggaaucagccaguccacuccaccaccaccgugaggaggcagggcugggagcuccaggugugaggcaagacauggcgaagacauccaccugaaagcagugcauuucuaaguuguaaucgguaaagcacccaguccugugucccaucuucagggcuuaguggcagacguuucuuaaucccagcaggagaccagucagaaugccuccagccuuggugacucagggcacagugaggagugagagcagaccaaaguccacagcauggugagcagcagggcccggccccucuaaugcccaggccccagugcuccuuagccccccuggcucuuaccccaaggcaggaaguuaggggauuuaucccuggagaaacugaaugucucuauguuagucuucuagggcugccauaacaaaaugccagacugagugacuaaacaacggaaauuuaacucugucagcucuggaggcuggaagccugagguuggcagggcuggauucuccugaggccacucuccuucauguggccgccuucuugcugcgacuucacggggucaucccucgguguggucugugucccugucaucucuuccuguaaggacaccacucaugucagauuagggcccauccuaacaaugccauuuaaacuuacucaccucuuuaaaggcccuaucuucaaauacagucacauucugagguacugggggccaggauuucaccguauaauuuugggggaacaaaauucagccuauaauaguccucagagaaaagaccaauguacaauguaugcuguuguacagaagcuaaagaaaucugaaagacagcuugcagccuaaucaauacuauggaaaaucucaccaguuaaucagugccauauaugcagagcaucugauuggccuguuggugaucuuuaauguuaaauaacagccagugauuuccugacacuugagagcgccucuaccauggaaaaaaaaaaaugaaaccugaacaaaugggugagggucaggggaaggauucugauugauagagagacaaagcaggaaguagaaagugucuuucaaaaaaucuauagaguuaauauuuucagagagauaaggaaugaaaucaacuuccugaaaucaaaaaggaaaguuguguaaaagcaaaagugagagaacaaaaagaguaaacaaaaggaaauuaaggaauaugauagccaaauacuaucccauagaaggcuuggagaacgauugaggaaaugauccauaaagugcaacaaaaggagagagguggacaaugacaaaagcaagcaagagaaaggaagacagagagaaagaaaggagagaaggaagagagggagggaggaaggagagagggagggagggaggaaggaaggaaggaaggaaggaaggaaggaaggaaggaaggaaggaagaguuagagaauucacugaacaucaaagcccuucaaaucaacauuuuagaacacccagguggcaggggacuccaccagagcuuccagagagaaggagcagcugcagcagugaagggguauaaagaugaugcuagaccuguugacagaauuggaagugagaagaguauggggcaaggcuuucagaaguccaaggaaaaaaaucauuuccaaaguggaauucuauacuuuucccaacugucagucaaacauggcaauagaauauggccauuugcaggcacgcagagucugccacccacgcaugauguuccgaagccuuccgcgguguguguugcagggacaagcuuuccugagacaaggccuggggucuaggaaacaaaaacuguaacgucaaagggaagcaaaacaaauuuccaaagugaggcaucaaagagcaaucagcuucaauuggagcagaacaccaggagugugaacgccaggaggaaauaagaaggaauuaauagauuaucugauauguuugauuauagccugaaaaaauguauugagaggguauuaaugggugugguaaaaacuauagcaacugaagccagaagaaaagaggcauaaaccagugcacuuggcuuagcagugaacacaaaguacguagucaaaauaaugaccauauuaggggaugaaggaagggagaggugacaaaguggguagggacagagguuuccaagaaagcgaacucuucauccaccacaauagucggucagugauagguaguugacaaauugauaaaucaagaaauuaaauauguuuaacuccuuaagaaagaaguaaauaccagauggauccacuaacaaaguucaaaaugugccuuugggaaagagccucagagguagagaaguauccaaagacauugcugcugguguuuuacuuuauacuauacaccuuuuggugucauguauuuuaccaaacacugugaacauauuccuuugaugauaaaaacuauuuuagaaacuaaauauauacauacacuuaucagcaauucuacuccuagcuauaugaccuagcagaaauacaucuguauacucaucaaaaaaaaaaaaaaaagacuagaauguucauagcagagcuauccauaguagcccaaaacuagaaacuauucagaugcuuuuccccaggagaauggacgaauagacugcauugcauuccugcaacaagagccuagugaacggaugguccaucacugcacacacaggggugagucucacacccagagcagaggagucagacaccaucgugcguguacuaugggaccuauagggaguuccaaagcaggcaaacagaaucugggcuguuguaauucagcaaagugggcaccgcugaggaugagggacagugagggggcacaggaaggccuuggggguuauacggugcuguucuuagugccaauggcugguuacauaugugguggggcuucacuaagcuguguacugaugcacagagcacuucucuaugaguguuccacuugguauacagucauaugggagauguauaucacauuuuaaagaagaaugaagggcacaggaaaagucaguaugaagugugugaccauuuacugcuauuuggaucugacgaauaaggagagugacaguugucagucccacugauucuagccguaauucugauuuaauaauagaauaucucaugauuuuaggauccuuccuguuccuaaacggccugcaugcuggaccccguggugcccugaggaaagcaggcgugcugaggggcacuggugaggagggccaggaggcguuugcagaaggugggcugcugggguggacccagcuacucaccuggaggaaggugaagcaccgugggcagccccauuagcauucagagggcaccaggaugcaggaccgagcugaagccacccagacacagaaauccacuuccuggaccagaucacaagugcgccucgcccuccucaggggcucccaucucugcuucgcuuccuccugagcucugcgugcucgcacuugagcagugccagccccgcagcccccucccucucaggcaagcuaagccugaaucugugagaaaccaaggcuggcuucucccuggccagggccagauguuuauccccuccgaaucucauauugagauguaacccccaguguuggaguuggggccuggugggaaguguuuggguccugcggacggaucccucauggcuuggugcuguccucaagacauugagugcucugagaucugguugaguaaaaguguguggccccuccuaucccuuguucucacaccccugcucuggcccugucacaggcuugcuccuguuuuuacuuccuccaugagugaaaagucccugaggccuccccggaagccgaguagaugcuggcgccauguuuccuguacagccuccagaaggaugagcuacuuaaaucucuuuucuuuauaaaguuacucggccucagguauuccuuuauagcauugcaaggagggccaaacacagccagcaaauggaguaaaugauagcagcugcccgguccagcagcagccuggugcagcagccgcaguucccguguauguuuacgauguuguuauauggugaugucuguaaauugagauccacagaaggggcuggccuugaggacaaggacacucaagaagccucccugggaggaaguccccucccuuggauguagugauucagaccagcaggaggcggaggggaucggcgccagcacccaggcggugaccuagccuuccucugguguuugaguuggguuguaaccaacacagucuguacauuugguuucacaguccaucuccucccugccauuuagaccuaacuaacaucagaagauuuauuuuuuuuaauggcuuaaaauauaaggguuguuaaaaaggcaggggucauaaaaauagaccugggccuaaauacaugcaggcaacaaacguguguuggggggucugcgugugagacccuuugccugagaagccucccguuccuauaguugcuguucagcuucucuuacuaucauuaagaauauugagccugccucuuugucgaguacagcucucaguaccuugucagugcacagcaaacauuagaugaugauaaauaauggaaauaaccuuuacaauaaugcaaagaaauguaauccagccagacagguaucgguacuggaaagaaaaugaaccauaaaacacccaugguggaauacauuuccagauaaauaguucgggaggcagccagugucuugcggaagccugucccagaucucgggaggcaggugucuggcgagggcauaacugcugaggacccccagcugugcuggccccgguccauggaugacggggacuguggaaacagcgaccuugccccuaaaaacugacugcaggagaaacaaugcagccgggguagaccucagaaaacgucaugauuuuuccaaaaccucaaacgacaguggguauuuuccagccaaaggacaagcaaaagcucauuggaaacuccaugaagagcgaagagaaauggcagccuguggguccuggccugucugagacagcccagagcccagcacuucagacaucuccagggugucucggggaaaggcagguagugacgcggcaggggacuggagcucgguggaguggacucugccucggggucacugagaacugggucccugauggccggugcuccuccccgugacagauuccacacaggagcugcaggccguggaccccugaaguggacaggcgcucuggccguacccuggggggugaaagcccuuccccagugaccugcagguuucgaggggcuucccccucccacggucaccccuguguccuucaucuugcagccguuucauuaucuccacccugacaucgaaccguguggaguaugaccccccacccccaccccccggcgauucacugaaugugaaauagauucccacgaggcauguggguguggagccuguuucccaggggccugggaaagcccacaaagugcacagcccggcaacgcccagagcuucguuucaggcguucaccacaggcucuucucccagcggggucgucugccucguuuucucccagauccaugcuguccagugugggacccccagccauggguggcuguuuacuuuuaaauuaguuaaaauuaaauaauauuaaaauucgguucugcagucacaugagccaugccccaagugccauguagacgcagcaaguggcacagccgagcagcaucuccauccccaggagcuucugcacggcucugauguggaccuucccuccccagcugcugcccggucuccaacuccucucaccccccuccuuuccuggguuacccagggagcugccaaucccucccguucuguacugcugagcguggcauacugcccgaacuggagccaaguccucccugugcccuguugagcccacagggcuucccuuuaauaggugucacuggccacagaaagaagcacuggacauaacucauuccuuucuggauucgccugauuucuaucuuccuuaauagcuuguggauugcauaaagccagugacuaccggccaugauuuggggccugccugcaugggguucugcccaucguggaaauguuucuggagagcaugaguuacccuuggaaacacgguagggggaaagucugccguccucaucaucguguggucaugaaugacacucccugggcccugucugggcacugccaggugugggugauguguccugcauucagcaaagaggcuagcaucaaugcugcagcauccugagugcuggguggagacacaagggcccagacaggagccuuucccuuagcagcuggcuggcaaggccgcugggaagguaccauggagaagcuguggcccggaagaugaauaguguuaaaacagugacgggugaugaaacggccacugcaaauacaaccagagagaaggcaaaaucagggagagguggggagaggccuggagagggagccgggcaauaccugcccuugacaggugcugccuugucaacguaauuacguuugcaucuguguucagagaugaagucagccucucaauucccuuucucugacuuuucuucucugguuuuggcaucaagauuuuacaaguuuuauaaaaugaguuucucuauucucuguagaugguucuuaucuguucauuuaauuauugauagaauucauuucuaaaguaagguaguuuuuuuucaacuaugcuuucuuccaguuaccguuccuucccagaaguauccaugaaccuguuuccaugccaacagcagaggcaacuugggccuguuuugugcuguagauaauaggaugccgaguccggcuucguuuguucaucacugugucucugaaauuuauuccaugacuaucugggugucaugacggcuugcccuucuaucgcuggcacucagagggcuuccaggucagggcaaccaugagucagauuccuuugaacauuccuacagauguguuuugugaauacaugaauaauucuuauuggguauuuacacaaauaaauguccacucauuuacgggaguggaauuguuguugcgugauguaucuauauguucagcuauaagaaaugcugaccauuuccccaaguggugguaccaauuuguaucccaccaggagugcaggggaauuuugguuuuuccacauugucugugacacuuccuguugccucuuggccuugcuggaggguccauguacagcauguucuaagcauggguugggcauggcugcacacacagcaggccuggccucaggaggaagggccuccucucuuccccuccuccuccccacucgucagccacagugucugccccuguggacaaggugcgguuggcaggagcagauaggagacagagaugucacagccaccccaaacucacauugucacaggaggcuugugcucucguacacggcuugcuuucucaucugggcacuuggcagguucuucucaggcccacgcucaccuucgcauccccagcuucagccugcuggcacaggcccuguguguccauccacuugccccucagcugggcucuacuggauaggacccaagaccaugucuggucccuggagaacaccuaggccuuuguucccugcccagccaggggcuggucaucuccacagagcagcacccuccuggccccaccccugagggggccggucagccgcuugccuuucagagucuccagguaggaaccggcuggucacccgcccgcagugcuggacaugcauggagccagcagggucccauggcagcugcacccccacagccugagugaaaagcaaaugccuuccuucuguggaugggacccaggcucagcacaccgucaguccuucaaaaugcuucucagccuccaaaccauuuguggaggcacaggccuugaggcaucuaaauuuguucugcucucuuguuuagaaaauaggcaaaggcugcugggggugggggcggggagguccccgucaccauccuagggugugucucuugugauguggagccugggauggagcuuccagcuggaccuucuguuacagagcaagugagcagaagaaagaaggagggagggaggaaaggggagggagggaagagagggggaggaaggagggagagaggagggagggaaaaccgagggaagagggagggaggaaagagggaggagguaggaaagaaggaggaguuaggaaggagggaggaaggaaggaggaaagagggaggaaguaggaaggagggagggaagagggaggaagaagggagggagggaagagggaggaaggagggagggaggaaaaaaggaggaaggagggagggaggaaaaaagagaggaaggagggagggaggagggagaugggaauaaaaaguaaggaagggaggagggagggaggagggagggagggacuggccuucagcaugccagcauaugccaagauacauuauuggauaaaccagggaccucaggugggcaugagaaggggagacacgaggggacugggcaagggcagccuggccacucccccaacuagagcaagaccuggauccaccaggagcgucagaaggaagcagggccuagaacccacucccagaccucucugccaccuucacaagaagccacucccuucagauagaaccauuccccaaaaugugaccaaugggcagggugggggguuccaccagagagaauugcugguggguuucagcauuaaacacuaccacccauggaaugcaaauugacuuugucccuccacaaacuggucauuucucaucacgaagccaugaccagcaugaccuuuacauguggaucaacagcucucgguccuuugacagccaguuccuuugacuuggccacuugauagugaccauucaaccuaaggaggugugacccagcggugguacgagguggcuggaccucaguucuaacggugacaacuucagcuaaagcacguuuguucuggcuguccguccucugcuuguguaacuuuuauuuccucagugugaacagcgcugcacuugagggacaggaagggggugcuuccauagcugucauugcuauggcgcaaguuuacuuuuacucuucaauuuaaaaaucgggucuucuacauaucuuugcaacuagggaagagaaagcaggucuuuuaauuccagaaccgcagugcacaaaucauguuccagugugggcugugcaggagcucagugccugguggguuucagguugcaggacaucucccuugggggcuacgucugaugcccugcagccagcccugccgauggagcccagcugcuuccugcguucucaaugaugaguccuugugcccugggcuguuaaggcugugccucugcugugagcugaaacgcuuucucugaagagcccuuacagugcagaaauagugucuuuggguccugcugagccccuacccccagcccaccgcuggcacaaggugcaggcacugggcacugcuuggggcuucgccagucaccugcacuuucuaaccgccugcacuuauuuuccaaugaaaggccaauaaagucacaaacuucacuugcaaccuguuggcaaaagacagggaaggaaaaccagccacaagaaauaacaaucuugacaaacuuuuuugcaccuacacacaaagccuugccuucagcucagagacucuuggacucaagacaguuugcccugcccucaugcacaccaaaaaucuugucaaagagccaggagcuuucguccagcagcugucaggauggaaacgugucuucccauuugcacccugccaaaggaaugagcaagcuguuucacagccacaguuauccauuuucugagacaaaagguucauaucagguaaaucaccuucauuagaccacguuguguguuuuguguauguaaaugacgucucugccuugcaggagugggcacugcagaaacucuggcuucuaugacacgcagaugccgagugacguugcugaaggcagccugcuugcuaaggcugcaucuguuugcuguuucugacauaucuccagcgaucaggccccuaacacaccacauucccuagguuucuuguuagagccaaacauauaaaccggcguaucaaggucccccagcguggagaaugagaauaaagagcaaaugugauucucaagcagacacaccagcuugagcaugagagcucuggugcgucuauaugcagaaccugcagaguugggccagaacugaggucaagagucagccccgugccacugccuuccuccucaacaccaccagagagacuggaacugugccccaguuagagaaguaucgcauuccuccuguccccccagagcccagcccaggccccagggagaccacaacacacaagagagacaugggcucugccuuggggagcuuacaagugagcaggaaggcaacuauuccgcaaguggguacucagaugugugagcccucaugagcucgggaagcccggcauggguguucccacaggggucagggaaugaaugcugcuggcaggugcccagucagcuguagcagcuccaccuuccucucugcaccccuuugcauagcccuggggauggcacuaaggcuggugaucauggcggggacacaaagccaugacccuaaugagcaaugacucuuucaguuagcgcuaaggaaaggcaauuacaggaaauuguguucgaagaugugggcgugugugggagcacugcugcaugaaacagacuuggcucaccacgacuucauucauucauucauuuauucauucauuguccuaggaggcuucccauuuugcaucccuuuaucucugcucccuccagaauuguccauagugagcucugaagcucaguuccaagacaaaaaguuggggaggaaaaaaauaaaaacuagcuuuuaagauccgaaaguuagaggagcgagaaggaagccaagcagcggcaggcaucccuuccccacacgacacagacuuccagagcucagagaccauggaagaugcagguucacgucaugagccaucucugagugugagccuuucugguccacugcagagguguugguguguuuuagcugguguguuugagugaaugacaugccgacucccauacucaccuauaaaaccuaguaaugucacugaccuuagguggaaaugggacccgguagaaaucuggcuuucuggagacggccaugagaacgagcuaggacauucugccaggguaguccugaccacagggggcccgcggguggcuugggagucaacccuccucagcaucacgugggcucccguggcucagugcuuugguagcaucucaccccaucugccaaaugagccauuuuacuccggugaucccuccaugguggccuccaaaaccuccauguuuccaucuccucgugaccccaagaaucaugaauuugauuacaccaacaccuggucaugucauugagcacucaggaauauagguguuaguuuuguaucaaaugauuuuauugauggaugaauuuuacuaacgccaaccauguccaggguggggacggucaggaagugaaugacucauggccacagcaggugaggcagcugaggaggaagguuucagguguccuccagugguuuucaugaucuuaugccggaguuucucucggggaaaugggaacugucauugccuuccgcacaccuccaguggguagcagagauucaauaagauagauagaaauaugcuuuagaaaauuacgaguuauucaaauaaacaagcacaccauucuuggguagaaagagcagcacuagaggagucuuaucuagcccaucccucaguacucgugcuggagaucccagaccccacacugauggaacucaguugggcuacuuccagccuucucuuauucccuuggggccaaguagaaaagaagucugucuucccugcggugugggggagcagcagcaggccccagccccacauuuguuucuugcaguuaaagaacugcccuggucauagcaggggugagcacaguuucccccucagccuucucugcaucaacaaugccuuuuucugaaucaggagccguagaugagcccuccacucacugcuuguuccgacuugcuuacaaugacuuccuuuuucuucuccaacucugcagaccaacaaagccguggccaagggggacuugcaccaggccagcaccagcucccggcgggcccuauuccuggcagugcuguccaucaccauugggacuggcgucuaugugggcguggccguggcccucaucgccuaccucuccaagaacaaccaccugugagcuuccugcgaauggagggggagcacccggggccaggucuguguggacguggaggaagcaggcauaccgcaugaugcuguacaguacaaaugauugccaaaugaugccacgaagcccugggauuuccuacccauggauuuauuuuguuuuuauccuuuaauuucauguucacagcacuguguagagcaccagacagacgggcacugcuaauccuuccaaaggaaagcuccaaagaucccagcccgcaaggcugucucuggauggauucugguggaugaauggcaacgcggcucucugcagccugccagugcccagagugccaccgcauuagcaauauacaaacaguccaaaaaaguguuuauuuuuuauggaauacggugcaauaggcagaggacaagggacacaucacucuucugucuguggcccugcuggaguccuuugugccccccggaguccacacgccuucccugcaagacgagaauggggcugggaagaaagaggcaacaccacggcuggcaggagccccgcugcacugcucugcagacccauuggccugacccugagaagcagagccagcaaagcccgggaccugccccucuuucuuucccuucacaccaccccagccucaggaugucaagccaccuccggaacgugucuacacuccacagcuaccccgcagcaauacgcacucuugggaccucgcugaucuaggauggggaggcaggccaccgccccucccaagacuccucaagaaagagccccgcgguugcuccggaaacucgaggcacugcagcuaugggcacugccucagccuaaagacacaggggcgccucccaaucaccgcgcuggcggaugcucaccccgucauaagcagaaacuagugauccuggaaaugagaugggccuuacucugucgacuaaaugaauagcuauuuucuugucauuuuuuaaagugcaacucuugcuucaugcugcuuaaguuaccagaugaaugcugagaaauaaguaaucacagacauuuuaauacc

SEQ ID NO: 191249 - RNA, 22902 nt, Homo sapiens
uucccggaaaaccauuuuaauuauaauagcuuacacaggcugcagagagggagacgcagagccggaccugacgggcugugcuuucaaaacugugcagucuccuuccuggcucugaacagguuagcaagaguuccaagaggccucaggccuccaaccacaaaggcagagaaguuagccccagaaagcugacagcugaaggcggggaggcugagagugcuugguguuugacagaugaguguuguggugggaggaguauggagucacacagaggcuccacccagcaaggccucuggccaggggcuauguuuaaggcuggggucaggcagaggugggagccgcaggggagagaagucuggccggcaagccccaagggaaggacaaaggcacuggggcagaugugaccguggacaaccgcagugcaggcagggccccuacaacgcuacagcaagcaaggccguccacgaagcucccugagcuacauucuaacagaauguggauguggggcugggucagcauguggccccaccaucuuuagcucaguggcaguucugacagcuuggguggcaaggaaucccauuuacccugcagcggcagcccccgcuggugucuccugggcccuagaggaugggaggaagagaagagaaugucagcgcagugcagagacugcccccacagccgagcgcucucccaccccgggccuuugccucugcagguccuccugcaagaauggccuggucagccucagcuaccugauggagagucacugaggccuuuucugggcucccacagcacucagucuacccacgccuagauccgggaacaggccagggagaggaucugaccacucugcauauucuagacaugucagcaugcgagagggcaguuuccucugccuccaccugucugaaagucuaccugaacguagcaacaggcccccaauuccagagcacaccccuaauaacgacagcuaccaucugcaagggugcucaccaagugacaggcucucuaagcacuucucuugcaauuuuuccacuugauucugacaacaagccugagauaagcccagcuaucaucuccauuucacagaggaaauggggcugacagaggugaguggcaggcagccuaaucacacagucaguaugugccagagccaggggccaauccaccucugacuccagaucgaaccuuuacuugcuguccucuagggcaggagugggcaaaccuuuucugcaaagggccagucauuuugggccgggcagccauacggccucugccucuguaguguaaaagcaaccacagccaacaugugaaugaaugaacacggcugugcuccaaagcacuuuaccuacggacacugaaacguggauuucauguaauuuucacgucacaaaauagucaucuucugguauuuuuucaaccauuuaaagauguaaagaacauucuugcggcccgguggcucacgccuguaauccuagcacuuugggaggccgaggcagguggaucaccugcggucgggaauuugagaccagucugaccaacauggagaaaccccgucucuccuaaaaauacaaaacuagccgggcgugguggcgcaugccuguaaucccagcuacuugggaggcugaggcaggagaauugcuugaacccggaaggcagagguugcagugagcugagauugugcuauugcacuccagccugggcaacaagagugaaacuccguuucaaaaaaaaaaaaaaaaauucuuaccucgggagcuguacaaauucaggugcuggguuggauauggcccaugggcuguaguuuucccagcccuccucuaaggcaaagcccacaagggcacccucuccacaccaccacgagcaaagacucaccccagggccccagcgugggcccuuggugacccagcagaucucgguguggcagacggugcagcggauccagucgcagccguccuucuucuguaccacgaucuggcacugggggcagcgcauggccucgcccugcugcagcaucaccuggaguggggcaggugcuggcccuggggcggggcuggggcagucacccagccuggccccuccccauggcagggagaagguggugacccucuagagcuguggagucucuccuguguggcucugccaggccaggcuccauccagcaacccccucuucauuccuguggucuccacccuccacccagacgcucuuccugacaugaccauucggccuaagucccaccuccggaugggagugacagccagaagggaggucagagccuccagggaugugugagcacagcccuuacugggaagcccccagcccccaccuggaucccagaacuuaaaaucccuaggccucggcccugucccagccucaccuucagcaucucugucgucugccgggcagccacaucguucugagcccgcagggccagguccuccugauacuccuugcaguucaucugcucauggauggccuguagcgggugagggacucaagguaagaagguuccucaggggguuaagaagcugggagaggugaggugcagggcaggaguccacaaaggcacuuaaugccucuagguguagucacuggcaggaccucacuuuguaaugcauaagccauuuuacagaagaggauauuggcgccagggaggugaagucaaggucaucacauaugcuaacagcaaaauauaccucagccuccugaguagcugggaccacugacaugugcugccacacccagcuuauuuaaguucugaugggcacagaaaucccuuauaccccuagggugagacccugcaucccuaacaagggccugcccgggguuacaggcccaaugaccccagacugagcuugcucaggcugagucugagaccaggcuccagaccuguuuaccggcuccucaccuucaacuuuugagaugaagcggcggggacaggccugggggaaggaucagguagggcugucuagguuuggggucagcacucaguugaggacacggguggagacgugguauagggccagggucaggccuuagucugucacagauucagucagaagccagggucagagcucgguucagggucugagcugaauaugggaccaccuuaagugacaagugcagggucagguuuggucagaggccaagucuauggacuuggaugggaucagggcucaaugugggacugggauucagucugugacuggggucagacuggcccagggucggggcuccauugugaaccagggcugccuagguuugaggcuccaucuggggcuggggcugggacuccgucuguggggccagggcucaguucaggcucaagccacacucucccacugacauguagcucuaagucaugaccagcaggccagugucacagcucccuucccaggagaacacgcacugcaguguggugagcuccaggcaagaugacagugacuagguggggggagucccugcaggccccaccuugcagagcaggcaguugacguggaaacacacagggcaggugaacucauugacaucauccucaaagaagcaccaucccuugcaaucuggggucuugcaaugguagcugaaggcacugcgguuuucagcaauggagaugcccaggucuagaaaucgcugguaauccucaggggucaggagcugccaacacaccauguccuugcugcucaggauucagaacaccugacauaugacccuugaccacuaaauacccuccagaaagcccccagcccagaaacuccaacccagccccaggcucuuuucuucauguaauccucauaguguugaaaaacuccauucaaagaguggauuuuaggccaggugugguggcuuacacuuguaaucccagcacuuugggaggucagucaaggcaggaggauuccuugaggccaagaguuucagaccagccugagaaauacagugagaccucaucucuaccaaaaaauuuuuuuaaaaaauaaaauaaccagguguggugcucacaccuguagucccagcugcuugggaggcuggguugugaggaucgcuugagcccagaaggucaaggaugcagugagccaugacugaugcacugcacuccaaccugggugacagaaugaaauccuagcuaaaaaaaaaaaaaaaaaaaaaaaaaaaaggaaaagaaaaguaaaaagaaagugaaagaaaguggggggaauuucuaaaaguucuggagguggaugguggugaugguugcacaacagugugaauguacuuaaugccacugaacuguauacuaaaaacugguuaaaaugguaaauguuaugucuauuuucucacaauaaagaaaagaacauaaauaauaagcaauguugggaaagacaugauuaaacuaguauccuauaaagaaaacguggcacauauauacaauggaguacuauucggccacaaaaaagaaugcaauccugccauuuacagcaacauggaagaacuggaggucauuauguuaaaugaaauaagccaggcacagacaaacaaacauuacauguucucacuuauuugcaggugcuaaaaaucgaaacaacugaacuaaugaggacagacaguaaaaggaugcuuaccagaggcugcaaaggguagugaggcguggcaggggaguggggauggcaaauugguacaaaaaaauagaguaagaccuaguauuugauagcacaacagacuguagccaauaauuuaauuguacauuuuauaauaacuaagagagguuaacuggauugucuguaacacaaaggauaaaugcuugaggggauggauuccccauucuccaugaugugauuauuacgcauugcaugccuguaucaaaguauuucauguaccccagaaauauauacaccaacuauguacccgcaaaaauaaaaaauaaaaauuaaacaaacuaguaagcuaguacguagcacugagaaagcaauguggcaauaacguuucaaccaucccaaacuuuucugacccuuugguacccaucccacuucuuuaacuuuaucccaagaaaauaauauauaagaugcaccagccaggaaugauggaucacgccuguaaucugaacacucugggaggccgaggcgggcgcaucacgaggucaggaguuuaagacuagcuuggccaacauagugaaaccccaucucuacuaaaaauacaaaaauuagcugggugugguggcaucugccuguagucccagcuacucgggaggcugaggcaggagaaucguuugaacccgggagguggagguugcagugagccaagaucacaccaauguacuccagcuuaggcaacagagugagacuucgucucaaaaaaaaaaaaaaaaaagaauacaccaugcaaaacauuccuugaaggaguauuacaaacugagaaacuagaacuaagagguauaaacaguauaugugcuauugagauuuguaauaaucuuuagaaaaauucuauagcaaaauaacaaaagcuaaagcgauuguauccaugcugguuacaaugaggcagaaaucaugccuauguuauauguaacagugguuggugguuacgagaguuacauuuguuaaaauuuaccugacugcauacuuacaaugaguacauuuuauugugugcaaaguauacuuaaguaaaguugacuuaaaaaaucauaucuggcugggcacgguggcucacgccuguaauccuagcacuuugggaggccgagguggguggaucaccugaggucaggaguucaagaccagccuggccaacauggugaaaacucgucuguacugaaaauacaaaaauuagcugggcauggcggugugcgccucuagucccagcuacuugggaggcugaggcaggagaauggcgugaacccgggaggcggagcuugcagugggcugagaucgcgccauugcacuccagccuggaugacagagugagacuucaucucaaaaaggaaaaaaaaaaaaaauuugcccagagauacugaaggaaauaagauaaaaugcaauuggaggauuuccuggguuugugggugauuuucucucugauuucugcucugguucuauguggugaggcauauuuuucuguuuuuguaaaaacaaccuccacuacauuacuuggcugaucccugccuccuucucucugucacacuugaccauuuucugagacucacaucaacuccagugggcuccagggaaguucaugcagcccuuuggcaugaaccuggccccagcauaaugccccuuggcugggguggacuccacagggaaaccucuaagcaaauggcuaugggugcuggggacauauggaaugacuggucaugaggucucuccaggccagagcgaaggagccucagcaaccacccagagacaacagagaaaaauggggcugcuccugauaucagagcugugaacucccaaaguucuaccucuucugccucccccuuuuccccaggggcagaaccucuugggcuccauaaacacuuggugaaguugggagcauucucaggagaaauaggggcauaggagagaggcaggggggacagaaauaaagaggaggucuguguauguguuuuguggggaucucccauuugggccucggcugccauguuuuggccugggaacccacagugcccaagucugggaaggucauuucccagcaguuugaaaaccaugaaucaagcccaacuguccacuuuucagauaaggaaauggagucccacagaagggaaacaacuugcucgagaucaccagcagccaggcagagaaccugcuaacgaauucaugaagagcgccagcggcaagcacacacguaugcagacacacauaacgcugugacagacuggcggaguggugacuccaauuuguuucugucuccccgauuccacacuuuuggguggucccuucccaauggacucugugcuugagcaugggacuugcuuuggccaaugggacagugucaagugagaaaugagcagacuuagaaaguacacaugcacuggggcuccccauggcugcucuuggaaccuugagaccaccaugacaugagaaggcccgggcagccugcuggugggugagacauugaaguggaaggaggccccagucaucccagucaucacagaugagaccauuauaaaccaggccaccgcggcugacccaccagccaggcccaggugaaaucagcgaggcccugcccagaccagaagaaccauccagguaaguccagcccaaauuauagucaucccucgguauccagagaauugguuccaagaccccugcagauacccaaauccauggaugcucaaaccccuuauauaaaauagugcaguauuugcauacaaccuaccaacauccucccauacacuuuaaaucaucuguagauuauuuauaauaccuaauauaacauaaauguuauacaaauaguuuaugcuguauuguuuuuuaaauuuguuuuuuauuguaauuuuuuuuguaagaauauguucuauccaccguugcugaauucuccagugugguacccacagauacagagggccaacuguccuaacuugcagauuuaugagcugaauaaaugacuguuguuuugagccugcagugauuuguuacacaguaagcgcuaacaacaacaaaggcuuacuaugugacaagcacuacucuaaauauauauauauauauuuucagacggaguuucgcucugguugcccaggcuggagugcaauggcgcgaucucaguucaccacaaccuccgccuccgggguucaagcgauuccccugccucagccuccugaguagcugggauuacaggcaugcgccaccacacccggcuaauuuucuauuuuuaguagagaugggguuucuccauguuagucaggcugaucucgaauucccgaccucaggugauccacccgccuuggccucccaaagcgcugggauuacaggaaugagccacugcgccuggauguacuacuaugaauucuauacacauauccucuacuguaaucuuugcaauccuggaaauagaagcuguaacucugacucuaacagagaugagauagaggcauagagagguuaaauaucugacuuguggucacacacccaggccaccaggcuccagaguucccugacuaauuuuuuuuuucuuuuuuugaggcaaggucucacucuguugcccaggcuggagugcaguggcacaaucacagcucacugcaaccuuacuuccuaggcucaagcaauccucccaccucagcccacucaucccagaccccacccaaguagcuaggacuacaggcgcaugcccccgcgccuggcuauuuuuugaauauuuuuugccauguugcccagguuggucuggaacucauggguucaagcaaucugcccacuucauccucccaaagugcugggauuacaggugugagcugccacgcccagccgagucccugauucuuaacaacucugcuguccuuccuucauagaugugguuucuugacuagcuacuccccucaauucuuuuucugcuuggggucucaacaccccacauggacaaagcucuugaaaaaugucuggggggcugaggaugaaugaucgcuuaagcccaggaguuugagaccagcuuggacaacauagugagaccccaucuccaaaaaaaaaaaagaaagaaaagaaagaugucugcugccugcucagggcccaguuccuuaggaguugggacuugggguaugucucccacccugaggccuuaccgccuugaucucccucuccagcagcuugcccgagcacgaguagguguugucaaugaaggggcaggagaccuccgccuccuggcuguugcggauggugcccugcaggcacucccuaggggaggggaggggaaaagaguuaggaucauaggaacccccuucacuggggacuccaucccucacauggcaaggccugaccccaggggccucacucagucaccccagguggacuucuccucaauaucuccuuccuucccaucccucucaccaacccaucaccaaggccuccacccugccuccauacugccgcucugauucucugguccaggccccacaucccccaccugggugacuccaggagccuccucgcugggcucccugcauccaucuggccccuagagucuaucucagaacagcagccaugucuccccagugacucccauccuacccagaacaaaucccaacuccucacugcugcucacguacccaacaccucucuauccugcucugauuacccccuucaucccucugcuccagccaccaagagaccuccucagucuccuccaacaggccaggcccacaccccacaccuacagcaggccuuccggucccugcucuggggcuaccuccuuggaagcuuccagaccacccucucugggaaggacuccuguugucucuuaauguacuguauguagcauuugacacaauucacaaagacaucaaccagcgauuauccgauucucaucagccucucugcuggaauguaagcugcaggaggcaggcacggagccugucacccaggggcggcuccacaaggguccgcuguggugagcgggucuguguuccccacauucaggggugggggggccaugacaggagacucagaaacuggcagaugcccacagcgaggcugagagcagcguggcugcaggagcccgggcggcgaaagguagaggggaagggagucuccccccacgccugcgcucacgucuaggcugcuucucucaugagccgugggccugggguaaggcgcugggccucucuuucccucagguuccucguccgcaacauggggagacggagccuaccucguagguuuucgcgggcguccaaugagguaucagagcacagggccccacccacguccagcccugcguaauuggcggcuuugauuaagcugcauugccgggggugggacugggggccgcaccugcagaaggugugcagacacucacgcagcaccacggccucgccgggcgccagcaccgaguagcacacggggcacucggcgggcuccguguucagcaccaggcuccucugguccagcuggacgugcugcagguaguuccccuccugcugcugcugcuuccgcugggcacacggggcggggccacggggcgggucagggccucgggggcgggucagaccccgaagggggaagggccagggggcguggucagggcugggucagaccagccacaggcaaagcugggagccaguagggaugggggaugggggacgggggugggggauggggguggggcugggggaugggggguggggggugggggaugggcaggagcaggcagguugggaggggcggggcugggagugaggccagguggagguggggaagccaagggaggggaggccggccagguagccacggaaggcgccaggugagacagcaauggcagcaagguaaggaagggggccggggucugaguggugagucagguagcagggcagggcccgggccagggcugguggagccacucaacgucagggguggggaagugacgaagccgaggagcugagacgggaacaggagugggguggccaggggcagcaccggguccaaggggaaugcagguggggccaggggugagaucagaauggggagcacucggggaucaaugucugugucauuagugcgugugucacgaugggggcgggguagggcuaaggcguaggaccggggucgggggucaucccccuagggcgcagcgaggguccaggccaggcucucaggaagucaggggugggcccagcccgagagggaagaggucaggaguaggagaguccagggugaggucacggcgagguggagcaggcuuaggucacagacgggugggggugagguccgagcugagguguggucauggcuagggugcuggggucauggcuagggugcuggggucauggccagccauacucguguggugugucaaagcuggggauggagccacagcccacgugggaguggggcaugugaaccuggaugugcgccacagccagggagcgggucucagccacagggugaccuuugagagagggcaggucacagccaggugcagggucacagccaggugcagggucacugccagcagcaugguugggaggggcaaggcaguaacggagaggcgcggcagugcgcaggugucucccuuccuggccuacaccucccccgugcggucugcaggugucuguccagggacuuucccgcccaccugcugguacugacgcagcgccuccuccucgcccgccaggcgcgcucgcuccuccucgucgggcugguaugaggcggggaccugguaggccucggggcgcgcccggcagcacaucucacagccaggccgcgugggcuuguugaugaaggugcacccggggcacugccagcccaccugggagcagagggugcugugagcccgacugggcagggugaggcaagggaggggcacagaagaggauacugaggccaaggacagcuuaccggugggggcucaggcacugcaucuggcugcccccguccggguuccugggggaccccgggcuuuggggggccuggcuccagagggccccgcggcugcagcgugagguccuugaagcccagaucuguggaggaggguuaaaggguggugguuccacgcggcccacuugguccacacccaugggggugggucucccugagccagccaggcagacccucccccuauccucucccuccucccuggggguaccuccagcuuccaucuggccaagugggcauccuggcucccccagggucagggucccuauuccaccgauaaaugcuucuauguccuuugagcuucaaaacccagcacaacaccagcccuuccgugccuccugaaggaugcaccaagagggacccaagagcaccgcugaggcgguccugccaaaacagugacuugauccacuccggaggaaacaucagcccccaacccccgccaaaaaaaagaaacuggccuggacucuuugaaagggacugagacaugacagcagaaugccaagucuuuugcuauaaaugacaauagugggacaacugguaaaaucugaguaagaucuguagacuggauaccaguacuguaucagcguuaguuuccugaguuggauuguuauacccaguaauguaagaaaaugaccuuucuuuucaaggaaaugcacacugaauuauuuaggggaaagagacaucaugucugcaacuuacucucaaaaugguucagaaaaaaaauaauuuuauauagaaagagaaugauaaaagaaagcaaauguggguugggcgugguggcucacgccuguaaucccagcacuuugggaggccgaggcgggcggaucacaaagucaggagaucgagaccauccuggcuaacacggugaaaccccgucucuacuaaaaauauaaaaaauuagccgggcgugguggcgggcgccuguagucccagcuacuccggaggcugaggcaggagaauggcgugaacccgggagucggagcuugcagugagccgagauugugccacugcacuccagccugggcgacagagcgagacuccgucucaaaaaaaaaaagaaagcacaugugguaaaacccacaugaaagguacaugggaauucuuuauguacuacuuuguaaaauuuagcaacuuuucuguaggucugaaacauuucagaaguuaaaaauuaagaauaaacacuaguuaucacgaucacugucauacccaauuuaugauuuuagcaaacugggcagcagauaggagcaaccuugcccaaggucacacagcugggaaugccggagccuggacggaguccaccccuccccgugccagcuguucucaugaugggucccugaaaugcucccucccaugugucuuagguccucucuuccccacuuggauaggguccucugggugagucccugacuaaaaacccaggggcucugccccugcuugcccuaugcccucaagugaguccagggcccccgcuggguccggcggugcucagggcagagccucaccuuccagcauccgcagcugccgcucccgcugcagcuccugaggguugagggagguguugcgggcugacagcagauagagguaggcacuguccccauucugccgcaccccaugggagugcagggucuccuggucucgugccagccgcugcccaaucacccacugcugcaagacuggugggaagccauaguccagaaaaaccuggugggggcaaagagagggagagugggaagggagggccagaggagagagaggaagcaggagugaaagggagagccuucaccccagugucgcccuccgccuccucacucaccauguccuugagagacgccacugucauaucagggcgcacugugagccagauggugacggugugcaucugagcauccuccacgcucacccacagccugcagagaacagcaggggcucagcaugggcucuggccagggguccagccucagccaccggcuacagacauguacauauuugcacacaggcacauggccaugcacacacacacacacacacacacacacaaaccccagucugggguaggccccacccaugcuucuuccuuuauuagaacccaccaguuaggccccuccaauggcuccacgcuacucuuagaaucaacucguggcagcacacgagggccuccaugaucuggcaccucccugaccucuccaaccucuucugucuucucuccccugcuccuuagugaaaccaccagaaguuguuguuaacuacgugcuaagacuauuuaaugcacuucauguguauuaacucauuuaauccucucaaccaacccaucagacagguacugcuguaucccuguuuuacagauaaaaaugugaggcacagauagguuccagugacucugccaaacuaagcaacuaauaacuguuagaggcaggauucauuuguaugucuugauuuaauuuuaagacacaggcucucuuucuguggcccaggcuggagugcaguagugcuaccuuggcucacugcaguaucaaccuccugggcucuucccaucucagccucccaaguagcugggaccacaggcucaugccaccaugccuggcuaauuuuuuaaguuuuuguagagacagggucucacuauguugccaaagcuggucuugaacucuuggccucaagugauccuccugccuuggccucccgaagugggauuacaggaguaagccacuguguucagccagaggcaggauuuaaaucuacaugguauuauuccagagaaagugguuuuaacuuucuugaggauccuccaacauguuuggaaaaucaaaagcaugaaaagaugaaaaaacagaaccgaccccaaaggaaacagagaucauuuaggguauggaacaauaagcaacagugaagucuaacuaguaccuucagagagauuugggaaaacacugcauucagaaagcaaggaaaggcaugaagcaaccaaaaaaugaggaagaguuccugcacauuaaaagugacugcugaaucccagcacuuugggaggccgagguggguggaucacgaggucaggagaucgagaccauccuggcuaacacggugaaaacccgucucuacuaaaaauacaaaaaaaaaaauuagccaggcacgguggcgggcgccuguagucccagcuacucaggagauugaggcaggagaauggugugaacccgggaggcggaccgugcagugagccaagauugcgccaccgcacuccagccugggcaacagagugaaacucugucucaaaaaaaaaaaaaaaaaaagugacugcugacuaauugaaacuuuaucucuaacuaccaguuacaggaaaaacgggagauaguaaaugacaccaugauagucuggguauuugucccugcccaaaucuuaccuugaacuguaauccucaguguugaaggugaggccuggugggagguguuugggucauaggggcagcucccucacagccuggugcugcgcucacuguagugacuucucgccauagugaguccucgugagaucuggcuguuguaaaguguggcaccuccccaccaacucucucucuugcucccucucucaccaugugaagugccugcucccgcuucaguaaaaguucacugaggccuccccagaagccaagcaaaugucaggaccaugcuuccuacaccaccugcagaacugagucaauuaaaccucuuuucuuuacaaauuacccagucucagauauuucuuuguagcaaugcuagaguggucuaauacauaccaugaagagguaauggauagauccagaauauggggaaaauucuagaggucaaaagaccagguuucuuaaaaaaaaaacuaguggcauaaaaauagaggagaguaaaagggacuuaagacauaguaagaaaugcuacauguagaucuuguuuggcuccugauuugaagaaaccaauuguaaaaagcacuaaugaaauaggaaaaugugaauauaaacagggcauuagcggauuuuaaggaauucuuauuccuuuucuaaggugugauaauaguauugagggguuuuguuuguuuuuguuuuuuuugagacagggucucacuucugucacccaggauggaguguaguggcaugaucuuggcucacugcagcuucaaucuccuggacugaggugacccucccaccucagccuccuggguagcugggacuagaugggcgcaccaccaugccuagcuaauguuuuguagagacaagguuucacuauguugcccaggcugguuuugaacucauggguucaagcaguccaccugccucagccucccaaagugcuaggauuacaagcaucauccaucgugccccgccaaguccuaauuuuuugaagacacauacuaaaguauuuaaggauaaaauaauaucugaaauuuauuuaaaagcaguccagaaaaugcucucaaaauucuucagguaaacaauuugaauacccagucaacuaucaaugaauugacagagcaaaauauagaaauuuuuaaacaugcaaagacucuaaaaguuuaccacauuuuccacgugaaaaguucuugaaaaacaaaaauagaugagucugauacaggagaauagaagaaaaguaaaaaaugaaaaggacuggaucuuaaccccaaaauguucuuccagcaauaaggguuuugaaacauaaaagugcauaugguuucaacugcacuaguuauucuauagugaauaauauuuccauaaucaaaauacuauaaauccuuucuaguaguguuacacuuuuagaaucaaccuagaggcaaagcauaaaggccuuaauuauguuagaaaacaaaauuuuuuaaagcuauaaucuuaacacuaucaacaaaaaaauacagcuggagcucucucauccaaugugacaucaggaucgcuggugaacagcagagaaucacaaaaacagcugcagacaaagcuuaaacacuuaauuuuaacuuacauacuauaaaugcauauucacuggccagucucuagguguacagccaauggcuuuucucucuuucuuucuuugagacaggguuucaccuugucacucaggcaugaucauggcucacugcaaccucaaccacccagggucuaauaauccucucaucucagccucucaaauagcugggacuacaggugugugccacccagccuggcuaauuuuuuuuauuuuuugcagagacaaggucucacuauguugcccaggcuggucuuaaacucgaguucaagccauucuccugccugagccuuccaaagugcugagccgccaugcccagcgugaguuuauaccugcucauuggaguuucccagggauuuuucuuuuuuuuuuuuguaugaaccacaucgauaaucaugaucuauaauuucuaguagcagcuucuuuaaagcgagcaagaacuuagacacacuccugaagcaucagagcacagagcccuucuggauuuuuacuguauuuccuuacuacugucucacccaaaaguguuaaucuuuuuuuuuuuuuuuuuuggugauuugucucuuaucuuuuuaaagcaaucagcuuauuuucacagaaacaacucuuucagcgcucauguuuuauuaauuaauguaauagcuaaguaaacuauguuauuaccaauaacacauacaacagguaucauuugcuaggaagcaucggguccaucgaugagaacccaacagcaggucugagaggugccgguugcccagagccucucaaaacucagguucugacccagcaagucugaggugagaccugagauuccccccauguugugguccacaggccacacuuuaguagcaagaugguggcugacauuguacauuuuacaaaggaaacgccagugccaguuaguuaauucaggggaucaaguggaagucaacugggaaaguguccacaaugauacuucaacaaaaaaaguaaggaaaaggaaagguggaagaugaguauguuaacuuccucauuuuucauagcaaggaguacacagguacugucucaagcaaucauuucaagaaguagauaucucaauauuuuguuuaaaaucaaguggccaaugaucuacagauucaaugaaaucccuaccaaaauucccaguuguuguuguuuuuuuuuugcagaaacagacaagcugaucguaaaauuuauauggaaauucaagagacuugcaauaaccaaaacaauauugaaaaagaacaaaaguuggagaacuuguauuuccugauuucaaauacuaugaagcuauaguaauuagugugguacuggcguaagggcagauauauauuauaguucaaugguauagaaaugagaguccagaaauaagcacucacauuuauggucaauuaauuuccaaaaaggguuaagaugauuaaacagaggaaaacagccuuaacaaauagugccggcacaacucaauauccacgugcaaaagaaugaagcuggacccuuaccucacaccuuauauaaaaauuaaaucaaaauggaccaaagaccuaaauguaagagcuaaaaccauaaaaucuuuagaagaaaauauagagguaaaucuucaugaccuuggaugaggcaacgauuucuuagauaugacaccaaaagcacaaacaacaaaauaaaacauagacuaacuggacaucaucaaaauuuaaaacuuuugugguucaaaggauaccaucaacaaagugagaagacaauccacagaaugagagaaaauuuuugcaaaucauguagcugauaagcuaaaaugaauaaaguacuucuagcuaaaaugaauaaaguacuccuacaacucaauauaaaaacauaaacccagccgggugcaguggcucaugccuguaaucccaacacuuuggaaaggccaagguggguggaucaccugaggucaggaguucaagaccagccuggccaacaugguaagacccgucucuacuaaaaauacaaaaauuagccaguguaguggugggcaccuguaauccagcuacucaggaggcuggggcaggagaaucacuugaaccugggaggcggagguugcagugagccgagauugcaccauugcacuccugcuugggugacagagcgagacuccaucucaaaaaaaaaaaaagauaaacccaauuuuaaaaugggcaaaagaccugaauaggcaaaccuccaaagaaaauaugugcaugaaaagaugcuuaacaucauuugucaucaaaugguuaggaaauugcaaaucaaaaccacagugagauaccucuucaaacuuacuaggauggcuauaaucaaaaagauaaacaacaacaaguauuagagaugauguggagaaacuagaacccucauauaugcuggugggaauguaaaauggugcagccacuuuggaaaacugucuggcauuucuucaaaaaguaacauagaguuacuguaugacccagcaauuccacugcuaguguguauccaagagaaaugaaaacguguccacacaaaaaguuggacacaaauguucacggcagcauuguuuauaauagccaaaaaauagaaacacccaaauguccaucaacugauuuaaugaguaaagauaaugagauaugucuauacaauagauuauuauuuggcaauaaaaaggaauaaaguucugguugggcaugguggcucacaccuguaaucccagcacuuugagaggcugaggugggaagacugcuuaagccagaaguucaagaccagcccagacaacaaagcaagaccuuaucucuacagacuuucuaaaaauuagccagguguggcugggugugguggcucacgccuguagucccagcacauugggaggcauaggcgggcggaucacgaggucaggagauggagaccauccugguuaacacggcgaaaccccgucucuacuaaaaauacaaaaaauuagcugggcgugguggcgggcgccuguagucccagcuacucgggaagcugaggcaggagaauggcgugaaccugggagguggagcuugcagugagcugagaucgcgccacugcacuccagccugggggacagagugagacucccaucucaaagaaaaaaaaaauuagccggguguggugguacaugccaguagucccagcuaccugggaggccaaggcaggaggacugcuugaauccaggaaguugaggcuguagugagcgaugauggcaccacugcacuucaaccuagacaagagaccccaugucaaaaaaaaaaaggggaaugaaguuguuagacaugcuacaacauggaugaaucucgaaaacgauccuaagugaaagaagccagauacaaaaggccacauauugcaugauucaacuuauauggaauuuccagaagguagaucccuagagauaaaaaguagauuagugguugccuaagguuggggaguuagggaaaagguagagagaugaggacuggcugcuaaugaguaccagguuucuuuacaggaugaugaaaauguucuaaaauugauuguggcaaugguugcacaaccuugaauauacuaaaagccauugaacuguauacuuuaaauggucgaacuguaaggauaaauaaauaaauaaaacuguuuuaagaaaaaccaaaugggacccaccaagagaaccaaaaaucagaaaccauaaaacuauugccuuacuauccaguaaugaaaaagcagucaaaaaauaacgauagacacuaauguuuauuauugagugcauaacacgccaggcauugugcaaaguguuucagcauugaguuuaagucuccuggagcacagaccgacaguauccauucucuucccuucccuuaccaagcgaaccccugaauucuagcugaauaucuuggcuauacagucuccccucaagcugaacuguagcugugggaaucaguucugguccacaggaauuaacggaagaaguguguacaauuuuugagcuaugcucuuuagaagaguguggaggggugucuuucuucccuuccuccugugaugugauggcuggauggagcuggaauggccauuuugcaccaugaggaaucugggaaugaauggcagaauggugagagaaacaauaugagccucugaggacugucgggagcagaaccucccuaucuggacucccugccaucaaauuuguuuacgucacuguuccguuuucuucuguuguauaaggccuaacauccuaauacaguacaccuccuaacaacccuaugagauagcuacuguuacggucugauuuuuaaaaugaggacacacugagaggugaagugaccugcucuguauuucacaguugauuaaugacauaacuaggguuagaagccaggccuccugaagccagaacgugccauuaggaagaacuguucuacaggcaagaauauccuguccugcugucccuuggguucaggccagccaugcacuccucaccugauguccugcguuggggagaccucaggcuucaguugcacacucaggggcacccguugcucugccagccagauggcacacuucauugccaccuguucauccccgcccgccacugcucgggugaggcucagggccauuuccucugcugaaagccaguacagcaggagccaguuagcacaggguuuauuuucaggagcugagaguaaugggguaggaaaggaggcgauccuuugugugugcugcuuucucugucuuccuggugaacuccuacguauccuucagcacccagacuaaaagucccuuucuccgggagggguucucuaauauuccccacuccuccucacacuaggcucauuugguuguuuguccuucccauucccagggucccucauauuucuauucauuuauccaacaagcaguuauugagcuucuacugugugccacccacugucccaggaacuggaaucccacagagauuuauaaacagggccccucuccuuauggaucucccugcccaguggggagacaaugaacaaguuuaacaagaaaaaaaaaaaaagucagauugcgauccuugcuggcagggaaauaaacagguuaaggagaccaggggaggccucugggaggggguaacacugaagcuaagaccugaaggaggagaagcugcacgugucaagcuccaguggggaagagugguccagguggaaggaagaguaagggccuuggccaaaaaaugguuggaugagaaccgaaggaagccaguggggcuccaguagagugagcauggcggggugacugaggacagauauccugugggccacccagggccucuggguuuuguuuggagaacacagaggggcaugggaggguuuccagcaaggcagugacugacuuccguucuacaacccuaggugcaggggacaagagaagaggcaaguaccccugcuucucaggucaacugacgucugucucccaccagcccaggaggucuccaaguucaaugcccuguguccucugcgaguccccuagccccaucucagcacagagccagcccaaggaguucucagggccccaagauggcucuggaagccagcagguaccaaaggaggaaacugauggggaggaggguagagggagggcaggcuaaagcccccucuccaaggcccuucuggccaggggcaaggccagguccugcggggcccacuucccaccggaaguuccccagccaccuccagccugugcccaccuuucuuggucuucucguccaucuggcguggcugugcccaucccccugggggggaccgugccuccugggaaaugcuaccuccgggucgccugggagaggcgggagaccaggagcaacucagccaggccguguggccuccggcgcggcccaagcccugugugugccucgcuguccccgcggcagucgggaagcaucacacugcccggugaccaggccgggauccugcguggggcggugagagggcagcgggcgccgagacagguccgcacugggcgcaggaggaaacgggaccagccgaggugggaagaagcggggaaaggacgcccggacaccacccagccggggcguuccaagucccggaggacccccacuugcgggagcgccccuggcgucccggguuucaaggcaaagcccucucuccucccgggaggccccaguucuucgcaaggggagcggcuucggcggaagagaaagugaaaguggcggccccggaaguggggcgggacugggagggggggccggaaaaauugucgccucauccgggaccuccacugcccggcuacccggcggcggcggacgccgagugcggggucccagcggucccggcgcuccuguuuggggcgaccccaccccguccuccggggcugaucgcggguccccggacucccgcccgggucacccugcgggccgcaucgcagagccgcgggaaggagcu

SEQ ID NO: 191250 - RNA, 22902 nt, Homo sapiens
agcuccuucccgcggcucugcgaugcggcccgcagggugacccgggcgggaguccggggacccgcgaucagccccggaggacgggguggggucgccccaaacaggagcgccgggaccgcugggaccccgcacucggcguccgccgccgccggguagccgggcaguggaggucccggaugaggcgacaauuuuuccggcccccccucccagucccgccccacuuccggggccgccacuuucacuuucucuuccgccgaagccgcuccccuugcgaagaacuggggccucccgggaggagagagggcuuugccuugaaacccgggacgccaggggcgcucccgcaaguggggguccuccgggacuuggaacgccccggcugggugguguccgggcguccuuuccccgcuucuucccaccucggcuggucccguuuccuccugcgcccagugcggaccugucucggcgcccgcugcccucucaccgccccacgcaggaucccggccuggucaccgggcagugugaugcuucccgacugccgcggggacagcgaggcacacacagggcuugggccgcgccggaggccacacggccuggcugaguugcuccuggucucccgccucucccaggcgacccggagguagcauuucccaggaggcacggucccccccagggggaugggcacagccacgccagauggacgagaagaccaagaaaggugggcacaggcuggagguggcuggggaacuuccggugggaagugggccccgcaggaccuggccuugccccuggccagaagggccuuggagagggggcuuuagccugcccucccucuacccuccuccccaucaguuuccuccuuugguaccugcuggcuuccagagccaucuuggggcccugagaacuccuugggcuggcucugugcugagauggggcuaggggacucgcagaggacacagggcauugaacuuggagaccuccugggcuggugggagacagacgucaguugaccugagaagcagggguacuugccucuucucuuguccccugcaccuaggguuguagaacggaagucagucacugccuugcuggaaacccucccaugccccucuguguucuccaaacaaaacccagaggcccuggguggcccacaggauaucuguccucagucaccccgccaugcucacucuacuggagccccacuggcuuccuucgguucucauccaaccauuuuuuggccaaggcccuuacucuuccuuccaccuggaccacucuuccccacuggagcuugacacgugcagcuucuccuccuucaggucuuagcuucaguguuacccccucccagaggccuccccuggucuccuuaaccuguuuauuucccugccagcaaggaucgcaaucugacuuuuuuuuuuuuucuuguuaaacuuguucauugucuccccacugggcagggagauccauaaggagaggggcccuguuuauaaaucucugugggauuccaguuccugggacaguggguggcacacaguagaagcucaauaacugcuuguuggauaaaugaauagaaauaugagggacccugggaaugggaaggacaaacaaccaaaugagccuagugugaggaggaguggggaauauuagagaaccccucccggagaaagggacuuuuagucugggugcugaaggauacguaggaguucaccaggaagacagagaaagcagcacacacaaaggaucgccuccuuuccuaccccauuacucucagcuccugaaaauaaacccugugcuaacuggcuccugcuguacuggcuuucagcagaggaaauggcccugagccucacccgagcaguggcgggcggggaugaacagguggcaaugaagugugccaucuggcuggcagagcaacgggugccccugagugugcaacugaagccugaggucuccccaacgcaggacaucaggugaggagugcauggcuggccugaacccaagggacagcaggacaggauauucuugccuguagaacaguucuuccuaauggcacguucuggcuucaggaggccuggcuucuaacccuaguuaugucauuaaucaacugugaaauacagagcaggucacuucaccucucaguguguccucauuuuaaaaaucagaccguaacaguagcuaucucauaggguuguuaggagguguacuguauuaggauguuaggccuuauacaacagaagaaaacggaacagugacguaaacaaauuugauggcagggaguccagauagggagguucugcucccgacaguccucagaggcucauauuguuucucucaccauucugccauucauucccagauuccucauggugcaaaauggccauuccagcuccauccagccaucacaucacaggaggaagggaagaaagacaccccuccacacucuucuaaagagcauagcucaaaaauuguacacacuucuuccguuaauuccuguggaccagaacugauucccacagcuacaguucagcuugaggggagacuguauagccaagauauucagcuagaauucagggguucgcuugguaagggaagggaagagaauggauacugucggucugugcuccaggagacuuaaacucaaugcugaaacacuuugcacaaugccuggcguguuaugcacucaauaauaaacauuagugucuaucguuauuuuuugacugcuuuuucauuacuggauaguaaggcaauaguuuuaugguuucugauuuuugguucucuuggugggucccauuugguuuuucuuaaaacaguuuuauuuauuuauuuauccuuacaguucgaccauuuaaaguauacaguucaauggcuuuuaguauauucaagguugugcaaccauugccacaaucaauuuuagaacauuuucaucauccuguaaagaaaccugguacucauuagcagccaguccucaucucucuaccuuuucccuaacuccccaaccuuaggcaaccacuaaucuacuuuuuaucucuagggaucuaccuucuggaaauuccauauaaguugaaucaugcaauauguggccuuuuguaucuggcuucuuucacuuaggaucguuuucgagauucauccauguuguagcaugucuaacaacuucauuccccuuuuuuuuuuugacauggggucucuugucuagguugaagugcaguggugccaucaucgcucacuacagccucaacuuccuggauucaagcaguccuccugccuuggccucccagguagcugggacuacuggcauguaccaccacacccggcuaauuuuuuuuuucuuugagaugggagucucacucugucccccaggcuggagugcaguggcgcgaucucagcucacugcaagcuccaccucccagguucacgccauucuccugccucagcuucccgaguagcugggacuacaggcgcccgccaccacgcccagcuaauuuuuuguauuuuuaguagagacgggguuucgccguguuaaccaggauggucuccaucuccugaccucgugauccgcccgccuaugccucccaaugugcugggacuacaggcgugagccaccacacccagccacaccuggcuaauuuuuagaaagucuguagagauaaggucuugcuuuguugucugggcuggucuugaacuucuggcuuaagcagucuucccaccucagccucucaaagugcugggauuacaggugugagccaccaugcccaaccagaacuuuauuccuuuuuauugccaaauaauaaucuauuguauagacauaucucauuaucuuuacucauuaaaucaguugauggacauuuggguguuucuauuuuuuggcuauuauaaacaaugcugccgugaacauuuguguccaacuuuuuguguggacacguuuucauuucucuuggauacacacuagcaguggaauugcugggucauacaguaacucuauguuacuuuuugaagaaaugccagacaguuuuccaaaguggcugcaccauuuuacauucccaccagcauauaugaggguucuaguuucuccacaucaucucuaauacuuguuguuguuuaucuuuuugauuauagccauccuaguaaguuugaagagguaucucacugugguuuugauuugcaauuuccuaaccauuugaugacaaaugauguuaagcaucuuuucaugcacauauuuucuuuggagguuugccuauucaggucuuuugcccauuuuaaaauuggguuuaucuuuuuuuuuuuuugagauggagucucgcucugucacccaagcaggagugcaauggugcaaucucggcucacugcaaccuccgccucccagguucaagugauucuccugccccagccuccugaguagcuggauuacaggugcccaccacuacacuggcuaauuuuuguauuuuuaguagagacgggucuuaccauguuggccaggcuggucuugaacuccugaccucaggugauccacccaccuuggccuuuccaaaguguugggauuacaggcaugagccacugcacccggcuggguuuauguuuuuauauugaguuguaggaguacuuuauucauuuuagcuagaaguacuuuauucauuuuagcuuaucagcuacaugauuugcaaaaauuuucucucauucuguggauugucuucucacuuuguugaugguauccuuugaaccacaaaaguuuuaaauuuugaugauguccaguuagucuauguuuuauuuuguuguuugugcuuuuggugucauaucuaagaaaucguugccucauccaaggucaugaagauuuaccucuauauuuucuucuaaagauuuuaugguuuuagcucuuacauuuaggucuuugguccauuuugauuuaauuuuuauauaaggugugagguaaggguccagcuucauucuuuugcacguggauauugaguugugccggcacuauuuguuaaggcuguuuuccucuguuuaaucaucuuaacccuuuuuggaaauuaauugaccauaaaugugagugcuuauuucuggacucucauuucuauaccauugaacuauaauauauaucugcccuuacgccaguaccacacuaauuacuauagcuucauaguauuugaaaucaggaaauacaaguucuccaacuuuuguucuuuuucaauauuguuuugguuauugcaagucucuugaauuuccauauaaauuuuacgaucagcuugucuguuucugcaaaaaaaaaacaacaacaacugggaauuuugguagggauuucauugaaucuguagaucauuggccacuugauuuuaaacaaaauauugagauaucuacuucuugaaaugauugcuugagacaguaccuguguacuccuugcuaugaaaaaugaggaaguuaacauacucaucuuccaccuuuccuuuuccuuacuuuuuuuguugaaguaucauuguggacacuuucccaguugacuuccacuugauccccugaauuaacuaacuggcacuggcguuuccuuuguaaaauguacaaugucagccaccaucuugcuacuaaaguguggccuguggaccacaacauggggggaaucucaggucucaccucagacuugcugggucagaaccugaguuuugagaggcucugggcaaccggcaccucucagaccugcuguuggguucucaucgauggacccgaugcuuccuagcaaaugauaccuguuguauguguuauugguaauaacauaguuuacuuagcuauuacauuaauuaauaaaacaugagcgcugaaagaguuguuucugugaaaauaagcugauugcuuuaaaaagauaagagacaaaucaccaaaaaaaaaaaaaaaaaagauuaacacuuuugggugagacaguaguaaggaaauacaguaaaaauccagaagggcucugugcucugaugcuucaggagugugucuaaguucuugcucgcuuuaaagaagcugcuacuagaaauuauagaucaugauuaucgaugugguucauacaaaaaaaaaaaagaaaaaucccugggaaacuccaaugagcagguauaaacucacgcugggcauggcggcucagcacuuuggaaggcucaggcaggagaauggcuugaacucgaguuuaagaccagccugggcaacauagugagaccuugucucugcaaaaaauaaaaaaaauuagccaggcuggguggcacacaccuguagucccagcuauuugagaggcugagaugagaggauuauuagacccugggugguugagguugcagugagccaugaucaugccugagugacaaggugaaacccugucucaaagaaagaaagagagaaaagccauuggcuguacaccuagagacuggccagugaauaugcauuuauaguauguaaguuaaaauuaaguguuuaagcuuugucugcagcuguuuuugugauucucugcuguucaccagcgauccugaugucacauuggaugagagagcuccagcuguauuuuuuuguugauaguguuaagauuauagcuuuaaaaaauuuuguuuucuaacauaauuaaggccuuuaugcuuugccucuagguugauucuaaaaguguaacacuacuagaaaggauuuauaguauuuugauuauggaaauauuauucacuauagaauaacuagugcaguugaaaccauaugcacuuuuauguuucaaaacccuuauugcuggaagaacauuuugggguuaagauccaguccuuuucauuuuuuacuuuucuucuauucuccuguaucagacucaucuauuuuuguuuuucaagaacuuuucacguggaaaaugugguaaacuuuuagagucuuugcauguuuaaaaauuucuauauuuugcucugucaauucauugauaguugacuggguauucaaauuguuuaccugaagaauuuugagagcauuuucuggacugcuuuuaaauaaauuucagauauuauuuuauccuuaaauacuuuaguaugugucuucaaaaaauuaggacuuggcggggcacgauggaugaugcuuguaauccuagcacuuugggaggcugaggcagguggacugcuugaacccaugaguucaaaaccagccugggcaacauagugaaaccuugucucuacaaaacauuagcuaggcaugguggugcgcccaucuagucccagcuacccaggaggcugaggugggagggucaccucaguccaggagauugaagcugcagugagccaagaucaugccacuacacuccauccugggugacagaagugagacccugucucaaaaaaaacaaaaacaaacaaaaccccucaauacuauuaucacaccuuagaaaaggaauaagaauuccuuaaaauccgcuaaugcccuguuuauauucacauuuuccuauuucauuagugcuuuuuacaauugguuucuucaaaucaggagccaaacaagaucuacauguagcauuucuuacuaugucuuaagucccuuuuacucuccucuauuuuuaugccacuaguuuuuuuuuuaagaaaccuggucuuuugaccucuagaauuuuccccauauucuggaucuauccauuaccucuucaugguauguauuagaccacucuagcauugcuacaaagaaauaucugagacuggguaauuuguaaagaaaagagguuuaauugacucaguucugcaggugguguaggaagcaugguccugacauuugcuuggcuucuggggaggccucagugaacuuuuacugaagcgggagcaggcacuucacauggugagagagggagcaagagagagaguugguggggaggugccacacuuuacaacagccagaucucacgaggacucacuauggcgagaagucacuacagugagcgcagcaccaggcugugagggagcugccccuaugacccaaacaccucccaccaggccucaccuucaacacugaggauuacaguucaagguaagauuugggcagggacaaauacccagacuaucauggugucauuuacuaucucccguuuuuccuguaacugguaguuagagauaaaguuucaauuagucagcagucacuuuuuuuuuuuuuuuuuuugagacagaguuucacucuguugcccaggcuggagugcgguggcgcaaucuuggcucacugcacgguccgccucccggguucacaccauucuccugccucaaucuccugaguagcugggacuacaggcgcccgccaccgugccuggcuaauuuuuuuuuuuguauuuuuaguagagacggguuuucaccguguuagccaggauggucucgaucuccugaccucgugauccacccaccucggccucccaaagugcugggauucagcagucacuuuuaaugugcaggaacucuuccucauuuuuugguugcuucaugccuuuccuugcuuucugaaugcaguguuuucccaaaucucucugaagguacuaguuagacuucacuguugcuuauuguuccauacccuaaaugaucucuguuuccuuuggggucgguucuguuuuuucaucuuuucaugcuuuugauuuuccaaacauguuggaggauccucaagaaaguuaaaaccacuuucucuggaauaauaccauguagauuuaaauccugccucuggcugaacacaguggcuuacuccuguaaucccacuucgggaggccaaggcaggaggaucacuugaggccaagaguucaagaccagcuuuggcaacauagugagacccugucucuacaaaaacuuaaaaaauuagccaggcaugguggcaugagccuguggucccagcuacuugggaggcugagaugggaagagcccaggagguugauacugcagugagccaagguagcacuacugcacuccagccugggccacagaaagagagccugugucuuaaaauuaaaucaagacauacaaaugaauccugccucuaacaguuauuaguugcuuaguuuggcagagucacuggaaccuaucugugccucacauuuuuaucuguaaaacagggauacagcaguaccugucugauggguugguugagaggauuaaaugaguuaauacacaugaagugcauuaaauagucuuagcacguaguuaacaacaacuucuggugguuucacuaaggagcaggggagagaagacagaagagguuggagaggucagggaggugccagaucauggaggcccucgugugcugccacgaguugauucuaagaguagcguggagccauuggaggggccuaacugguggguucuaauaaaggaagaagcauggguggggccuaccccagacugggguuugugugugugugugugugugugugugugcauggccaugugccugugugcaaauauguacaugucuguagccgguggcugaggcuggaccccuggccagagcccaugcugagccccugcuguucucugcaggcugugggugagcguggaggaugcucagaugcacaccgucaccaucuggcucacagugcgcccugauaugacaguggcgucucucaaggacauggugagugaggaggcggagggcgacacuggggugaaggcucucccuuucacuccugcuuccucucucuccucuggcccucccuucccacucucccucucuuugcccccaccagguuuuucuggacuauggcuucccaccagucuugcagcagugggugauugggcagcggcuggcacgagaccaggagacccugcacucccauggggugcggcagaauggggacagugccuaccucuaucugcugucagcccgcaacaccucccucaacccucaggagcugcagcgggagcggcagcugcggaugcuggaaggugaggcucugcccugagcaccgccggacccagcgggggcccuggacucacuugagggcauagggcaagcaggggcagagccccuggguuuuuagucagggacucacccagaggacccuauccaaguggggaagagaggaccuaagacacaugggagggagcauuucagggacccaucaugagaacagcuggcacggggagggguggacuccguccaggcuccggcauucccagcugugugaccuugggcaagguugcuccuaucugcugcccaguuugcuaaaaucauaaauuggguaugacagugaucgugauaacuaguguuuauucuuaauuuuuaacuucugaaauguuucagaccuacagaaaaguugcuaaauuuuacaaaguaguacauaaagaauucccauguaccuuucauguggguuuuaccacaugugcuuucuuuuuuuuuuugagacggagucucgcucugucgcccaggcuggagugcaguggcacaaucucggcucacugcaagcuccgacucccggguucacgccauucuccugccucagccuccggaguagcugggacuacaggcgcccgccaccacgcccggcuaauuuuuuauauuuuuaguagagacgggguuucaccguguuagccaggauggucucgaucuccugacuuugugauccgcccgccucggccucccaaagugcugggauuacaggcgugagccaccacgcccaacccacauuugcuuucuuuuaucauucucuuucuauauaaaauuauuuuuuuucugaaccauuuugagaguaaguugcagacaugaugucucuuuccccuaaauaauucagugugcauuuccuugaaaagaaaggucauuuucuuacauuacuggguauaacaauccaacucaggaaacuaacgcugauacaguacugguauccagucuacagaucuuacucagauuuuaccaguugucccacuauugucauuuauagcaaaagacuuggcauucugcugucaugucucagucccuuucaaagaguccaggccaguuucuuuuuuuuggcggggguugggggcugauguuuccuccggaguggaucaagucacuguuuuggcaggaccgccucagcggugcucuugggucccucuuggugcauccuucaggaggcacggaagggcugguguugugcuggguuuugaagcucaaaggacauagaagcauuuaucgguggaauagggacccugacccugggggagccaggaugcccacuuggccagauggaagcuggagguacccccagggaggagggagaggauagggggagggucugccuggcuggcucagggagacccacccccauggguguggaccaagugggccgcguggaaccaccacccuuuaacccuccuccacagaucugggcuucaaggaccucacgcugcagccgcggggcccucuggagccaggccccccaaagcccggggucccccaggaacccggacgggggcagccagaugcagugccugagcccccaccgguaagcuguccuuggccucaguauccucuucugugccccucccuugccucacccugcccagucgggcucacagcacccucugcucccaggugggcuggcagugccccgggugcaccuucaucaacaagcccacgcggccuggcugugagaugugcugccgggcgcgccccgaggccuaccagguccccgccucauaccagcccgacgaggaggagcgagcgcgccuggcgggcgaggaggaggcgcugcgucaguaccagcaggugggcgggaaagucccuggacagacaccugcagaccgcacgggggagguguaggccaggaagggagacaccugcgcacugccgcgccucuccguuacugccuugccccucccaaccaugcugcuggcagugacccugcaccuggcugugacccugcaccuggcugugaccugcccucucucaaaggucacccuguggcugagacccgcucccuggcuguggcgcacauccagguucacaugccccacucccacgugggcuguggcuccauccccagcuuugacacaccacacgaguauggcuggccaugaccccagcacccuagccaugaccccagcacccuagccaugaccacaccucagcucggaccucacccccacccgucugugaccuaagccugcuccaccucgccgugaccucacccuggacucuccuacuccugaccucuucccucucgggcugggcccaccccugacuuccugagagccuggccuggacccucgcugcgcccuagggggaugacccccgaccccgguccuacgccuuagcccuaccccgcccccaucgugacacacgcacuaaugacacagacauugauccccgagugcuccccauucugaucucaccccuggccccaccugcauuccccuuggacccggugcugccccuggccaccccacuccuguucccgucucagcuccucggcuucgucacuuccccaccccugacguugaguggcuccaccagcccuggcccgggcccugcccugcuaccugacucaccacucagaccccggcccccuuccuuaccuugcugccauugcugucucaccuggcgccuuccguggcuaccuggccggccuccccucccuuggcuuccccaccuccaccuggccucacucccagccccgccccucccaaccugccugcuccugcccaucccccaccccccaccccccaucccccagccccacccccaucccccacccccgucccccaucccccaucccuacuggcucccagcuuugccuguggcuggucugacccagcccugaccacgcccccuggcccuucccccuucggggucugacccgcccccgaggcccugacccgccccguggccccgccccgugugcccagcggaagcagcagcagcaggaggggaacuaccugcagcacguccagcuggaccagaggagccuggugcugaacacggagcccgccgagugccccgugugcuacucggugcuggcgcccggcgaggccguggugcugcgugagugucugcacaccuucugcaggugcggcccccagucccacccccggcaaugcagcuuaaucaaagccgccaauuacgcagggcuggacguggguggggcccugugcucugauaccucauuggacgcccgcgaaaaccuacgagguaggcuccgucuccccauguugcggacgaggaaccugagggaaagagaggcccagcgccuuaccccaggcccacggcucaugagagaagcagccuagacgugagcgcaggcguggggggagacucccuuccccucuaccuuucgccgcccgggcuccugcagccacgcugcucucagccucgcugugggcaucugccaguuucugagucuccugucauggcccccccaccccugaauguggggaacacagacccgcucaccacagcggacccuuguggagccgccccugggugacaggcuccgugccugccuccugcagcuuacauuccagcagagaggcugaugagaaucggauaaucgcugguugaugucuuugugaauugugucaaaugcuacauacaguacauuaagagacaacaggaguccuucccagagaggguggucuggaagcuuccaaggagguagccccagagcagggaccggaaggccugcuguagguguggggugugggccuggccuguuggaggagacugaggaggucucuugguggcuggagcagagggaugaaggggguaaucagagcaggauagagagguguuggguacgugagcagcagugaggaguugggauuuguucuggguaggaugggagucacuggggagacauggcugcuguucugagauagacucuaggggccagauggaugcagggagcccagcgaggaggcuccuggagucacccaggugggggauguggggccuggaccagagaaucagagcggcaguauggaggcaggguggaggccuuggugauggguuggugagagggaugggaaggaaggagauauugaggagaaguccaccuggggugacugagugaggccccuggggucaggccuugccaugugagggauggaguccccagugaaggggguuccuaugauccuaacucuuuuccccuccccuccccuagggagugccugcagggcaccauccgcaacagccaggaggcggaggucuccugccccuucauugacaacaccuacucgugcucgggcaagcugcuggagagggagaucaaggcgguaaggccucagggugggagacauaccccaagucccaacuccuaaggaacugggcccugagcaggcagcagacaucuuucuuuucuuucuuuuuuuuuuuuggagauggggucucacuauguuguccaagcuggucucaaacuccugggcuuaagcgaucauucauccucagccccccagacauuuuucaagagcuuuguccaugugggguguugagaccccaagcagaaaaagaauugaggggaguagcuagucaagaaaccacaucuaugaaggaaggacagcagaguuguuaagaaucagggacucggcugggcguggcagcucacaccuguaaucccagcacuuugggaggaugaagugggcagauugcuugaacccaugaguuccagaccaaccugggcaacauggcaaaaaauauucaaaaaauagccaggcgcgggggcaugcgccuguaguccuagcuacuuggguggggucugggaugagugggcugaggugggaggauugcuugagccuaggaaguaagguugcagugagcugugauugugccacugcacuccagccugggcaacagagugagaccuugccucaaaaaaagaaaaaaaaaauuagucagggaacucuggagccugguggccugggugugugaccacaagucagauauuuaaccucucuaugccucuaucucaucucuguuagagucagaguuacagcuucuauuuccaggauugcaaagauuacaguagaggauauguguauagaauucauaguaguacauccaggcgcaguggcucauuccuguaaucccagcgcuuugggaggccaaggcggguggaucaccugaggucgggaauucgagaucagccugacuaacauggagaaaccccaucucuacuaaaaauagaaaauuagccgggugugguggcgcaugccuguaaucccagcuacucaggaggcugaggcaggggaaucgcuugaaccccggaggcggagguuguggugaacugagaucgcgccauugcacuccagccugggcaaccagagcgaaacuccgucugaaaauauauauauauauauuuagaguagugcuugucacauaguaagccuuuguuguuguuagcgcuuacuguguaacaaaucacugcaggcucaaaacaacagucauuuauucagcucauaaaucugcaaguuaggacaguuggcccucuguaucuguggguaccacacuggagaauucagcaacgguggauagaacauauucuuacaaaaaaaauuacaauaaaaaacaaauuuaaaaaacaauacagcauaaacuauuuguauaacauuuauguuauauuagguauuauaaauaaucuacagaugauuuaaaguguaugggaggauguugguagguuguaugcaaauacugcacuauuuuauauaagggguuugagcauccauggauuuggguaucugcaggggucuuggaaccaauucucuggauaccgagggaugacuauaauuugggcuggacuuaccuggaugguucuucuggucugggcagggccucgcugauuucaccugggccuggcuggugggucagccgcgguggccugguuuauaauggucucaucugugaugacugggaugacuggggccuccuuccacuucaaugucucacccaccagcaggcugcccgggccuucucaugucaugguggucucaagguuccaagagcagccauggggagccccagugcauguguacuuucuaagucugcucauuucucacuugacacugucccauuggccaaagcaagucccaugcucaagcacagaguccauugggaagggaccacccaaaaguguggaaucggggagacagaaacaaauuggagucaccacuccgccagucugucacagcguuaugugugucugcauacgugugugcuugccgcuggcgcucuucaugaauucguuagcagguucucugccuggcugcuggugaucucgagcaaguuguuucccuucugugggacuccauuuccuuaucugaaaaguggacaguugggcuugauucaugguuuucaaacugcugggaaaugaccuucccagacuugggcacuguggguucccaggccaaaacauggcagccgaggcccaaaugggagauccccacaaaacacauacacagaccuccucuuuauuucuguccccccugccucucuccuaugccccuauuucuccugagaaugcucccaacuucaccaaguguuuauggagcccaagagguucugccccuggggaaaagggggaggcagaagagguagaacuuugggaguucacagcucugauaucaggagcagccccauuuuucucuguugucucugggugguugcugaggcuccuucgcucuggccuggagagaccucaugaccagucauuccauauguccccagcacccauagccauuugcuuagagguuucccuguggaguccaccccagccaaggggcauuaugcuggggccagguucaugccaaagggcugcaugaacuucccuggagcccacuggaguugaugugagucucagaaaauggucaagugugacagagagaaggaggcagggaucagccaaguaauguaguggagguuguuuuuacaaaaacagaaaaauaugccucaccacauagaaccagagcagaaaucagagagaaaaucacccacaaacccaggaaauccuccaauugcauuuuaucuuauuuccuucaguaucucugggcaaauuuuuuuuuuuuuuccuuuuugagaugaagucucacucugucauccaggcuggagugcaauggcgcgaucucagcccacugcaagcuccgccucccggguucacgccauucuccugccucagccucccaaguagcugggacuagaggcgcacaccgccaugcccagcuaauuuuuguauuuucaguacagacgaguuuucaccauguuggccaggcuggucuugaacuccugaccucaggugauccacccaccucggccucccaaagugcuaggauuacaggcgugagccaccgugcccagccagauaugauuuuuuaagucaacuuuacuuaaguauacuuugcacacaauaaaauguacucauuguaaguaugcagucagguaaauuuuaacaaauguaacucucguaaccaccaaccacuguuacauauaacauaggcaugauuucugccucauuguaaccagcauggauacaaucgcuuuagcuuuuguuauuuugcuauagaauuuuucuaaagauuauuacaaaucucaauagcacauauacuguuuauaccucuuaguucuaguuucucaguuuguaauacuccuucaaggaauguuuugcaugguguauucuuuuuuuuuuuuuuuuuugagacgaagucucacucuguugccuaagcuggaguacauuggugugaucuuggcucacugcaaccuccaccucccggguucaaacgauucuccugccucagccucccgaguagcugggacuacaggcagaugccaccacacccagcuaauuuuuguauuuuuaguagagaugggguuucacuauguuggccaagcuagucuuaaacuccugaccucgugaugcgcccgccucggccucccagaguguucagauuacaggcgugauccaucauuccuggcuggugcaucuuauauauuauuuucuugggauaaaguuaaagaagugggauggguaccaaagggucagaaaaguuugggaugguugaaacguuauugccacauugcuuucucagugcuacguacuagcuuacuaguuuguuuaauuuuuauuuuuuauuuuugcggguacauaguugguguauauauuucugggguacaugaaauacuuugauacaggcaugcaaugcguaauaaucacaucauggagaauggggaauccauccccucaagcauuuauccuuuguguuacagacaauccaguuaaccucucuuaguuauuauaaaauguacaauuaaauuauuggcuacagucuguugugcuaucaaauacuaggucuuacucuauuuuuuuguaccaauuugccauccccacuccccugccacgccucacuacccuuugcagccucugguaagcauccuuuuacugucuguccucauuaguucaguuguuucgauuuuuagcaccugcaaauaagugagaacauguaauguuuguuugucugugccuggcuuauuucauuuaacauaaugaccuccaguucuuccauguugcuguaaauggcaggauugcauucuuuuuuguggccgaauaguacuccauuguauauaugugccacguuuucuuuauaggauacuaguuuaaucaugucuuucccaacauugcuuauuauuuauguucuuuucuuuauugugagaaaauagacauaacauuuaccauuuuaaccaguuuuuaguauacaguucaguggcauuaaguacauucacacuguugugcaaccaucaccaccauccaccuccagaacuuuuagaaauuccccccacuuucuuucacuuucuuuuuacuuuucuuuuccuuuuuuuuuuuuuuuuuuuuuuuuuuuuagcuaggauuucauucugucacccagguuggagugcagugcaucagucauggcucacugcauccuugaccuucugggcucaagcgauccucacaacccagccucccaagcagcugggacuacaggugugagcaccacaccugguuauuuuauuuuuuaaaaaaauuuuuugguagagaugaggucucacuguauuucucaggcuggucugaaacucuuggccucaaggaauccuccugccuugacugaccucccaaagugcugggauuacaaguguaagccaccacaccuggccuaaaauccacucuuugaauggaguuuuucaacacuaugaggauuacaugaagaaaagagccuggggcuggguuggaguuucugggcugggggcuuucuggaggguauuuaguggucaagggucauaugucagguguucugaauccugagcagcaaggacaugguguguuggcagcuccugaccccugaggauuaccagcgauuucuagaccugggcaucuccauugcugaaaaccgcagugccuucagcuaccauugcaagaccccagauugcaagggauggugcuucuuugaggaugaugucaaugaguucaccugcccuguguguuuccacgucaacugccugcucugcaagguggggccugcagggacuccccccaccuagucacugucaucuugccuggagcucaccacacugcagugcguguucuccugggaagggagcugugacacuggccugcuggucaugacuuagagcuacaugucagugggagaguguggcuugagccugaacugagcccuggccccacagacggagucccagccccagccccagauggagccucaaaccuaggcagcccugguucacaauggagccccgacccugggccagucugaccccagucacagacugaaucccagucccacauugagcccugaucccauccaaguccauagacuuggccucugaccaaaccugacccugcacuugucacuuaagguggucccauauucagcucagacccugaaccgagcucugacccuggcuucugacugaaucugugacagacuaaggccugacccuggcccuauaccacgucuccacccguguccucaacugagugcugaccccaaaccuagacagcccuaccugauccuucccccaggccuguccccgccgcuucaucucaaaaguugaaggugaggagccgguaaacaggucuggagccuggucucagacucagccugagcaagcucagucuggggucauugggccuguaaccccgggcaggcccuuguuagggaugcagggucucacccuagggguauaagggauuucugugcccaucagaacuuaaauaagcuggguguggcagcacaugucaguggucccagcuacucaggaggcugagguauauuuugcuguuagcauaugugaugaccuugacuucaccucccuggcgccaauauccucuucuguaaaauggcuuaugcauuacaaagugagguccugccagugacuacaccuagaggcauuaagugccuuuguggacuccugcccugcaccucaccucucccagcuucuuaacccccugaggaaccuucuuaccuugagucccucacccgcuacaggccauccaugagcagaugaacugcaaggaguaucaggaggaccuggcccugcgggcucagaacgauguggcugcccggcagacgacagagaugcugaaggugaggcugggacagggccgaggccuagggauuuuaaguucugggauccaggugggggcugggggcuucccaguaagggcugugcucacacaucccuggaggcucugaccucccuucuggcugucacucccauccggaggugggacuuaggccgaauggucaugucaggaagagcgucuggguggaggguggagaccacaggaaugaagaggggguugcuggauggagccuggccuggcagagccacacaggagagacuccacagcucuagagggucaccaccuucucccugccauggggaggggccaggcugggugacugccccagccccgccccagggccagcaccugccccacuccaggugaugcugcagcagggcgaggccaugcgcugcccccagugccagaucgugguacagaagaaggacggcugcgacuggauccgcugcaccgucugccacaccgagaucugcugggucaccaagggcccacgcuggggcccuggggugagucuuugcucguggugguguggagagggugcccuugugggcuuugccuuagaggagggcugggaaaacuacagcccaugggccauauccaacccagcaccugaauuuguacagcucccgagguaagaauuuuuuuuuuuuuuuuugaaacggaguuucacucuuguugcccaggcuggagugcaauagcacaaucucagcucacugcaaccucugccuuccggguucaagcaauucuccugccucagccucccaaguagcugggauuacaggcaugcgccaccacgcccggcuaguuuuguauuuuuaggagagacgggguuucuccauguuggucagacuggucucaaauucccgaccgcaggugauccaccugccucggccucccaaagugcuaggauuacaggcgugagccaccgggccgcaagaauguucuuuacaucuuuaaaugguugaaaaaauaccagaagaugacuauuuugugacgugaaaauuacaugaaauccacguuucaguguccguagguaaagugcuuuggagcacagccguguucauucauucacauguuggcugugguugcuuuuacacuacagaggcagaggccguauggcugcccggcccaaaaugacuggcccuuugcagaaaagguuugcccacuccugcccuagaggacagcaaguaaagguucgaucuggagucagagguggauuggccccuggcucuggcacauacugacugugugauuaggcugccugccacucaccucugucagccccauuuccucugugaaauggagaugauagcugggcuuaucucaggcuuguugucagaaucaaguggaaaaauugcaagagaagugcuuagagagccugucacuuggugagcacccuugcagaugguagcugucguuauuaggggugugcucuggaauugggggccuguugcuacguucagguagacuuucagacagguggaggcagaggaaacugcccucucgcaugcugacaugucuagaauaugcagaguggucagauccucucccuggccuguucccggaucuaggcguggguagacugagugcugugggagcccagaaaaggccucagugacucuccaucagguagcugaggcugaccaggccauucuugcaggaggaccugcagaggcaaaggcccggggugggagagcgcucggcugugggggcagucucugcacugcgcugacauucucuucucuuccucccauccucuagggcccaggagacaccagcgggggcugccgcugcaggguaaaugggauuccuugccacccaagcugucagaacugccacugagcuaaagaugguggggccacaugcugacccagccccacauccacauucuguuagaauguagcucagggagcuucguggacggccuugcuugcuguagcguuguaggggcccugccugcacugcgguuguccacggucacaucugccccagugccuuuguccuucccuuggggcuugccggccagacuucucuccccugcggcucccaccucugccugaccccagccuuaaacauagccccuggccagaggccuugcuggguggagccucugugugacuccauacuccucccaccacaacacucaucugucaaacaccaagcacucucagccuccccgccuucagcugucagcuuucuggggcuaacuucucugccuuugugguuggaggccugaggccucuuggaacucuugcuaaccuguucagagccaggaaggagacugcacaguuuugaaagcacagcccgucagguccggcucugcgucucccucucugcagccuguguaagcuauuauaauuaaaaugguuuuccgggaa

SEQ ID NO: 191251 - RNA, 16896 nt, Homo sapiens
uuauuucauaauucuccuuuauuaggcacagguaaacauacauacucaugguauccaaaaccuagaguauggaccugggauuguggaccccaaguguccccagaagagucccaccugggacuuuccagguggccacaggacagacccugccuaauccugucccucaaccuuggugcucaggucagaagccccaugguugacaggccuggacccucauuccagaacagucuugaguuagacaagaacuagccucauaguuuggauucuuaucucuggcccaaaucccaggcuuaggccuggaaggagaaucucuuaaucaagaggacagagaugcugggaacacaguucccagagugagcugggcuuggguccugaguugcaggggagaggccuggagccuuuggcacagggauaccucccuuucucugaaaagguacaagauacaaaggcagcugguuuguuugugaaagggauuguccuuggacagaggugccugagcaccagcaucaguggaggccgacacugguacaaaguguacccaguguagacagugaccuauggucauggaaaaguguugucagcucaaggaugccaguuugucaucucugugagcagggaauauugucuccuuugcucacugcuguacucccagcaccgagaacagggcuuggcaccugauaagcacccaagcaggaacugcauguguguggaacaaagcagauguguacacagcacacuccacacaggcuucugccuuucucccuucuggaaggcacugaagguuuggcucaguucagaggcaggagaaggcuuggagcuacccccaaacucaauccacuguuggcagcugagcguguaguagggugguccuagccauacagaaccacuucucugucucccuccucuucccuggcuucguccagccccaguccaucagggaccaccugggcagccucccagagaugggaucggguuggggcuaagggcaucggguccugucgcagccaggggugcaggaggaugccuguggcugugagccguucagcuggcucccgacgaaggaggcagcgaaccagacagcgggcaggggccgagaggccugcaggcaaggcguaggccccgcggcggaucuugccgaagagcaggacaggcuccgaguccuggaagggguaguggccggccagcauggugaagagcgccacgcccaggcuccagacaucggcugccuugcccgaguaugaggcccgugagcugaguaucucaggucccacguaggcugggcacgcgugcuugucccacagggaaucaucuggcccagucagcacgcaggaguccuccagguucuccagcaccagcuucuuccugggacauggggagaaacagaagggucagguccuacccagaacccccaugccaccaccccaugcuaucacccuuguggcacccacuuuccaagugccugcuggccuuugacagacacaagccaguccugugaugucugauccuguuuuacagauacccaagcccaggcucagagagguuaagucauuuaaggccacagagcaauuaaauuuaaacuaaaauucugaaaggaauacauuuuucaacagagucccuuggggagggggcugauggggcugagaggguuaagccucucuuaaaccagcuacaaacuuaggguccaggcagguaauaagaugagagaaacaggaagugugccugacaucucagcacaagcgcuaccuaaaaaggguacacaacgcauucuaggguuuaccaagugccugcuguguuccuggcccuugacccagcucauuaccuggcucaccucauucuaucuaggcuacagccugcaaggaagacaccauuuuacagcuguagagcaugggccugggaugggaacgcuggcuggcagauacucagagccagugcugugacccacccucgcaguucccaagauggccccacauucccauuguuuuccccaagagaagccaggaauuguauuuuaaugaaaagguccccauuuaaaaaauauuggcaaccaguuuauauaaaaaacacaaacagguaagcagggcaaaaaaaaaaguguguaaggcugggcgcgguggcucaugccgguaauccuagcacuuugggaggccgagguagggggaucacuugaguucaggaguucaagaccagccugggcaacacgguaaaaaccuaucucuacaaaaaauacgaaaauuagcaggcauggugauucgcaccuguagucccagcuacuugggaggcugaggcagaaggauaugacuugagcccaggagguggcgguugcagugagcugagaucgcgccacugcacuccggccugggugacagagugagacccugucucaaaaaaaaaaaaaaaguguguccugccauuugcaauuucuacuuuaaacaacuuccacugagcacucaaagaugacuuuaauaguaaucauucuauuaccacugcuauuaguuucuucuuuauggcauuacuuccuggguguccaguggcauuucacaaauacugaccaauccuaugaaucacaguauugggggacaaggggugucagcauuauuagcccauuuuacagaugaagaaacaaaggcucaggcaggugaagucauuugcucagggccaaaaagcagguaagaagcagaacccaggauuuaaacacaggucuaucuaacucacggucccucuucuaccaaugacucucaugugauuuuucuuuuuuuuuuucuuuuuuuucuuuagagauagggucucacucugccacccaggcuggagugcaguggugcaauccuaguucacugcagccucaaacuucugggcucaagcaauccuccugccucagccucccaaguagcugggaucacaggugugcaucaccacaccuggcuaauuuuuauaaauuuuuuguacagaugggguuuucuguguugccuaggcuggccucgaacuccugggcucaagcaguccuccuacuuuggcuucccgaagcacugggauaacaggugugggccaucaagugacuucuugaaaagagcaggaagcacgcugucuccuccaggagguccgggguaguuguaucuacccuaagccuaaaauguguuugaaguuauguacuagcuuaaacaucauuauaaauguuacuucuuuaaaaaaggcaugcuuguucuaauauaaaauguagaaggaaauauuaacagaaaaucagccuugggggcugggcgcagcggcccaugccuauaaucccagcacuuugggaggccaaggcaggcggauuucgagaccagccuggccaacauggcaaaaccccaucucuacuaaaaauacaaaaauuagccaagugugguggugugugccuguaaucccagcugcucaagaggcugaggcacgagaaucacuugaacccgggagguggagguugcagugagccgagaucgugccacugcacuccaaccugggcaacagagcgagacucugucucaaaaaaaaaaaaaaaagaaagaaagaaaaaaaagaaaaagaaaauuagacuuaggcaagcaccacaauaauaacugcuauaggcaagauggauggcugcuaaaauuagugggugaaaguugaggaaaaacaggauauuuauaugccuagcuuaccucccccaagguauuugucaauuacaaaggguaaauuaggaccuuacaguagagaaaccugguagguccugcccuaaccaagugaucaaggucacgacauaggaaugacuaucagcucaaguaucucuugauaugauguggagaggggccuaucgauucuguguuguucuugccaaaaauacauaacugcaaucuaacugugagaaaacaucaaucaaauccaaauugagggacauacaaaguaacugaucaguacucuucaaaagucucaagguuauggccaggagcaguggcucacgccuauaaucccaggauuuugggaggcugaggcaggcagauugcuugagcucaggagucugagaccagccugggcaacauagcaagaccccaucucaauuagccaggugggguggcacacaccuguagaaccaacuacucaggaggcugaggugggaggaucacuugagcccgggagguugaggcugcagugagcugugaucacaccacugcacuccagccugggugacagagugagacccugucucaaaaaaaaaaaagugucaaggucaugggucuucaaagacagggaaagacugaggaacugucucagauuggaagagaccaaggaaaccacugaugacuaaauugggauccucacuggauccugcacagcaagggguguuagugggaaacucgggaagugggaaucaaucuguggcuuaguuaauaguuuggguaauuguaccauagcuacgucagguguuaacauuggagagcacugguuaaaggauaugcagaaacucuuugaacuauuuuuguagguuuucuaaaagucuaaaauuauuucaagauaaaaaguuuuuuaaaaugccauggggucacacuccuuucuccacagaaaacuccuguguaacuggcagcuuagugcacucccugacacaucuugacugcccccaggaaucuggagagggaacaggaggcgagucucucugcccuucuccccagaauuaucuuuuaaaaauuuuucuuagcgucuaggcugggugcaguaccucacaccuguaaucccagcacuuugggaggccgaggcaggcggaucaccuaaggucaagaguucaagaccagccuggccaacauggcaaaaccccguuucuacuaaacauagaaaaaaugagccaggcaugguggcgcaugccuguagucccagcuauucgggaggcugaggcaggcguaucacuugaacccaggcagcagagguugcagugagccaagaucgcgccauugcauuccagccugggugacagagugagacucugucucaauuaaaaaaaaaaaaauucuuagcaucccaaccuagagaaggaagauucuuuuaaccaaaaagugcuaauucucaguuucacagaaaacguucccguguggggaaccucagacccuauuuuggcuguggucuuggaauccugaaaacacccuaacaauccagcccuuuuccuuaccaacggagaaacugaggcucagagacacuaggucacccaaagucaguugguaagcccagccaggccccugccucucaagcucagauugaauuaagacccaggcucuggagucagaucuagguucaaaucccagcucuaccauuuauucugcuaugggaucuugggcaaguuacuugagcucucugggccucaguuuccuugaucauauggggauaauaacaguaccugccucguguuuguaaggauggaagaccacguuagauaauguggcgaugcuuucgucacugucggcuacuaugacuuucacaucucagugcuccaucccagaaucccaaggggcucccaagaggacugagucaacucuuuuuuuuuuuuuugagauggaaucucacucuguugccgaggcuggagugcaguggcgugaucuuggcucacugcaacuuccgccucccagguucaagcaguucuccugccucagccuucagaguagcugggauuacaggugugcgccaccacacuaggcuaauuuuuguauuuuuaguagagacggaguuucaccauguuggccaggcuggucucgaacuccugacuucaagugauucacccaccucggccucccaaagugcugggauuaaaggcgugagccacugcaccuggccugagucaacucuucucagggaacuaaacaggggcugcugguuacuucaguuucucccacuucuugccuaaguuaccuugccuuccugggccucgguuucucuccaucauggcccacccccugggugugucuguggcuggggucucugagaccacacucaccucucacggucagcgaagacaaagcgacacagcuugagaucacgcaggaccagaccgugcuggugacagugcgccagggcgguggccaucuggcggaagagcacggcagccucaggcucagggauacgguggcggcuucgcaccaggcugugcauguccccauggguccgagugaaaaaggcguagaggagcuggguaccagccaggaccucagugggccgagccacaugcuugugcgggggcagccgcgcauagggcuccagcacggccagggcuuccuggacgggguacaccugugggcagagcaugguguuagcacagcuggggacucccgggagcugaggcuggcauugcaaacagucacagcugaccuauuagacacuaccaugugcuaggcaucgcaccaagcgcuucacugaccgagucacucagcccugaccaugguccuauaagguaggaugacuugcuccauuuuacgguuaacgaagcugagaggccacacagccagcaaacagcacggcugagauuugcacguaugcacuccacugucugugcuuuuuuuuuuuuuuuuuuuuuuugagacggagucucgcucugucacccaggcuggagcacacuggcgcaaucucagcucacugcaaacuccgccuccuggauucaagugauucucccgcuucagcccccaguguagcugggauuacaggcaugugccaccgcaccuagcuaauuuuuguauuuuuaguagagaugggguuucaucauguuggcuaagcuggucucgaacuccugaccucaggugauccucccgccucagccuuccaaagggcugggauuacaggugugagccacugcacccggccuuuugucugugcucuuaacugcuacgcuauauggccucaaacaucggauaacugaaaaguaacaggucacccaaacagaaaaauaacccacaaagcaggaggaauccggaagggcggaugaugcagaaggcaccugaugcucaucaccgucacagcucccguccucuuugcccacccacgcuuucauucauucaguaugcuggcccugggccugcacgggccagccacauguccagcuagacugacagccaugggcucugcucuccggugcccacugggaggccaugcaaacaugcccagaaaccaaauauugacaaaugcugauaagcauugcaaaggaaccaagaaagaugcuggaauaaggguuuuccuguuuguuuuuuguuuuuuugagacggaguuuugcucuuguugcccaggcuggagugcaguggugugaucucggcucacugcaaccuccaccucccagguucaagagauucuccugccucagccucucgaguagcugggauuacaggccccugccaccaugcccggcuaauuuuuuguauuuuuaauagaaacaagguuucaccauguuggccaggauagucucgaacuccugacuucaggugaucugccuaccucggccucccaaagugcugggauuacaggugugagccaccgcgcccggccaccugacacguauuuuacuuauucgcuuguuuagugucuguaucucccacuagaacgucagcuugaugagaacagaacuuuguuuuuuaaccacagcaugguacauggcaaauacgggugcucaaugaaguuguguugaauuaaugaauaaguugaucauuuacaaagacaagauuuugaucuuucuacacacugaccagaaaagcugaggaaguguggaaaugaccauucagcacccauggugcacauuggcauaggggugaguauguuccaguggauuuucccaaauguuucuugagaaucagggcccugugaacgcauggcgcuucucuccugagccugcuuggguuauuccucuuaucauggacucaccuccccagcgggaguggaaaagagccugugaugcugcaggaaggggacccagaguucugggcuccuuagggcaccugguaagggcgcuggagaucugugcacaagaggccaggugaagcuaggggcuggacccugucuggaucugccccgcuguucacugcaucuccgucaacagagcaaagcucugcugcugccccaggaggaggcuuaaguccuucugcuucucugugcauucccaagggacccaggcccccgcuacucucccuuggguuuccaggucccccuuaucuuccuuaugcuugccugccagggcagccugcccugauugugugaaacgcuuauccuagcacgggcacaggacucucugggcucagccuccugggcccaaucccagcucugauaccaccuggcucugucauguggcaaguaaccauggcuuucugagucucaguguccucuaucuauaaaaggggcacaaugauagaaaccaccucauugguugugucaagauuaaaagagauugugcacacuaagcaaucaucauaguaccuggugcacagugaauaccuauuguuacacuuuuuauucucaucucugucuucuuggacugucacuugucaguguccugcaugggcugacccucaggggccuugacccuguccauuuccugguuucugccaggaauccucagacuuuucuaccccuuaguuuaccccaggagccaggcccagugcuaugugacuucacgcauggcccuucuccugucuucaucucagucuuccuaucuguaaaauggccccagguuaggcucgaucaccuccgaggucccaggaguuuugaugucuaccaugcccuacccuucucuugugcaaacaucuucaguagcuccgcacagcccaguggaggccccuuguuaacaccuucaugaccagcugcugccaaccuucaucuccugccccuuucugcacauccucuccacucuggccacagagaaguccuuuucauucucuaaagugcuauccccucacuuuucuaggccuuugaacagcuguucccccugccugcaacucccaucucccacuucuaccuggcuaacuucugcucggccuuuucugcgcccaugaucccuaaguucuaccccugcagcauuuaucacacuguagggccuaagcugugaacucccccaggacugggacgaccucugguuuaccucucuaguaucaguccagcaggggcucccuggaugcuuccccacuaaacaaacacaagaaugaaugaacauaaggaccccucugcacccuggcaauccuuuggaggccuccuucccaggccuccuguggugcugggggacagccgcccaugggcacguaccuugcagguauacucagugccuguagggcagugcagggccugguaggcccgcccgcccuccucgggcuccaggaggacauagggcccaagacgggaggcaguggccacagcaguugcacgaucuggagcaguaggugggcucaggggcaacaggcaggggggcagucugggcuggggcccacuucgagcucguuucuggacgggacgcucgguaucuaaguugucauccaacuccaaccgcuucuuccuggacagggaacccgcaggagcagccagagggguggcucgcaucugguaaaaaggagagaaaagcacuaaagugagacugcuugguggccccuccuuuccccugcuggugggaggauacguggcacaacauuuauagggggugaucuggcaguguguguuaaaaugacaaagucacauauccuuaacugggugccccacuucugggaauuuaucuuccaguuaaacuucucacaaaaaaauuaaauauaguaaaggcuguucaucagagccuuguguccaauagcaaaagcaggaaauaucccaaaugucaggcaguagaaagcuagugaaaacaucaugguauagccauacagcagaauacuacacagcccugaaaaaggacaaggaagcucucuauauacugaugcguacugaucuccaagauguauuaagagaagaaagacaaacacagaauuacguguuauagaaugcuuuuaugguggguuuuuuuuuuuuuuuccccaagagauguugcccacgcuggucucaaacucguggccucaagugaaccucccaccucagcuuccuaaguagcugggacucuaguagugaaccaccacaccuggcuauacuuuuauguuaaaaagaauauauauaaauauguuauauauauguauguauuuguuugaauaucuaucaucucucucucugaaaggaugcacaagauuaggaggagacucuuacuauuacaguucacuugcagccucgaccucaggguucaggugauucuuccaccucagccucccaaguagcugggacuacaggugugcacuaugaugccugacuaauuuuuuuuuauucuuuguagagaugggggucucccuacauugccuaggcuggucucaccugagcucaagcaauccuccugccucagccucccaaaguguuaggauuacagaugugagucaccauguuuggccgacuuuuauaguuuugaauuugagccauguaaauguauuuccuggccaggcgugguggcucacgccuguaaucccagcacuuugggaggccaaggugggcgaaucaugaggcugggaguucaagaccagccuggccaacauggugaaacccugucucuacuaaaaaauacaaaaauuaggccaggcgcaguggcuuaugccuguaaucccagguagcagcacgugaccaaggcaaugccaaagugcagcccacggcagcacuuugggaggccaaggugguggaucaugaggucaggaguuugagaccagccuggccaacauggugaaaccccaucucuacuaaaaauagaaaaauuagccaggcgugguggcgugggccuguaaucccagcuacuugggaggcugagacaggagaaucacuugaacccgggagguggagguugcagugagcugagaucacaccacugcacuucagccuggccaacagaacaagacuccgucacgggagaaaaaaaaaauuagccgggcgugguggugcauaccuguaaucccagcuacugggaaggcugaggcaggagaaucgcuugaacccaggaggcagagguuguaaugagccgagauugugccacuacacuccagccugggugacagagcaagacucugucucaaaaaaaaguauuuuguaaucagaaauguacauuuaaggaaauaaauaccugcuuaaaaacacagcuuguuucuaaaaauuauaguuaagaaaaucaacuaaucucauaauccauggcucucguacauucacagaugagagauaugaucuuguucauucacuuaacacugggugcuaggaagagaaguagguuagacagcagucuugccgucaggaucuuccagucaauuuggagggcagaugaguaauaaaaucacguccaaggcuaggugcaguggcccacaccuguaauccuagcacuuuggaaggccauggugggaagacugcuugaacccaaaaguucaagaccagcuugggcaacauagugagacccugucucuacaaaaaaaaauuuuuuuuuaauuagcuggguguggugguggaugccuguagucccagcuacuugggaggcugaggugggaagauugcuugagccugggagguugaggcuucagugagccauguuugugccacugcacuccagccuggugacagaguaaagacucucucaaaaaaaaaaaaaaaaaucacauacagugugaucagcccuacuauacagagaagcaugggccucuaggaacccagagaggccucucuccugggcuggugggucaagagaggucuuccuagaagagguggugucuacacugagaccugaaagugaggcagaguuagccaggugacacggagagucauacugcgguucagugguucucaaacuugagcaagcauugagaucaucuggaggccuguuucaacauacauugcugggcccuacucccaaaguagcucauucagaaggucugaaucugcauuucuauccaguucccaggugaaguugaugccgcuguccaguaaccccuguucuggggugagggaagaggcaaaagaacaugcugcauguuccccaagaacacgguggagaaugagcgugacugcaaaaaaaagugaaaaguuaaaaaaaaaaaaaaaauaggccgggcgugguggcucacaccuguaaucccagcacuuugggaggccgaggcaggcaggucaccugaggucaggaguuugagaccagccugaccaacauggugaaaccccgucucuacuaaaacuacaaaaauuagccgggcgugguggcacacgccuguaaucccagcuacucaggagucugaggcaggagaguugcuugaacccaggaggcaaagguugcggugagcugagauagugucauugcacuccggccugggcgacaagagugaaacuccgucucaaaaauaaauaaauaaauaaaaauaaggugagguuaguagaggcccuauugugaagggcucuacgagcaucauauggcagaggugguuagugguccccaguuucaggucuccccuccuuacauaggauuagaaccugagauuuucagcugagcacaaggacaccuagaauaaacugcauuuccugucucccuuguauccuuguaucagcauauggcuaguaggacacaaguggaaguguuguguacaaugcccaggacaguguucuuaaagggagggcccaacuuccucauuuccuccuuuccuguaugcuggaauguggaccuaacugcuggagcuccagcaucuaccuuggcuucagaaguaccacauacaguagagcaagagaggagccuaggucccugacacauggaguugucaggccagaccuccagguuuuuuacacaggagagaaauaaacaucuauugaaggcugggcgcaguggcucaugccuguaaucccagcacuuugggaggccgaggcaggcagaucacaaggucaggagaucgagaccaucuuggccaacauggugaaaccccaucucuacuaaacauacaaaaauuaggugggcaugguggugcaugccuguagucccagcuacucgggaggcugaggcaggagaaucacuugagccugggaggcagagguuguagugagcugagaucucgccacugcacuccagccuggggacagagcaagacucugucucaaaaaaagagaaaaagaagaaaaaaacgucuauuucauuuuagcuauuaaguggcuguuucuauauuacagcugagccuaauccuaauuaacacacaauaggauuuggaauuauccaaaggcaguggggagccacugaaggauuucagcaggggaacaucaugcuuuuaggguggauuugaaaguacaagacggggcagugagacuagcuaggaggcccacacaagcacgaguccaggcaggagaaggugaccuggacuagggggugcuagauggagacgcgaaguuaagggcucauaggaggaagaucaagaggacucaguggcagacuggauggacuggauggauuggaugugaggggugaaggagaggguggaaucgaggugagguccagccuuuggcuccugcaaugaggagggaugauggcuucauguccugagcugggggagaagccuguauuuuggggacuguggaagaaaacuguuaaguauuucagacccuuaugucuuggcagugucaugaaaaguggguuuauacuguggaauaguggcagugcagccacuaacaaugaagacagugcuagugggaggauaaaagguaccaccucugaggagugcauuuugacaauaucaaaaugaaaaacaggcugggugcagugcuucaugccuguaaucccaguacuuugggaggcugaagcaggaagaucacuugagcccaggaguucaagaccagccuaggcaacguagcgagacccugucccuaagaaaaaaaaaauuaucuggucaugauggcacacagcuguagucccagccaugcaggagguugaaguaggggaaucacuugagcccagaagguaaaggcuucagugagccauggucaggaacucuagccugugcaacaaagugagacugucucaaaacaaagcaaaacaaaacaaaacaaaaacaacgaugaaaagcgugugagcuuugauucagcaauuaaucccauugcuaagaauuuauucuguagagguguguguguguaagcaugcaaauacacaguuauuccugcagcccuuuugacagaaauaauuggcugucuauaauuacagggcugguuacauaaauuauacuucauccacacaacggaacaaugugcagccauuuaaaagguugaggaugcucuuuauaggguaauuggaaggaucuccagagugaacuguuaagugaaaggaaagccaccauucacgcagcugugugacugugugugugguggcugaaggagagggcaguagggcauggucagggcagacggguucucucuagaacccaucugcccacccacuuaaacuccauuccaaggaggugcaugcccagguaugggcauuggugcgagagaccucagccugguuaaagaccuucccaacaguucaaggcaggauuaacaaggcaacaugagucaguuaccagacagaggcccaccucuccaaguacgcugcucccaaauggaagagcugccuuggaagggaaggccuccccacaugagugaaaggucaugacuuuggcuugguaagaaugcaguaaggaguggcuguagucagauauuccuggguucuaauccugucucaaacccuuucuagcugggggguaccccuggucaaguuccucaagcuuucugagccucaguuccuguaaagugggaacaggaugcaaagcuuacagguuuuucgugaugaugaaaugaaaacacaaaugaagcauguagagcuuauggaccuguugccagguaggugucaggaaauggucauuauuagcacucauccuguuauucuucacagcaagaugcauaaguaccauccuugggagucuuagaaagcuccccagguucgaggcugggaugacacuccuuacaucucaaggcuguucugagucacgcaggaugauaccuggcugugcacaugcuuugugcccugugcagcaggagacugccuggagucccucuggccugugccacaucaguaguccaggcugccuuggccccggccaucccucagagccuguuggggccugggauaagcuccacccagauggggacagaugcgguaacugagucuauacaucuugggcaaggcauuuugcagaccacacugcagaauagaaucugugauguggaaugaaagcagccccuaauaucuaccucuugcuguucccugccacacucgggacccagggaaaugagggcggguuacaucaagcgcaagcgcgcgcgcgcacgcacacacacacacacacacacacacacagcccucccagcugucacacccauggucuacccgagcaaggccgcacccccaccccgccccgccccccgcagccaggccccucccgugggagcccaagcgaaaggcggcggguguccgagucagaaguuucagcggaaauugaagcgcggcccugggacaggaggggggugaggcagagggaaggagguggcugucgucccccgcccuccccggucugcaggcacagcacacaccgcagacacgcgcgcaccguccaccugcaaacccggagccgcgcacuggggagaaccagcggcccugccgggccagagaucgcgcgcugcgcccccgcucccacucccucggcucccccgcuccagggcaccccagcccugucccggcgguguccccugcaccgccaaccccugccaccaagugcccagcccuccagacagcucucaccaucuccugagacacaggugcucgggacccacccucacccaggacucuccccugcggguucacgaggacccccucggaucccccgccacccccagaguccuccagugccccccacaagccccucaccgcaccacacgacuccccuaucccgcacucacgcaaaacagacccccgcacgcccuccucuaggggugacggccggacaccuccgucccuggcuuccccagcccaacucgggcgaccccacgcuccgcggggccgcgucaccugaagcccggggggagcacucagcccaggcccggaucaaaagggaucugaccuggccgcgccccgacggcggggucugugaaaagguguguaaggggcgugcgugcguguaacacgcggcaacacgcagacgcccagaggcuuccggcgcccccuuccccggccgcccccucccgccccccggccuccgggcgaguccgcaggccgcaccccgccgaguaccucgccccgucguuccgcgugggcccgggcgccgccggggcucagagccuccagggcaccagcaggugggccggcccgcugcgcugcugccgagcucgggaucccagcccagcuccagcccugcccggguccuagcagcggacgcgcgcggagccgccuccacuuccgcugcgagucucgugcgcgcccggcccccgguccgggugaugcaaaccggagcuaaucccccgguccgggugaugcaaaccggagcuaaucccccgguccgggugaugcaaaccggagcuaaucagccgccgucugaugcccucgggcccgggaucgcaccaucccccgcgccgcgcccgggccucucuccucugcauccgcugcaccugggacccgcccucgcuggcccccuaggggcgucuggucagugcagacaucagccacggacucucccuaucaccuuggaaaaaaaauuugcucuuuuuuuuuuuuuuuuugagacagagucuugcucuguc

SEQ ID NO: 191252 - RNA, 62700 nt, Homo sapiens
gagggaaagacaaaacguauuuauuccaggccaggucuuaaaaugcacacugcacgguucccuguuguuaucagcaccaguaaggaaagaacgugccuuaacggcagccccacccagagccugcugcguggcugcugugaggcuccccaugaauccacgcagucuucuuccucacuggugcaguuggugagguuuucuacccucacagcaaagggauccuuaacuauaaauucacgguaugcagagaagaggacagaaucugauuuacugauuguuccucauuuaaaccaugacuuaaucucuaucuuaggauuuaacuaucuuuauuuucugguuaaaauuuuuaaaaaaaguggggagagggugagagucguaaggggcaauagcaauagagauuacacugugcugacacagagacuaaauucuagucagagugaagacccauauaaaaggccggcugaugguuuaaaggaaguaacuacauggagucuaaucgagacauucaugaguuacaucucauuauuagccuuaguaauguaagaaaacaauucucaacaaaacuggaguccacaguugucaaguaugcuuucucaggcacggguagguaaaagucuggagaaauggguucucuccaugcccaaugacaaagcaagacgguccuagguuugagguuaagagcaggucccauugccgggcgguauccgcagcucacagcugaguuuagcaguggaaucgaguggagaauuugggagauacaggcacagucagaggcuggucacuugacuuuaucuccagacccugguacuugcguauuggauuugccuuaugcaccugcaaaguaaggaaaaguuaccagugagagggaugucagagaacuacgcuuauaauugcuuuuauuuuuuucuuuuugagaaaauguuuguagaguuuuacaggucccagucacuaguuucagguguggggaguggggccuggggggcaacacgguaugauggaaaaguguaugugcuuuggagcccaaaaggguuucuauucaggucucuauugggucccccagcuuuccuuuaggccacagucuccucaagucccucagcuuucacuaaagaaugccaaaccuauguccugugugauuuacuaggguauaauagggcuguacucaaguauagcagagaaguuacaagcuaagaauuucccagaguacagucuuaaguuuacugacuauaaauauucaccaaaagccugaauccuggggaaaaagcaaaaacaaaacacaacaaccauaccaggaaggguggcuaaagaaggcauggucccauccauccuuuaggguagucuaaaaucaauccuaaaucaagccagauuaguagagaguuaaccagcauugacugaauugugcuuuacaauguugccaucaguuauguugagaauugcugcaagaagcaguucuauaauggggacaaacacaagaggcagguaccaaaugcuaaagaaaaaucaaaguugaggccgggaaaaaaggcugauuguaugaguguauauagaguggggauuauacuauuuucucauucacucagcaaaugguagucuagauuuuaccaagaggcuggucuccuaaauaguguguccguggaaccuuccuaugggcauaaucaccuaugccaauagcugccaauagcuguuucaacugcuagucuagcauuuuauuuauuuauuuaaaauagagaugggacuuugcuauguugcccacgcuuuucuugaacuccugggcucacgcaauccucccaccuuggccucccaaagugugaggauuacaggugugagcugccacauccagcuguaguauagcacuuuuagacaaaaccucaacaacuuacacuucuuuuuuuuuuuuuuuuuuuuuuuugagacagucucgcucugucacccccaggcuggacugcaguggcacaaucggcucacugcaaccugggccucccagguucaagcaauucuccugccucagccucccgaguagcugggauuacaggugcgugccaccaugcccggcuaauuuuuguauuuuuaguagagacagaguuucgccauuuuggccaggcuggucuccaacuccugaccucaagugauccacccaccugggccucccauagugcugggauuacaggugugagccaccauuccuggccuucuuucuuuuuaauugacagauaacacuguauauuuuuauuguguaccgcugauguuuuaaaguagacauacauuauggaaugguuacuaugugagauaaugcauuuguuaauuagcaagaugcuaauuaacauuguagugugagcacauaacauccacuuauuguagugugagcacauaacauccacuuucuuuacaguuuucaagaauacaauauaucauuaacuacagucaccuuguuauaugauagaucucuugaaauuuacuccucccaucuaacuguaacuaaguaaccuuuuaccaacaucuccccaugacccuuucuuuuuuuauuuaucauacgaaguuccaucuaaaacugucugcuucuucauuaacacaguuaacacaacuugcugcccuccuagcagauugguccuuaauguggaguucagguuucuuuuuggauaaccaacaucuaaauaauuauguuaguagaggauuaccuggagcgacgaacacuguaacuccaaggaguuugggcucaguauuaaaacaaaaauacaguugccauuuaauucccauguccuucgcuauguauucuugucuaauuacaaaacucaguggugcuucuuaaccccagaggaaauaauaaguuacauaaauaaaauaaacaaauaaauaaaaaacaguccuaggaaaggcaucaugguuauaccacauguuguccuccuuaugaaaacuuccggaagaaauucugucuaaaaauucacuaucaaagggauaaauguauuuuuugaacaacugucuuaugucucaugaacacugcgaguuuuguaacugacagguugguuccuaaaaagggccaaaauuacagcuccuacuuagaucacaauguacacaucguuagcuucauucacaacucaacuucaucaccacccucaguuugugcaauucccccuuucacucauugucuuugguacagccuugcgggcuaccuuagauccugucugguacaagguaagguacagguaaaauaaaacagaggcauguuuguguucgucagugcucaugcucccaguuaccaguucucuccguagccuggccagcuccucuuuuuucugcucuuccuccuguagucuggccuccuccaacugcugggcuuucugggcuucuaccucagccauucucuucuccagcuccugccgcucuuuggcucucuucucaguagccagcugaaaagguuccugaacuagagaaccagaaaggcccucuaaguacagaaacagaaaaaauauuggugcacaagcaggacuugcauaaaccuacgcccccuggaaugagcaaguggcacagacaugcacacuaacaggaagacugugcucuaaacaagccccauugggagaaagguagagccaacuaaauacaaaaaguuuuagaauuuuaagaguucaaagggccccuggaaaucgucugguguaauugggaaaaaggcaaagacauaaaguagcuugcacaaaacuauauagugauugauuuugaggcagacauagaagaaagaucccaauauucuuuuuuucccuuuuuggaaagauuuuuuugaaaaagagauggggucuugcuauguugcccaugcuggucucaaaucccugggcucaagugauccuccuguccgggccucccaaagugcugggacuacaggcaugagccaccacacccgguggaaucccaguauucuagcacacugcccaguguuuaaggaaucaaauguuuuauaucuaaaguuugcuucagggugaauuccagaaagccauacuggcucucccucccucauuuacuuguuucucuguggauggggaaaaccuaucauuguuguugaaaugccagcugcuucugccaagguucauguuaaaugaaucuggcccuaacacauccugcaacucaacauagcugcuggguucaauaaaggcaaaaaacugggucuaggggaagaaaagcuaccaucugcuaaagucaaaugcuucuaguugacacagcauuguacugacacacugaauuccagcaucccacugggaagucugacaauucugcccgagucccaucagaguacauauaauacuaccagcaacugauuucuucucuuucuugggaacaaagggcuccugagagaugacgguguuuggacgagccuugaaacaagcugcuucuuucugcugucucaguucuucuuccagcuauuagagagaaagucagucagaugagcaaugucucaccuuucuaugaccacuaccucaauaacuuaaguucuaaugucugaacugcuucaucaauaaaaauagcagauuuaauauaaacccuaguaaaaaucuuucacacaaacuuuacaaugaacagaucagucugacaacauuugaacucacugagaacuagaaagcauuuuuaagauacuuuuaagauucccaaguuugcauuuucgacauuaaaguuuacuuuuuuuuuucuuuuuaguuuauguucacauuuauuuuucuuauuauuauacuuuaaguuuuaggguacaugugcacaaugugcagguuuguuacauauguauacaugugccauguuggugugcuaaaguuuacuuuuaaauuaaaaaaaaaaagauuccaaacacaaagaaaugauaaauguuugagauuauggauaugcuaauuacccugaucagaucauuacacauuauacauauugaaacaucacuauguaccccaagaauauguacaacuauuauuugucaauuaaaaaaaacaaaaaauuuuaaagguacuuuuaagaccuaucuuuauaucauaaaaauaaacaacuagacauuuucugccuucacacaugauucauuaggaacuauacaguaucaccuauaaaguauucuucccaccuccaaaaaaaaaaaaaaaucuaaccagaauugaaucaagccuccagaucuuacuacucauuuauaggaaauacaagcaacagaggaacauguuagacaacugugugggaacgcaaucagcaaaauccagauuguggaaaaucuacaguacaaacaauccaguuuauucaacaaauaaaaugcaaagagaggagccuauagauugaaagaagauucggagauuuagcaaacaaaggcacuauguagacuauauauggauauugauuuuaacaauucaacuguuuaaaaaauuaugagaaaugugcagauauuugauuauuuuuaaucuuuuuaagugugagaauauuauugugguuauaagucuuuauauuuuaaauauauacacugaaguauuuuuggaugaaaagggauguuacauagaauuuguuucaaaguaaucuuacacagguagaaguauccaguguaagauaaguggguagaaguugggaugaaacaagacuuuucauguuuugaucacuauagaaccaggugauggguucaugaaaauucauuauacuauucacccuacuuuuauauuucugaaaagcuuuuuaaaacaauuguuuuuguuguuguucuuugcagaaaaugcccuacacagacauucugugucuuggucauugagaggggaaaauucacuauuuccaaggcaacaguccuaagguuucuuagagaaccacacuaacaggggaccaacguucagucauguaagccauuacaacucucgggcuucaggagggguaauuccuacaaacaaacaauagccuagagcuccuuuuggaaagaauccaagauuaaugaugacauaaaaauccaaaaaacuuagaaauucaggggaaauuuuuuccagccacguagaauuagaucccaauuaaaucagcaaauaaccaauuaauuguuuuaaaucaccugucauuuauaaagagcaaauagcacaucaugcugagaaaacagcauuguauauuucaaucuauucucccauacuguuucuuaccaaugcaucaacagaaaggaauaaacacaaugaaugagucuaauagauggaauagauaagaucuuaaagaaacucccaacuccagaaaagccugucgguucccacauuccccgggugaucacuuggagcaggggacauucccaggugaucacuuagagcaggggucagcaaacucuggccuacaggccaaauccagcuugcaaccuguuuuaggacagcgcuugagcuaagaaugguuuuuacauuuuuaaagaguugauugggcacagcagcucaugcuuguaaucccagcacuuugggaggccacggugggcagaucacuugagaucaggaguuugagaccagccuggccaacauggcaaaaccuugucucuacuaaaaacacaaaaauuagcugggcgugguggcacgcgccuguaaucccagcuacucgggaggcugaggugggagaaucacuugaaccugggagacggagguugcagugagccgagaucgcacuacugcacuccagccugggugacagagcgacacucugucucaaaccaaacaaaaaaagaguugaaaacauguagcugggugugguggcucacaccuguaaucccagcacuucgggaagccgaggcggacagaucacgaggucaggaaauugagaccauccuggcuaacacggugaaaccccaucccuacuaaaaauauaaaaaaauuagccaggcuugguggugggcgucuguagucccagcuacucaggaggcugaggcaggagacuggcgugaacccaggaggcggagcuugcagugagccgagauugugccacugcacuccagccugggcaacacagcaaggcucugucucaaaaaacaacaacaacaacaacaaaaugugugcguacacacacacauacacacacacacacacacacacacacacacacacacuaugcgacagagaccauauguaaccuacaaaaccuaaaauauuucuuaucuggcccuuuacagaaauaaugugcugaccccugauuuacagugagagccccugaaacaauguagcauguuaacccaggugauuucaguauggugggucugccuguacaaucaaccaaccaagcaauuaacauuuuggcugcucuccccauccccuaccuggugcuuccaagucugugccuucagagcaccucuucugucagucuccaagcagaaagguucaaucugggucacauucuuuaccuucuucucuggcagguuaauggugucaaaaugaggcaagggaagugccuugaacuugggcaccuaacagaaaagaaaacaugagguuuaagauaaagacuagcuggaaagcaauagcugcuccagaauaucuggaagaaucugaaaaauaaggaaggaaaccuuucaaagcagcaugaaagaaugaauaauggguucaaaaggaaaucuaggcuuuccuccuaauauugccuauaaccagcagugugaucagaggcaagucacuuaaccuccuugugccagaaggauuauuuaaauuacuugucccauuuauauuuuauaggguucuuagaaagaucaaaagaagucagugauuuuauaguuaaaagugcuacagaaaaaacugucuuugagggaucaaagaauaguauuacacuacuugcagaaauggaaacaccuaccuccccuuucugcaguucuuuuauuuucuucuccuucuguaacugacguucuuugucucgagaaucaaacgagaaagggcauauuuccacaguucuugccucugggauuuggggcuuaaaaggcaccccauaauguggcacagguugagcuuuuaucacuaccgguucguccucuuccuagggaaaaaauugcaguuuagaaauaagacuccucacucucuccaacuuccccagaauguggagucagaagacauuauauuaauauguggcauuaauuaaaacaaaauuaaaggaagucuuagcuuccuuuucuauccaagaaggaugaugacuuagguaagucaucuaccaccaagggcuaacacaauuacucuuaaaagaucuaguuuuccacaggaauguuguaaaaacuaaauaagaucuaacauuaugaauaaaaugaacaucagaagaucggucccaaccaagcauauaccuuagucucuucuuugacccagccucuagacuucauuaaaacaugugacugggacuuaaugguugccaaacccagaauaggauugccaaacccaaguuguuuggguucaagcugguaacacaagauuacugcguauuuuaguuucaaaugaaccuauaaaaaggcuuaugcuugcaaucugcuauaaaauuacccuaacucuggauauuuauagauaaaaugggagauguaacaagaaacuggccugaccaaugacaguuuauauauuacaauuccauaaacgaucaccacagucaccuuugcaacuccucuggguuaacggagauaggacaagguggauguaauugcuuaguaugaauuuucaaaguccaucacugaauagugacaaucuaaggcaaaauaaagugcaacuuuugauccauguuacaaagagcagcugauuuucaaugcuacagcagacaagccuccaaugcuuaacugcuccuuacuguuuccauaaauuguaacuaguuaucacuaagagcagaaaauucauacccuuaccaauuacuuuguucuuggaggaacaaaaaaaaugaacaaauguucauacccauucuuaaagacaaguccaaaaaagagugguugccuuugaacuccauuaagauuaauaaaugauaaggcuuagauugacugacuauauagaaggaaaaagaaccccccuacucccagggaaucaccucaucuucuuuggugggcauucgaauucuguucuucaaugcaaaggcuggugacuuggggacggugauuggaaguaccuucuuuucaggaacacccugaaaggaguaagcaacucaauuagauaucacaaaaugaucuccacuaagcuguaugagaagauuaaauccuuuuuuccccuuuggguagagacagggucucacuauguugcccagcuggucucaaacuccugggcucaggcaaucuuccugccuuggccucgcaaagugcugggauuacaggugugagccacugcacauggccuagaaugauauuuuugaguuuuuaaaauauaauuaaucuaagcacagaaaauaaaagaacauaaaagggaaagaacaccaaauugucaacucucauaucucuuugagggugaauuaagagagaaauuuaauuuucuacaucucauaauccuuuuauuuguuuguuuguuuugagacagagucucacccuguugcccaggcuggagugcaauggggcaaucucggcucacuguaaccucugccuccugggcucaagugauccucccaccucagccuccugaguagcugggacuacaagcgcgcaccacuuugcccagcuaaucauuuuuuguagagaugggucucaaauuccuggccucaagcaaucuccugccuuggccucccaaagugugaggauuacggacgugaaccacuguacccagccuuauaucucauaauuccaacacauucaacuacccugaagauuuuuccuuaaugauuuuaaaacacugcuaacauuucaaaucguuguggaauaaaugacauguaucauauugugcacauaauuuaaaacuaacacauuuuagagaguuguuccacagcauuuuuugauucacacagaguuuauauucuaucacaaaucuggcaauuaauccuaacugcaaaaugguaucucuuggcugcuguuuugaaugaaguguacggccagaucgauuaagaacaaaacaaaaccucaguaauuucuuguuacacucguguccacauccugcccccaucagcucucuauucugcucuucccuaaaguuucauugccagaccuacuucagcuauugccugugccauucugcuagucuccuaacagucuuucagcuccacaacucauuccuccaauucauugucugcauguaguccacauuauuacucuaaaacacauuugaucacauuacuuccugacuuaaaauucuuuaggccaggugcaguggcucaugucuguaaucccagcacuuugggaggcagagguggguggaucacgaggucaggagaucgagacuauccuggcuaacacggugaaaccccgucucuacuaaaaauacaaaaaaauuagccgggcaugguggcgggugccuguagucccagcuacucgggaggcugaggcaggagacuggcgugaacccaggaggcggagcuugcagugagccaagaucgcaccacugcacuccagccugggcgacagagcaagacuccgucucaaagaaaaaaaaauuaauucuuuaauggcuccuauugcuuaccuacaacagcauaacaaauuccuuuucgugaaacacaaggcacuugcuugaaucucacucauaaauaucgccuucauggccuccuuaguaguagcauuaaucugguacccuccugacucucccgccuuaccucucaccccuccuuacauaucacguugcaaccacaacgaacuacugaucgcuccccaaaugguuccuaucucauuaccuuugcuugugcuuucucugucugaaaugccccggcugcuugaaagcacccaauucaucuuuucaagccuccacuuuuauaaagccuuuccucuuuuauaaagccuuucaauagaucucuccacucccaggaccuacagaacugaccccuuuaucccauuguauaugguuuuaucacaguccauacaaaacuuaauugcacuuauuuauuuagauguucauuucccccugcuagccugagugcuucgaggauggagacuauuuuacuccaucagacccaaguaccuaacauagaccuuggcaaguauaaagcacucaguaaauguuuguugaaugaaugcaguaagaaugaaugaacacaugaguaacagaauuuauaccuuggacucuaggaggauaccuugggagccuucuccuuaaucccaacaaugcugcaaccguucgaaacauguuuggaaugucuuucuuggaguggcuuucaaaggcacuuucuggaccaugcaagacaguugcucaaucuuuacuauucauuuaacaaauaguuuacaccucuauuaucuuggacuacucagaaguuuuaguuccaaauaaccuuagacuagauccuaaaagcaaauuaauguuuaaaauacacgugaagauuugucauccugggagggaucccaaaggcucaucucaggauucaagaugcauggcuuuuccaaaaugcuuuuugcaguaucacaaucauuggaagggauuuacagucucucaaggugaccacugagaaugcucauucugcugugaaauuucuuauauguuuucuaaagaaugcuagaaucauuagcauagugaaauccaauauagcagaucuuguauucagagugacaaaacuccaagaaauggguugucaaaugauguuuaccauaaaacagcaacaacaacaaaaucugcucuucuauagacauguggacacuagcaucuugcuugaaugcaccaggggcaaguggaagagagacaaauagugagcaagaagccacgggucugucuguuccagcccagcucugcuuccaaucuguauaaccuuaaacacaucagauauccuucuaggccuugggguuuuuuaauaaaauaaaguaauugaaauaaguaauugaggauucauuuaguucugaaauaauucccucucucugcauucacccaacagaaaugucugcauuuuaaaagagaagcaagggaaaccucuaauaaguaggccaugaaggagauauguaugagugagcucaaucucuuaauuaguugggggagaggaaaagaugauuuaugaaaaucaucuuugcagcaacuauccacucacaccccagccccccuuccaucaaaguuaacuaggggcucgauuagaaauaaugaaaagaaaauuggguuuacagaaacaaagaaaguuuuuuuuuguuuuuuuuuguuuuugcuauuuuaaguuuuuuaaauuauaagcuccuugaggacuggaauauugucauuugcauucuuuugucuucccauaucaccuacuagaagaccccguaguaacuguucaaugaacauauguugguuaauauuaccauauuuacucauuuacacaucuauaugcucuaccagacuaugaaagcuuugaggacaagggccgugucuuauaccaucuuugaauuccuagugucuaggugcaugucagcuucuacuauuacucacucaguuauccgauaucagagugcuugugcugugguggucacuaugcuaggggcuagggauacagagugaauaauauagauacacacggucccuguucucagggagcucacauucuaauggaggaaagagacaaugaagauuuaacaaauuaaauacuuccaaauuuucacaagugcucuaaagaaacccagcagaauauggagcuaaugguuauuagagggaugcucccucaaugaaggggaagguaucucuaaagaggugauaugugguuagaauggggcaauguggguggauaaaugaugcauuuaggaaaagcagccaggacuggggaugggaauggggaggugaauaccucucccuaagacaggaugugccccccaaguacccugggacaggaucucaggccugucccagggcaguuaggaaacuacucugaagcaauguuauuuugggaaguauauauauuuuaaaaaagccugcugcccuccccaagucaucccuaaaguaucucugcuaaaauuacucacuggucucacugacaccacauccaccuccguggugccccggcugcccaauagaggucagcaccaaguucacauuucacacccucgugcucaaggcuuugucacuccaccucugccccaggaguccuuuucucauuucugccucacuugggcccacugcugcccaagcccaucuuucaucaacucuauuuauugucccccugccacuuaucaaccacaaguggaagugcagaggaaacacuguaaggacacacgaaacagcuucagcacugggggggacguggauggggaacaaaagcaucagacagacaagcugcaucaggcucuggaaggugggcucuuaaauucugcuguaaaaguccaacacuagaaguucaaagacuuuuuuuuuuuuuuuuuuuuuugagacagagucucgcucuguugcccaggauggagugcaguggugcaaucucagcucacugcaaccuccaccuccuggguucaugcaauucuccugccucagccuccugaguagcuaggaguacaggugccugccaccacgcccggcuaauuuuuuuuguauuuaguagagacaggguuucaccauguugggcaggcuggucuccaacuccugaccucaggugaucagcccaccuuggcuucccaaaguguugggauuacaggcgugagccaccgcgccuggccgacuuacucucuuauaaauguuucuuuuaaauguuuccauaggcaagcuauaauccccugugaaaggaaaauaaaucuugggacccccaaaaucaguaagccaaggagaaaagucaagcuaggaacuucaacaugcaaaccugccucccauucaaagaugaaaaagguacauaccucccucacaauuugcccacuugaaaauuccuugggggccccaaguucuucacccuaaaacaguucuguugaauuucacccugacaauauaaauugauagcuuaucuucacagguacaggacaaaggacagaacucaaagucaucccuuggcucaccugagaaaugcguaucugauugcuuccucugcccuaauuaucuuauguaaaaaugcagauucacugaacuagaugaaugcauaaguaacuauuccucuacccccucucacaugugaacaaagaaugcaaccauuugccucuuaccuacccauaccuuuucaaaaucucuuccccuuuccccacuauccacccuuuccccuuaaaauaugaagcccucaaaaucaucuuuggagaaagguacagaccugucucccaggcaugcauccuuaaccuuagcaaaauaaacuucuaaauugauugagaccugucucauacuuuuugguuugcaccccuuucaaaaccucccuuucugaaaagugaagcggguagaagaaaacacaucuaacaucucuuccuaugcuaugcuucucuagaaaccaagaguugaagucaaaucacuggaaauuuuaguagggaaaccugcaaacagccagugucaaacucagaaaccucauuugccaaaauaaauaugauaacaguaagcauuguaggguacaauaauacaguguuuaaggagaugaugggcucagauucugguucugcauacuagauaccucucaguguuuauucccuugucugaaaaauagggauaaguauagacuccaccucuuagaaguguaaucagacauaaauaagacaaucuacauaaaguacucaggacaauguaagcacucaauaaaaugacaauuacuauuaauaauaccccugcuuacugcgugucaggcaccauacucagugcuuuaucugggcucccucugugauguacccaacaaaucuguuuauguaauaagagccccagaggauucugagaaccagcuggauuuggcaaacacuuccauuccgcaaaucguaucaauucggucacaccuuaccuagugcuuugcagaucuguuuacacagaauuuucacagguauaaccugguacccaacuacucuaagaucucaacuaacuccuaaugaacucuggucacccuucccuacuuacuacuucacccuagcauuucuagaguacacacaacugacaaaccaauuuccuaaucaguguuuucaaaaauguaguucagcugggugcaguggcucacgccuacuauccuagcacuuugggaggccaaggcagguggauugcuugagaccacgagcucaagaccagccugggcaacauggcgaaacccagucauuacuaaaaauacaaaacuuagcugggcaugguggugugugccuguauucccagcuacucaggaggcugaggcaugagaauugguugaaccugggaagcagagguugcagugagcugagauuacaccacuacauuucugcacucuagccugggcaacagagugagauugucucaaaaaaaaaaaaaaacaguaguucaggugugacugaugcuaugagaaaggaucuuaggugagguguagacuguuguuuuuuuuuuuuuuaaauaagcacauacuuccuaagaaccuucuauuuuaaaagguaaccucuauuuuuauauaacagcauggacccuggaaucauaucaccuaagauucguaugcuagcucugccgcucacuaguuugugauuuugggcaaguuauuuaaccucuauguuuccuaacuguaaaauggauuaaguaccuacagugcuuaccucauaggguuguugugagaauuaagugcauuauuauauaaauguaaaaagcuuagaauaaagaccuggcauguaauaagcauuauauaaguauuagcuauuauugcuguguuauuuguggcaaaagguacugguuuuccauuuacauauuuauuuaaaaguucccuuuaaauuuacguuagguuacaaagugaguugauuuuuaaaauaauaauauugguauguaagguacaaggauauaggacaaauugagagagugguacauaaauaaaaacaaaaacuuagguagggggaaaagcuuggaggaaaauauguuauuaaaagcaaggugccagccaggcacgguggcucacgccuguaaucccagcacucugggaggccaaggcggguggaucaccugaggucaggaguucgagaccagccgggcuaacaaggcgaaaccccgucucuacuauaaauacgaaaauuagccaggcgugguggcaugcgccuguaaucccaacuacucgggaggcuaaggugggagaaucgcuuaaacccgggaggcggagguugccaugagccgagaucacgccauugcacuccagccugggcaacaagagcuaaacuccaacucaaaaaaaaaaaacaaaacaaaaaaccaaaagcaaggugccaaaagaguguuauagaaacccugaagaaauaauuucucuuaucuggggcuccauuaucuuguauguaaaacuaaacguugagcccuucuggcucuacaacucugagguuugcauauaaccuacuuuucccuuguuguauucacaacacuguuuccucaauggguaaagacaaagaaggcacagcccuuggagauuaaucacuugggugggggaagauuucuuaacaguuuauuguaacagagcuuggcauauaguacauaugcaucauggcagggaaaaaaaagcaucgugaacagaagucacgcaaaaagcucucaaucaaaaguagguaucagggaggagaaccauuucuaagcauaaucaugauuuuuguaaagccuggaaaauauaacuucaaguugcuucugauuuagugcuaagaaaauacaauaaacaaaacuagguacucagucaaagguaauacauuggugcaguuuccccuaaaagcauggugacucuaaagcaagcaaaaagaaagaagauaggaaaacagagugcuucuagaguuaucccggaccugcaucaauccaggcaauccaaaccaguggcggcgggugagguccucaucugcacugaaauguaacuaaaagccgcuuucgcauuuaugcaggugcuuaacuccauugcuuauucucugacuguagccuugcuuccugauugcacauuuucucuaaacuugugguugugagccuauuaucaaacuacaacucacuucucugaaacaguuuccaguggcucuugauaaacuuuucuccagcuuaacugacccacuaacagcucccaguagaagcuucuuguuucccaccgucaggcuuuuuaucauguaauuccuacugccuggaauguucugccaauccaguccauuugcauuucugcaagucaaaauucuaucauguaauggagaggcauauaaugagguauuaggaucacagacucuguagcuagagugucugaacucuuacuugcuccaccauguacuagcugagugcucuaggaauacuacauaaccucugugugccucgguuaccucaucugaaacaggugauaaaauaacccaccuaaagggguuguugucaaaacuaaugggcuaauauaugaaaagggcuuagagcaguccuggcacacaguaaaauugucagcuauuaugacaacaauagcaacacaauaacuauuacuacaguacaucgucaaggcucaggucaaaugugccucucuacaaagcacacccugaacuuucuaucuggaagaaaccauuuucuccucugaauuccuauuuuaacugucaucucucucagaacacuucuguccauuuucuauuauucacacauauauugucucccauaccagacuuugaguuaacuaaaagcaaaauccacuuccgauaagucucuuuaucaccugcaguuccuaauaugaugcccugcucauaauaucuacccaaacuuuugugugaauggguggauaucuggucaugagcaguacacuucugccagcacacauagccucaaccuuaccacaacaucuuccaaaaucuuaguagggcaaggucuggaaugaaauucaaaguguucauccucuguuuucuucuuugauucucgcuccuggauucuuuucucaauuuccaaaucaaagccaauaggcucggugggugguuucacaggugguuucuugggcaagaugggcccaccuucaaguauucugggaucaaguucacgugcuuugaauuuguaucuguaaggugaaaauuuaaauaaccacaaaaaaaauuuuaauaaaaugaaaacuucacaaacaaaguaagccaaccacaaagaauaguaaucauuaagauuaugcucccauugacuggacaacagaauaaaauaaauaaaaacgaaaaacaaugggccaggcacgguggcucaugcccguaaucccagcacuuugggaagccaaggugagcagauaauuugaggucaggaguucaagaccagccuggccaacacagugaaaccccaucucuacuaaaaauacaaaaauuagcugggcgugguggugcacaccuguaaucccagcuacuagggaggcugaggcaggagaaucucuugaacccaggaggcggagguugcagugagcuuagaggcaccacugcacuccagccugagcaacaagagcgaaacuccaucucaaaaaaaauaaauaaauaaaaaauaauaaaagaauaaaagaagaaagaauaaaucagacaguccuaacaucccuaccacuuaagaauugaggcuucacuucacagaagaagcucccccuccucaaaagaagcacaaaaaggaauggaagaaggauacaggaaauaaacuccaaugcuacgaaucacacuaaguuuccauuucccuccacuaauaauagcuguaacaaucccuuggggagucacaaaagggugggaucuaccuaacuuaaccuuagagggcauuccuuaauugaaauccuaaguaaguucuucuacugcaaccucuggauuagauuuuguguguguguguguguguguguguguguguguguguguguguauguguguaugugcaagacagucucgcuuugucacccaagcuggaguauauuggcgugaucuuggcucacugaagcauugaccuccuggguucaggcugcccccuaguaggugggacuacagacgcaugccaccaugcccagcuaauuuuuuuuugguauuuguuguagagaugggguuucaccauguugcccaggcuggucucaaacuccuggacucaagugauccucuugccucggccucccaagguacugggauuacaggugugaaccaccacacccagccuggauucaauuuuuaccaguuuauacuccagaacaucuccauauucccacuauaguccuuaaaucauauaggcaggggcguagccugcagagccuacuacucaaaugccauaaauuuuuacggaaagaaaaauagcaacugucacccuaacagaacugaaaauaaaguaggcagguucguggaacucuuccucagauacugccagugggacuuacuguugcaauuucucgagcuccucagccuccagcucugcuguacuuuugcaggucacagcccgugcacgguguuugguuugcaguacaggagucugugggucucugcaaaucuuggucacagaagauuuggaggguaacaggucuguaaacagagaugacagauguucaucuagauccgcaagacccaguuuacuuguaaguggugauucaccuauguagcccagagagggauaaaccaaccacagaguggugggcccacaacagucagcucagcuuacauuggucaaaccaaccaacauucaguuacuucuccccuauuccucuuuuauugagggguaugacuaagguagccuuuggguaaacucuacugucaucuucugaacugaaaauccauccaugucugacagguuccuuaucacugcacgggccuagacugacuuucuuuuuuuugagacagggucucacucuguugcccaggcuagagugcaggggcauaaaggcucacuacaaauccaaccucccuggacucaggugaucuucccaccucagccucccaagcagcugggauuacaggcaugcaccaccaugcccagcuaauuuuuauauucuuuguagagacaggguuucacuauguugcccaggcuggucuugaacuacugggcucaagcaauccacccaccucagccucccaaagugcugggauuauaggcguuaagccacugugccuggccaggccuauacuuucuauugacaaugccaauuauuuugcuuguuauuaacacaaaaaauuuuugcuuauuccagcuuuaagauauaaggccuuccuggccggucacaguggcucacgccuguaaucccagcacuuugggaggccgaggcagggggaucacgaggucaggagaucgagaccauccuggcuaacacggugaaaucccgucucuauuaaaaauacaaaaaauuaaccgggcgugguggcaggcgccuguagucucagcuacucgggaggcugaggcaggagaauggcaugaaccuggaaggcggagcaugcagugagccaagugagccaaaugagcgccacugcacucuggccuaggcgacagagcgagacucugucucaaaaaaaaaaaaaaaaaaaaagauauaaggccuuccuaaagaccaaguaaagccugaacagaauggcucaaaccuguaauucuagcaauuuagaaggccaaagcaggagaacugcuugaggccaggagcucaagaccagccugggcaacauaaugagacccugucuccuaagaaaauauaaaaauuagguaagcaugguggcaugcaccuauauauagucccaauuacuuggaaggcuaaggcaggaggauugcuugagcccaggaguuggacacugaagugagccaugaucacgccacugcacuccagccugggugacggagcaagacccugucucuaaaaagcaaaacaagaaggaaaauaaauaaauaaauaaauaacaaaagaagaccaagugaaaacucccaauuuuaugaaaucaauauaaaagcaucaagaccacaucuuacagaaaaucaaauggagaaaguuaaaaacuauguuaaagcaucaauauuaagacaucaccaccacucauugaaaauauuaauuuaccuggccagugaaaccuugucaauuuucauaacuaauauagaaugaaucuuucaauuuaggucuugucacauaacagugguagaucaaaaccaaaucuauuuuagaaauaagccauguuucaaagauacauguaaccauuauuuagcuguaacuguacaaaguuuuaaauaaaaauugcauaauauaauuucucuuuccuuuugccaggacuaguauucugaaagcaggacauaucagacucugagucauauauuauuugaaaaguuaugcuuaauauuuaaauuuccauuagaauaaagaagaauauuucauuauuuucauacuauaaaaucuaacaaaaucauuuuggccacuagaacauaauaauaauauuaaaaaaugcuguacuuggccaggcgcaguggcucacaccuguaaucacagcacuuugggagguugaggcgggcggaucacuugaggccaggaguucaagaccagccuggccaacagagcaaaacuuggucucuacuuaaaauccaaaaaguagcugggcaugguggcacacaccuguaaucccagcuacucgggaagcugaggcacgagaaucucuugcacccaagagguggacguugcagugagucgagaucgcgccacugcacuccagccugggugaugacacccagaacgagacucugucucaaaaaaaaugccuaugcaaggauauaaaaaauuuagagauccucaaagguaaaacaaccacauucugcuuuauccagaauacuaucccuauacucccaacaacuauuuaauaccaccuccacccuucagauuucaucuuccuucuugcagaaauuauuuccauaaagauagaaacuauuacauuagaauccgcucaucugcucaccaccaaaucuacaaacucccccaguauuugcacccauuccucccacucuuccauccuccuuuuaaagaacacucacuccaccugugcuaaguaucccuccaauaccugccugcucagggacuuaauccauuaguuaucuccucucucucguaccuucagcuucuuuaucucugacgagacuucucaacauucagacaugcucucccuaucucccaccuccuuugacucuugcaccucccuccuccucaaaauccccugccauaauuuguagugaccuguuuaucuaaugacaguuuaagaaugcaaagaacuaauuaguguaucucuaaugacagagauaaauaggucacuacaaauuaugguaaaggcuuuugaaacuugaugucgaguuuugaaacuugaauuagaaaccugauguugaguagcaccaagucuauuuuauuuaccucuauauaccuaacacagugugccugguuaguaguaguaaaaauuuugguggaccacugaauaaaaagcacauagccuugaaugaaugaaaugccuucauuuucuauagguaacuaaaugcaaugugacacuuugacacauggcaaaaaaauguccguuaaggauguguaaugacaucucagguuaccuuaacucauuccccuuggccaauuauugaugaggaggaucaagacgguugauggguauaagacagacagcugggugguuugaaaaauucugaaggauacauuuguugucugcauagucacacgccauacuuuaauugaaaaacuaggauuucagcuaaagacaaaucugugccuaagauguaagcagagggaauguaggagagguuccauccaacugugauacugguaggaaacuuacuaauaucauccuucuugcuccucaaaugauaucuguuagggguucguuuauggaagucuucaacuugcugugcaaggggcacauauguagaaacuguuucaucaaauguucuuuucuuuccuugggacagguugaaaggcuuaacaaugguacaucccuuagucacucgggccuguaaagagaaaaguuguuccccaaaugaaaugucacggaagagcucacaucuaccauaagccacauauucggcacagaggaucaauaaaaaaggccuguguaaaaccaagauuauuauucugaaguuugucaguccuugagcaaggguuauaacuaaucuguucucauuaaaaaaaauuaaaaauggaagaaaggaucuagcacuuaacaaaucuuauguucuggaauaguacauagguaauuuccccccaaccaugucaauguuuugaaggaauccagaguaagcuaucuuagaauugaagacaaaaagcacugcaaagaaaucucacccucaacuccacuuuaaaaaaaaaaauugauugggccucuggguaugcaucaggucaggcagcuuccugaaucaguggaaucucuccauacauccccuaaagagacugaugaagaagccuauuccuauuccuuggaccaguaauuuugauaaaacuggucucuaauuggaagcaaaacccuucaaggaccuguaucucaaagaaagaagcauaaccucaggguuuaagaaugcaaauaacuaauuucaaaaaaugaugauacugacuacaaaugcaaguggagauuauuaguacuagcauuuuuacuuaacgauuauuacugauuuuguuggugcucugguaacaaaacugcaugagauuugacuggucugccccaacccuauuuuuccuauaagaucuguuauauuggccaggcaugauggcucacacuuguaaucccagcacuuugggaggcugaggcagguggaucgccugaggucaggaguuugagaccagccuggcuaacauggggauacccugucucuacaaaauacaaaaauuagcugggagugguggcaggcgccuguaaucucagcuacuugggaggcugaggcaggagaauuacuugaacccgggaggcggagguuacagugagccgaaaucgugccauugcacuccagccugggcgacaaaagugaaacuccaucucaaaaaaaaaaaaagaucuguuauauuuuacacaacuuuauagacacaagguuuuuuuucucaauuauacuauuauaaacagugaccacaaaugcuacacguaaaauccuaaaugaauauuaguaacagaaauguucauuuaguccaucaacuuacaggagaugaaggaugcuuucguaguucagauguaaaguucacuuccuuauauuccuccugguucuuaggauguuguuugauucgcucaucugugcggaaguggaagucaacugauuuggugaccuggcucacugauuucuucacagguugcccugagagaugaacacaguaaaacauacagacaacauuaagauagggaacaccaguaaauccccuuuacuccaguccuuuugcuauuucugucaccauggaucuaacuuugcuuacuaucuaccuguaacccaaaacuugaaguaguccucagggacacuaauauaugugucauauucacugaguacuauuagguuugaggccuuucagucagaugcaaacuaaaaaaaaguaguagcacaggguagaagaaucccaucuccuagguguggucauagcuauggagaaaaagaauaacuggaauacuuuugauaagaaaagcuauggauugacuuugaaagcacaguuaacucagcaucucuaagaggaaaauccuauaaacuccaggggugcuuuuucaauccaguaaggagaacuuuauaguuaugacuccaccaauaacaacucuaugcccgagcaaagcagaacugugaccccuucagcucucucagucauauuuuuccuccacaggugaauuggauuugacuguuuucuuuuccuuugccuuuagaaaaaaauaggaaaacaacaaacuggucugcccaauuacuuuaucuucugucucaauccaaguuccuuuuuuucccuaagaccaagaacagacuuuuaagaaaguaccagugagccaggcacgguggcucaugccuguaaucccagcacucugggaggcugaggugggcggaucaccugacgccaggagcucgagaccagccuggccaacaugaugaaaucccaucucuacuaaaacuacaaagaacuagccagacguggugguggaccccuguaaucccagcuacucaggaggcugaaacaggagaauugcuugaacccgggaggcagagguuguguugagcggagaucacgccacugcacuccagccugggcaacaagagcaaaacucugucucagaaaaaaaaaaaaagaaagaaaguaccgauauauuuaaguaccaauauauguaaaauaccaauauauguagaaagugcuaaggaauaaacacaucuuuuuuaugcugacuacuaaaugagaaagccuuuuuauuuacuucagagacuucaaaaacaccuacuggccgggugcgguggcucacgccuguaaucccagcacuuugggaggccgaggcggguggaucaugaggucaggagauggagaccauccuggcuaacaaggugaaaccccgucucuacuaaaaauacaaaaaauuagccgggcgcgguggcgggcgccuguagucccagcuacucgggaggcugaggcaggagaauggcgugaaccugggaagcggagcuugcagugagccgagauugcgccacugcaguccgcaguccggccugggcgacagagcgagacuccgucucaaaaaaaaaaaaaaaaaaaaaaaaaaaaaaaaaaaaaaaaacaccuaccaagaguguuaagaaccaccccucaugaaucagacucaaccacagccaagcucaccuauuccagccagagcaaguuucuugaauucuucauucuuuuuccgcaucuccaccaccucuugcugcauuuucauacucuucuccagcucuugcuccucaguacuuuuuagaaacuucugccuaaagagaaaaucaguaaaugagaagagaggagaggagaaaggcacccagugacucaaaagaaucuacaggcauuauauaauauuuuuaaccugugauaagauaaucaucaaaaccaaaaaauaucaucuaauaaauagaugcuaacuuaauuagauaacaccaugaaaauaaauaaaaaugcacacuuuggccaggcaugguggcucaugucuauaaucccagcacuuugggaggccaaggugggcagaucaccugaggucaggaguucaagaccauccuggccaacaugguaaaauccugucucuacuacaaauacaaaaauuaggcaggugugauggcacacaccuguaauucuagcuacuggggaggcugaggcaagagaauugcuugaaccugggagggggagguugcagggagccaagaucacgccacugcacuccagccuggccacagagcgagacuccaucucaaaaaaaauaaauaaauaaagacaagaaaaugcacacuuuauaccaaaauacugaaaaaauuucagaagaaaauaacuaaaauagauuaaaauauauuacaaaauauccauaaauaugaucauaaacgaugagauuggacugggugcaguggcucaugccuguaacccagcacuuugggaggccgaggcggguggaugaccugaggucaggaguucgagaccaaccuggccaacauggugaaaccccaucuuacuaaaaauacaaaaauuagccagauguaguggcaggcaccuguaauccuagcuacucgggaggcugaggcaggagaaucgcuagaacccgggagguggagguugcagugagcuaagaucacgccacuguacuccagccugggcaacagagugagacuccaucuccaaaaacaacaacagcaacaacaacaaaaaagauuagguuguaagccacaagaaaaacuaaaagaccaguagaagccuagugcaauggcaugcccuuguaaucccagcuacuuggaaggcugaggcaaaaauauugcuugagcccaagaguucaagaccagccuaggcaacacagcaaggcccugucucaaaaacaaaaacaaaaaaagaccaguagaaugaggaaaguaucuacaaccuaggguuaauacacauaaaacacauguaacagaaggaagaaacucagaaguaaagccgacuaaaucccaacccugucauuucauuugcugccuauaaugaucuugagaaaacuauuuaacuucccugagccucaguuuuccccacugugaaaugggaguguaaauacucauguucacauccuauuuaugacuguucaaucagaugaugucucugaagugcuugacacaugguaauguucaacacagaguauccauucuuaguaaggaaaauaucaccaaggacacuuauaggcaaauaagguuaccaauaagaaaaaaaauaaaaaggaaacagauaauucacccaagaggaaauauggaaaaauguuuacaauaguagcaguaauacaaucuugucagcaaauacauaaaaauuaaaauaauuugaugcuggggguugggggaaauggggagaugacgauuaaagaguacaacaaaucucagacaagaggaaaaagauuuuucuuuugcucuacugcacaggguggaggauaucauuaguaaucguaauacacuaagagaauaaauuccagccaggcgcgguggcucaugccuguaaucccagcacuuugggaggcugaggcagguggaucaccugucaggaguuugagaccagccuggccaacgugguaaaaccccaucucuacuaaacauacaaaaauuagcuggguauaguggcaagugccaguaaucccagcuacucgggaggcugagggaggagaaucacuugaacacgggaagcggagguugcaguaagcugagaucucaccacugcacuccagccugaacaacaagagagaaacuccaucucgauaaaaaaaaaaaaaaauccaaauguucucacuacaaaaagugguaaguauuugaggugacagauauguuaauuagcuagauuuaauuauuccaaauuguagucaugaaucauaacaucacuuuguacuguauaaauauauacaacuauaaauuaucaauuuacaauuaaauuuuuaaaauaauaauuucaugccaucuauaugaauuuaaaaaaagaaacaauuuuauaaguuaauaaacaaugcagaugagauaauaagaaaauaaaaauauucauucaaagccaauggcacuucaggccaggcaugguggcucacaccuauacccagcacuuugagaggcugaggcgggcagaucacuugaggucaggaguucgagaccagccuggcuaacaucaugaaaccccaucucuacuaaaaauacaaaaauuagccggggccaggcaugguggcucacaccuguaaucccagcacuuugggaggcugaggcagacagaucccuugaggucaggaauucaagaccagccuggccaacauggugaaacuccaucucuacuaaaaauaaaaaaugagccaggugugguggcaggugccuguaaucccagccacaugggagacugaggcagaagaauugcuugaacgugggaggcagagguugcagugagccgaaaucgugccacugcauuccagccugggcaacagagcgagacuccgucucacaaaaaaaaaaaaaaaaaaaaaaaauuagccggguguggugaugcaugccuauaaucccagcuacucaggaggcugagguaggagaaucacuugaacccaggaggcggagguugcagugagccaagauugcgccacuguacuccaaccugggugacagggugagacuccaucucaaaaaaaaaaaaaaaaaaaaaaagccgauggcacuauaaauugguacuuccauuucagaaguaaaauuggcaauaaauaucaacacugacaaaacuggucauacccuguggggaauuucuccuuccuuauucugagaagaucacucaaagaaaugguucugccuauaaaguuguugacugaguacuuauaaucaugaaaagcuggaaacuacauuuucaacagaaaauaguuaaauauauuuugauagaauauuaacaaucuaucaaaaaaggauaaaugugaaaauuuuguagcagcacagaaacaaaaucugaaauaaucucauggcaagucaauaaagcagaacccaagguuuuguauuaacugauugugaaaauauguaugcuggcuuggguaaaauccagcagggagguuggaaaaauaaaaaauguucaaucuacgugguaagaacuguugcuaacuuuuuccuuuuauauuucuuuuaaauuugcuucaacaguauauuuuucugacuguucaagaucugagcaccagccagcacuguggcucaaaucuguaaucccagcacuuugggagaccaaggcaagaggacugcuugaggccaggaguuugagagccugggcaacauagugaaaucccaucucuacaaaaacauguaaaaguuagccagguaggcugggcacaguggcucacaccuguaaucccagcacugugggaggccaaggugggcagauaacuuaaagucaggaauucgagaccagccuggccaacauggugaaaccccaucucuacuaaaaauacaaaaauuagccgggugugguggugcacaccuguaauccgggcuacucgggaggcugaggcaggagaauuguuugaacucgggaggcagagguugcaguaagccaagaucaugccacugcacuccagccugggaaacagagugagccucugucucaaaaaaaaaaaaaaaaaaaguuagccaggcaugauagugcaugccuauagucccagcuacuugggaggcugaggugggaggaucacguaagcccaggaggucaaggaugcagugagccaugauugcaucacugcacaccaaccuaggcaacagaaugaggcccugucuuuaaaauuaauuaauuaaauaaaaauuuaaaaaucugagcacccaucaggacacauguaacaauucaccucaccauggucaaagcuucaggaguuugccaaccuccagguacaccaaacagguuguagauguaaaucuguaauuuuauaccauucauucuaaaguuuaaauucaggaaagaaacuuacuuugcagguggcauacaaggcacaguaugucuacccuuggcuuucucuggggaagaugcauucuuuucagcaguaucuugaugagcacugccuucuuccucuggcuucuuuuuguuguuagaacuugaguucaaaaggacaaaaaauauguuuucaauucccugaagcauagccuguacccuccuccccaaaucuacugcauauggauuaaauuuucucauucuauaggauaacaagcaugcuucgaccacaugauucuuccaacaguaucauuagaucauauauauuaauggcuucaaugaguaaacuuugagaaagccaaccgcuaucaagauaagaguuaucuaguggugguuuggaagaguaaggagggacucuaacugcucaccaucaaaugaucaaauggcagaguuaauugccaucccaauaucuauucugucucuuucucauuaacaaaaccccaauuucgggaggagcagcaacgcacuaagcuacaaguaaguauuguacuugccucaacagccucuacugcaacuagggaauccaagugacacaagucuaggcgaaugaaaugaaauuuaaggguugcugcgaaagacuuaaguuuccugauauagaugcugcccuuuuuccuuuacuguacucuucuucuucucuuaaacauaaauauaacaccuagagauacaccagccaucuugugccagugagacaacaagcaaaagaaaaaaucuaagaaacacagagcagcaucuugaagaacaaguacgaaaaaaaaaaaaaaaaagcuaaaaaucagccacugaaccaaagccagcagcaaacuacuuuuagaccucugugaaacaaauaauucauuauucuuuaaaccacuccaguugaagacuauuacuugcagcaaaauacauucuuaacuaauaaaaauauaaacaaacaucauguaugcagcuuguuauuagccguaaaaacaaaaagagguaaaaccuaugccaacuaagaugugagugcccuccaggacacacguaacaauucaccucaccauggucacaguuuuaggcauuucucaagcuugagguacaccaaacauauuacagauguaccauuuuuaauuuuaaucuauucaaucuaaaguguaaauucagaaaagaaacuuacaagugguauacaagguacaauaugucugcccuuggcaguaagaaguuguggcuacucacacuuucauuuucuuagaggguagaauuucaucgaugauuacaggaguggcacaucucuuggcuuucauuuuuacaugaugcuuuucuuucuguuccaaauccuucugagcagaaagccuaagagaucuucuaugguagagaaauugacaaaauauauaauaaauauauauacuacagauauccaaauguuccugagaaaugugaaaggaugucaaacuacaaagggcaauaaaauggagugcuauuaucucugcucuaaaaaucuaaucucucuuguugauaguuuuugaaauucaaccauaacauuuuaguucuuaaauacaccggugucuauaaaugugaccucaauaaaaugauuaaaaagaaaaacuuggcugggccugguagcucaugcuugccauccuagcacuuuggaaagcugcggcaggaggacugcuugaggccaggaguucagaccagcaugggcaacauaucaagacccugucucuacaaaaaauuuuuuaaaaauuagcccuacgugcuggugcgcaucuguggugcuagauacuuaggaagcuggggcggaagaaucacaugagcccaggaggucaaggcugcaguaagccaugagcgugccacugcaugccagccugggcaacagaguaagacucugucuaaaaauaaauaaaucaauaagaugaauacaaaacaaagagcauaaugacagaucuaauacauaccaaaaagugcacaaaacaaaaauacuuaaaugacuacaaaguggaagaccuuaugaaaucaccaccuaggccaaaauacagaacacugacaaccacugcuaccuugauuuuaagagugaucauuagauaggcugggcgcgguggcucacgccuguaaucccagcacuuugggaggccgaggcaggcggaucaccaggucaggagaucgagaccauccuggauaacauggugaaaccccgucucuacuaaaaauacagaaaaaaaaaauuagccaggcguggcggcgggcgccuguagucccagcuacuugagaggcugaggcaggagaauggcgugaacccgggaggcggagcuugcagugaaccgagaucgcaccacugcacuccagccuaggcaacagagcgagacuccgccuugaaaaaaaaaaaaaaaaagcgugaucauuagauaauuuccuuauuguuuuaccaaauaagcacguauuacguaaacaugguauguuaguuucgaagaaaaacaaaaaauuuugugguuuuuuuuuuuuauuauuauacuuuaaguuuuaggguacaugugcacaaugggcagguuaguuacauauguauacaugugccaugcuggugugcugcacccaaaaauuuuguauaauguaaccacacuacuacaaguauucuuuucugucuggcuuaucucacucaacuuuauguaugugagauucaaccacgacaauucacacagcucuaauucacugacuuucauugcuguauaauauucauuguagggaugugcaacuauuuauucagucuacuauugauggguuaucuccucauuuuaacuauucuaaaaaaaauaagauugcugggucauaggaaauuaaugugcuuuucucugaugaucagugaaacugaguacauuuucacauguguaucggccauuugguugucccuuuucguaagugcuaguuuaagucguuugccuguuuucuacuggcuugucaauucuuuacuaauugauuuguaauucuuuguauacucuggauauaagcccuuuguaggauucauggguuacaaauaguuucuccuacucuagggguuggcuuuucaucucuuuaucuuuuaauuagauaaaugugccugaauuuaucaaccucuuccacccccauuauggucagugcuuuucuguguguguccuguuuaagaaaucuuuccggccgggcacaguggcucacgccuguaaucccagcacuuuaggaggccacggugggcggauuacaaggucaggagauugagaccauccuggcuaacacggugaaaccccgucucuacuaaaaauacaaaaaaaaaaaaaaaauuagccgcgcguaguggcgggcgccuguagucccagcuacucaggaggcugaggcaggagaaucacuugaacccgggaggcggagguugcagugagccaagaucgcccacugcacuccagccugggcgacagagcgagacucgucugaaaaaaaaaaaaggauggcaugugucgggcaugguggcucacgccuguaaucucagcacucuaggaggcauaggugggcagaucgcuugagcucaggagaucaagaccagccuggacaacauggaaagacacuaucucuacaaaaaauacgaaaauuagcuggccaccuggugcccugcaccuguagucuccacuacucaggaggcuaaggcagaaggauugcuuacaccugagaggucgaggcugcagugagccaagaucaugccauugcacuccagccugggcaacagagcaagacccucucucaaaaaaaaaaaaaagaugaaauuuuugaggcaaaauuucagaagcaagaaaaccacagagaggguaaacacuaaacucugauuauaaacucuacucuggccugggugcaguggcucaugccuguaauccuaacacuuugggaggcauagguggguggauugcuugagcucgaguuugugaccagccuaggcaacaucguaaaaccuugucuguacaagaaauacaaaaauauuagcugagcacaguggcuugugccuguagucccagcuacgcaggagguugaggugggaagacugcuugagcccaggagguuguggcuacagugagccaugaucaugccacugcacuccagccuggguaacugagcaagacucugucucaaaaauaaauaaaauaaaaauuugucuauuggcuggaugcggugguuuaugccuauauagucucagcacuuugggaggcugaggcaggaggaucacuugaacccaggaguucgagucugcagugaacuaugugccacugcacuccagcuccagccugggugacagaacaagacccugucucaaagaaaaaaaagaaaaagagagcuaaaguaauacagaagaacaaagauauuugacaucaggaagauguaacaauuauauccauacaaggccuuuggaaacagauugauaagaguuugaaucuuggcucugaaauaaacuugccuuaagcaagcaacuuaguaucucugagaccuuaucuauaaauuaauuaagcauauuaccuacaacucauaaauguuauacagauuuuuuuuaauuuauaccaaccacacaaacccauauuaugaggauuuuuaaagguaacauagcugggcgcaguagcucacgccuguaauccuagcaguuugggaggcugaggcgggugggucaccugaggucaggaguuugagaccagccuggccaacauggcaaaacccuaucucuacuaaaaauacaaaaauuagccgggugugguggcaggugccuauaaucccagcuacucaggaggcugaggcaggagaauugcuugaacacgguggggcagagguugcagugagccaagaucaugccacuucacuccagccugggcaaaagagcgaaacacuccgucucaaaaaaaaaaaaaaaaaaaaaguaacauaaagguguccauaaacacaguauagacacauaauagauguucuguccaguaacuauccuuugaacauuauuaucauaaccaccacuuugagauuccaaagucuuaccucugaggcugggcuggaguuuuucuugauauggcugccucaacuuccagggaagaacaagcauuugacggaauggauuguuccacaagauuuucuuuuucugccucuuuguaguaaguguugucaacugcggaagaccaaaagcuagucagcacucaaaggccaaggaaaauaauuggagaugagacacacacacacacacacacacacacacacacacacacacacccugucuaagccacagaaaccuuaguuccaguuaaaucuuauacagaagaccaguuuauaaaagcuacuuugguugaaacagaaaugauguauccagggcuugccuauuugccagccuaagguacuaccuuuaaaaaaagcaucccaaacacaaucucaugacauuucaggacacugguaaagauaaaauucugaaagcuuccauaaagaagaaaaaaaaucacuuacaaaguaaggaaaauuagauaagcacugaauuuuucaucagcaauacauaaaaauagaagauaaaggaacaaugucuuuagaguagugauaaaaaauaauuugcaaucuauaaugcuguauuaagauaaacuuucaauuguauauaaaagugaaacaaugccauuuucaaauaugugagaacucaaaguuuuucucuccugcacuaauuuaagaaaguuuccugaggaugcacucccacauaaugaaggaguauauccagaagaaaguuauaagguccaggaaacaaggcagcaaagauaguaaaaauaauaaugcucucccaaaaaaguaguaauaacuuccaaggaucauuguccaauaugaagcaagauaaaguguggcagaaauuuaagaaauugauaaaguuuaaagaaaagcaaauccacugaucuccugaugucagaaucaucuuuauguggcucagggguugugacaauacaaccaaagauagccaaagaguaccaagaagggaugcaacugcaucacaguuauugaucuggcauugaacaauauuuauauaaucauaacauuguaaauacugcugauauaaucauacuaucaggcauuaugaauguaaccacagcacaaguuaaaauagugaguuaaaacagcuacugggaagacggaggcaggaagaucacuugagcccaggauuuugagaccagcuugggcaacacagugagaucccaccuguaaaacaaaauauaaaaacaaacaacaacaacaacaacaaaaccaauaugaguuugagaaaaaggacaggggguagggaugggaagagaaagggguuauuuuaacauaaacucuaaguauuguuagccauguuaccauggccauguuuuauuuugauaaacguuuuuuuuuuuuuuuuuugcuuuucaauauuauauaaauagagaugggggucucaguauauugcccaggcuggucucaaacuccuggccucaaucaauccucucauuuuggccucccaaaguacugggauuacaggcaugaacuacaagcccagccuugauaaacauuuuuaacgaaauagaaaaaaaguguuaugggaacacugagaaaguuagccagacaugguggaaugugccuguagucccaguuacucaggaggcugaggcaagaggaucacuugagcccaggaggucaaggcugcagggagcugugaucaugccacugcucuauagauggggugacacacugagacccugucugcaaaaaaaaaaacaaaaacaaaaaaacaaaacagaauaagaaacaaguaaaggcuucauggaagaaacagcacuuaaucacauagcauaugaacugacuccugauaaaggaauuaaacugcaacaagaugacagggaagaaaagauaggccaugaaaacauaguuuaggcauuauucauuucagagaacaaucauuugguucaucuccuaaagaaauauuuuuggggcagagagacucacacgcacacacaaaauaauagcauagcaugucaaggcuaaaauagaugcauuuauuccaauuaaaaugcagcaacaauaauauuaaauaauaaagcaagacccaauuauaugcugucuacaaaaaaaugcacuuuaaauauagacauaccaugcuaaaaccaaucaaaagaaaacuagaguggcuauauuaauaucaggcaaaguagguuucagagcacagaauuucaauggggauaaagaagaucauuucaaacuguuaaaguggggccaggcacaguggcucaaccuguaaucccagaacuuuggaaggcugagguggguggagcacuugagcccaggaguucaaaaccagccuaggcaacauggcaaaauucugucucuacaaaaaauacaaaaacuagcuaggcaugguaguggcaucuguggucccagcuacucaagaggcugagguaagaggaucaccugugcccaggagguagaggcugcagugaggcgugauugcuccacugcaguccagccugggugacagagugagacccugucucaaaaauauauacauauacauguauguguacauguauguacacauacauguauauguacauauauacacacauacauguauauuagauguauguacauauauauaugcuuguguguauauauauguguguauguguguguguauauauauguauauaauuuuuuguuuuugagauggagucuugcucuaucgcccaggcuggaguacaguggcaugaucuuggcucacugcagccuccgccucccagguuucagcgauucuccuaccucagccucccgaguagcugggacuacaggugcgcaccaccacacccggcuaauuuuuguauuuuucaguagagacaggguuucaccauauuggccaggcuggucucgaacuccugaccuugugauccgcccaccucagccucccaaagugcugggauuacaggcaugagguaucacguccagccaaaaaaaaaaaaaaaauuaaauuuaaauuaaauuaaauuuaaauuaaauuaaaguggccaauucaucaacgugacauaacaauccuaaacauuuaugcaucuaauaguagcuucaaacuauaugaagcaaaaauuauaaagauaaagagacaaauccauaauuacagucugagauuucacuaccucucucucuaauugauggaacaaauggaaagaaaaauuaguaagaauacaacagccauaaauaauguauaagcaggacaggcgcaguagcucacgccuguaaucccagcacuuucagaggccgaggcagguagaucaccugaggucaggaguucgagaccagccuggccaaaauggugaaacuccaucucuauuaaaaauacaaaaauuaucuaggggugguggcagaugccuguaaucccagcuacuccagaggcugaggcaggagaaucacuugaacccggggggcggagguugcaguaagccaagaucgcaccacugcacuccagccugggcaacaagagugagacucugucucaagaaaaaaaaccuaaaauucacauggaaccacaaaagaccccauauagccaaaccaauccuaugcaaagagaacaaagcugaaggcaucaaauuaccagccuucaaaauacauuacaaagcuauaguaaccauaacagcaugguacuggcauaaaaacagacacacagacaaauggaauaggauagagaacccaggaaaaaauccacguauuuauagccaacugauuuuugacaacagcaccaagaacauuccuugguggagggacagucuuuucaauaaauggugcuagcuuugggaggcugaagugguaggauuguuuaagcccaggaauucugagacaagccuaggcaauagaguaagaccucaucucuaaaauaaaauuuaaauuugaaaaaucaaaaaauggugcugaucaaacuagauauuuaaaugcagaaaaaugaaacuagacaucuauuucuuaccauauacaaaaaucaacucaaaauggauuaaagacuaauauguaagaccuuaaacuaugaaacaacuaaaaacauaggggaggccgagggcggugguucaugacucuaaucccagcacuuugggaggccgaggugggaggaucacuugaagucaggaguucaagaccagccugaccgacaucacgaaaccccaucucuacuaaaaauacaaaaauuagcugggugugguggugcgcgccuguagucacaacuacuugggagguuggggcaggaggaucacuugaacccgggaggcggagguugcagugagccgagaucguacuacugcacuccagccugggcaacagagugagacucugucucaaaaauaaauaaauaaaguaauaaaauaaaaacauaggugaaauacuuuaggacacgguucugggcaaagauccuaugaacaugaccucaaaaguauaggcaacaaaagcaaaaguagacaaaugggauuauauuaaauuuaaaacuuucugcacagcagaggaaacaaucaacagagugaagagacaacuaaagaaugggagaaaauacgugcuaacuauucauucaagaagggacuaauauccagaauacacaaggaacucaaauaacucaacagccggacaaaugagcugaacagacaucucucaaaagaacacauacaaauggcaaacagguaugugaaaaaaugcucaacaucacuaaucaucagggaaaugcaaauuaaaaaucacaaugagauauccuuucaucccaguuagaauggacacuaugaaaaauauuaaaaauuucucugcaucccugaggaugcagagaaaggagaacucuuauauauuguuaguaguaaagucaauuaguacagcuauuauggaaaacaguauggaggcuccucaaaaaauuaaaaauauaauuaccauaugauccagcaaucccccuacuggguauauauccaaaaagaaggaaaucaguacaucgaagagauaucuaugugcacuccuauguuuauuacagcacuauucacaauagucaagauauggaaucaacugaaguauccaucaacagaugaacagauaaaauguggcauauauauauacaauggaauacuauuuagccauaaaaaagaaugaaauucugucauucauggcaacauggaugaaccugaaggacauuauguuaagugaaguaagucaggcauagaaagauaaauauugaccgggugcaguggcucacgccuguaaucccagcacuuugggaggccgaggugggcggaucacaaggucaggaguuugagaccagccuggccaauauggugaaacccugucucuacuaaaaauacaaaaauuagccgggcaugcuggugggcgccuguaaucccagcuacuugggcagcugaggcaggagaaucacuugaacccaggugguggagguuacagugagccgagacuauaccacugcacuccugccuggacaacagggugagacgccagucucaaaaaaaaaaaaaaaaaaaaauuaauugaaggaggggugacaggagggaggugagaguagucauauggugugauggagaccaguuucagauuuacccacauaauacuuuucaaauguucuaaacugauaggaugaugguugcacaacucugugaauauacuuaaaaacacugaaauguuuaucuuaagugaaucauaugaugugugaguuaaaucuaaauacagcuguuuuuuucaaaagaaucaauuucaagaaggauuuuaugaccucuuaaagaaugcuucuuauguucuaaccaaacagacaauauucugcagauccaguacccaccaguuuaaaugucaaucaucuuuuacacuugaucuuagccaaaaggccgagaagcgauccaucaucuuuuaaaaucagauacauaacucaaagaauucuuguacaauggcaagcaguacagucuucuuucuugcuguuuuauuucccacccagacccagguuagguuacauuaaaucuugucacaaaaagauaacaguuacguaucuggcaauaaaauucuauguuagcccccgggaacaguagcucacaccuauaaucccagcacuuugggaagccccugaggcaggaagaucacuugaagcccggaggucaagaccagcuuggcuagcaaagacuccucuacuaaaauuuuuuaaaaaucagucaggcaugguguugagcaccuguagucccaguuacuaagagcucaggaguuugaggcugcagugagcuaugacugugccacuguacuccaccagccugggugacagaaccagaccccaucuuaaagaaaaaaaaaaaaaaauucuauguuagcuuaagcuccaagagauuuuuuuuuaaguguagcacaucauuaguuuuacauuuaucaugaaaugaauuagcccauuucaccaauaauaaacaaagagauagagcauuuagguaauuuucccagaaccucaggcuucuaaaacacugucccaccauucuaucaaggagcuuuuuucuaagauguuuucuuaccugguuucaaaggugugacaauagcuugcugaagauuagccuuucucaaaggaguuuugcccugaaaaagcccuccaguuccauucuuccccaguaacuuauucuccaaauuggccuucuccucugugaaaagggaagaucaucauugucugaucagcaaggaagcaaaacaaaucacuaucacgcauuuaaaaugcaaacuaaagcucccuaccaguacacuuccaacucauguggcaaguacaagcaaaguucuagcaaucaaaagaaaaaguacacauuacacauccgagauagacuauaagaacaaucacuaaaaacuggcaacauugaacaauguauuauaaaaaaggaaaaguacagauucugcauugugaauaacuccuuaucuuuguuugguacacauuuagggucauacaaauaugaacuggcuuuaucuacucccuaaauauaucauguuccucuuaaagaaaacuguaaccagccgggagcgauggcucacaccuguaaucccagcacuuugggaggccgaggcgggugggucaugaggucaggagaucgagacugucuuggccaacauggugaaaccccgucucuacuaaaauacaaaaaauuagccaggcgugguggcacaugccuuuaaucccagcuacuugagaagcugaggcaggggaaucgcuugaaccuggaagguggaauuugcaguaagcugagaccgcaccacugcacuacagccuggcgacagagcaagacuccaucucaaaaaaaaaaaaaaaaaaaaaacgaaagaaaacuguaaccaucaaaaacuguagggcuuacaagagauacuguauagucuuacagaguuuccuccucagugggguggugggaggaauaaggggugugugaggguagagcagagcuagguucucucaagaaauuuuaucuuagauucuacugugcccagaagucaguacaaagcagugaagggucuguucuaccaacagccuacugauaguuucaggaaugcagugagacacagcaauaacuacccugugcauguacauucugauugcaacuguguagaaagaugugacuauuuauuugggaaagaaauuggaaaguaauauauuaaaacugagguaguuuuguuagccaaaagaacucuggcaaaaacaaaaagaaaaaaaaauaaaaauguuuuaaaacuaagguaguuuuggaaaaauaguggggucauuuuuuuucuuccaaauuguauuuaacaguauucuuaggcuaaucuuuucuuuucuuuuuuauuuuaaagaaaagcuuagaaaaagaaauccucagacagcccagccauuuccuuacaguuccagugaagcaagggcauggggaagauccccgcaggacagcuggcccuuguauuuauuuacccuuccucccacaccacuuccaacagacgacuccucucaggauccccacuagaugccauuaaaguccuuuuccaaaaaauggcaccugucaacacauuuggacagugcacuauacggauaaguacagcugcaauggacucacuucuguuccccaccacauauucauagugauuucucccgauaaggaggauggagacaugagagaaagaaucaaaggggccucaacaacuagucucagauauuauuucaaaguaauguaaaaauguaaccacauucuuacuuaccauuggccaagcaauacuguuucugggaauggguucuuaguagcauaauccuuccauuuaaaaaugaauugagggccaggcgcaguggcucacgccuguaaucccagcacuuugggaggcugagguggguggaucaccugaggucagggguucaagacuagccuggccaacauggcaaaacacugucucuacuaaaaauacaaaaauuaguuaggcaugcuggugggcgccuguaaucccagcuacuugggcggcugaggcagaaccgcuugaacaagaguggcggagguuacagugagcugagauuguaccacugcacuccagccugggcaacagagcgagacuacagccucaaaaaaaaaaaaaaaaaaaaugaauugagggagggguggcaggagggaggugaggguaauuauaaaagaucuugacugugaugguagacacauaaaccaacacaggugauaaaaccacagagaacuuaauacacauacaaguaaaacuggagaaaucugaguaaaacugguagauuguaugaaugucaauauccuagcugugauauaaucuaucccuaaugauaguagacaaaguuuuuauguggcugccaucacuacagacauauuugagcauggaguuuuguugaacacugguucaucugaacuuucccauaggucccuaaagcuuaaaucugccauucugaacuacaaaacaacauaugcuuuguacuuacaauccauuccccaaauacugggcauuucaauuauucccauaauaucauggaugacagaaugucuuggugcagaaagaaguugauauuuuaguucuuuucuugcaaccccuucuauuauugaaaggucuucagcacaaagcaagccacuaauccuuaaaauagccagagaaagcaggcacuuaccaaaccaugaaucuauguuuugaguaucuccuucaucauccaaggaugaaaaauugaugaaauccgagggggcaucauaggaauaagagcuuuuaacuugugacauugucucccacuuaacgcagaagagcagguuuuucccaguauuuguaccacuuuucucagcaggucaccuucugaggaaagaaaugguugcacauaaaucuaaguaaauucccaucauuacuuugguuuuacuaccacguuuguaauuuugcaaaccaccuagaauuuacugaaaauagccuuacuuuguccaaucaaccuaaacauuaguuuuucagguaacuuaaagauacuccuugagguagauauguuuggaauuagaaagaagugggccagacacaguggcucacgucuguaaucccagcauuuugggaggagggaggaccacaugagaccaggaguccaaguccagccuacaaaacauagacagacccugucucuaaauaaauuaaaauuaucucuaaguauaacaguugacccugucucuaaaaagauaaaaauuaucuguaaguaguugacccuaucucuaaaaaaauaaaaauuaucuuuaaguaaucagcaaauauaaagaaaaaccaaaaagaaaaaauugaaauuaaaaauaaauuuuaggccaggagcaguggcucacgccuguaaucccagcacuucgagaggcugaggcggguggaucaccugaggucaggaguucaagaucagcccgaccaacauggcaaaaccucuucuguacuuaaaaaauacaaaaaauuagcugggcaugguggcaggcgccuguaauucuagcuacucgggagggugaggcaggagaaucgcuugaaccugggaggugaaaguugcagugagucgagaucgcgccauugcauuccagccugggcaagaagagcaaaacucugucucaaaaaaaauaauaauaaauaaaaauaaaauaaauaaauaaauuuucuaaauguuuuuuaaaagaggcaaaguuugauaaguaucuacacugugcuagguguuuuacauucaccaugucauuauuuucccucaauuuaccauuuucucauuucuagccuccucuagcccaauuuauucucucucugcccugaauaacccaauuucuaaaauacaccacuaauuuuuaugccuaccaaccaaaaucuuauccaucauucaaaguccaggucaaaucucuaugaacucuuucccaauuuccaccuaucauacaaaauuguugccucuccaaagccaauugugcuuuguuuauaucuccacuguaacacuuaucauccaauuuuauauuaacuauguaaaugucucucccaguagacucgaaguuccuaaaaacaaagauagauuuuacucacuuguguauaccucauccauccauccauccauccaaccaucaaggugcuuaacacagugcauuauacauaguaagaguucaacacaguuuugucaaauauaaguugucuuuucuuagaaauauucucaaaaaauacuauuucugaguauaaagacgacaacuuugaaauacacguaagagucacaacaugcagcauaggaacagaagcaaggauaagggaacaaguuaaauaggccccucccuacuccugcguacgaaguuuugcacucuaucuuguggaaaccugugaagguuuaaagucagcuccuacucaagccuaaucuaguuaauaaaauagcugaaaguaaucugauaaauagccuaaaggccacacucaguggccaauaauuugccaaugaaacccaaugagccauuugucuuuuuuuuuuuuuugagacggagucucacucugucccccaggcuggagugcaguggcaugaucccagcucaccacaaccucugccuuccggguucaagcaauucuccugccucagucucuaguagcuggaauuacaggcgcccacagccacaccuugcuaauuuuuuguuuucaguagagacgggauuucaccauguuggccaggcuggucucaaacuccugaccucaagugauccacccaccucggccucccaagugugagccaccgcgcccggccagccauuuguuuuuauccagggaacgacauguacuuaaaaguaucuguaucuuagaagggagguagaugccaguaaucacuugaauaaauguuuauuuaaauuaauaccuuucuaguguggcgcaguggcucaugccuguaaucccagcacuuugagaggccagggcggauggaucaccugaggucaggaguuugagaccagccuggccaacauggugaaaccccaucucuacuaaaaauacaaaaaagcggccgggcacgguggcucacgccuguaaucccagcacuuugggaggccaaggcggguggaucacgaggucaggagaucaaaaccaucauggcuaaaauggugaaacccugucucuacuaaaaauacaaaaaauuagccaggcgcaguggugggcaccuguaaucccagcuacucaggaggcugaggcauaagaaucccuugaacgcaggcagcggagguugcagugagccaagaucacgccacucuacuccagccugggugacaagagcgagacuccggcucaaaaauaaauaaauaaauaaaccuauaaugcuacacuauuccagaugucuucucccucauauauauacaaacuauuauuuuuuuaaaugaaucauugacaguuugaaucugcuucacauauuaugaauauucuuguaugucaauaaauauagacauaucaauuaauggcuguaucuguuccauaauuacuuauccuugauuuucagccuuuuuccaauauuuucacuuuaaagauacugcuaaagcaucauccuuguagcuaaauuucuguacacauccauaauucuucccuuaagauaaaucuuaagagguggaacugcugggucaaaagcucuugacacauacugugaaaaugucccucagaagaaaaaaacacccacuuacauuaccaggagugugccaguuccccaaacucuccccaacucugggcacugcagcacucauuuucucuaaacuauaccacauaagcuauccacugagaugaaucaugagauuaguuacucccaaccuacauagccguucagugguuuggccagcauuucacagcuucucucaguggacuagggcaauucaaaauggacuaggggcugagagugguggcucaugccuguaaucccagcacuuugggaggacgcggcgggaggaucacuugaggucaggaauucgagaacagccuggccaacauggugaaacuccaucucuacugaaaauacaaaaauuagccuggggugguggcugcaccuguaguuccagcuacucggugagaaucacuucaacccgggaggcugcagugagccaagaccgcaccacugcacuccagccugggagacagagcgagacucugucucaaaaaauaaaauaaauaaaaauaauguacuucugguccuuauagugucucagaaacaucuguuauuguuguuguuuuuguuuuguuuuguuugagauggugucuugcucugucgcccaggcuggagugcaguggcaugaucuugguucacugcaaccuccaccuccuggguucaagcgauucucuucccucagccucccaaguagcugggguuacaagcgugcgccaccacgccuggcuaauuuuucuauuuuuaguagagaugggguuucaccauguuggccaggcuggucuugaacuccugaccucaggugaucugccugccucggccacccaaagugcugggauuacaggcaugagcaaccgcacccggccagaaacaucuguuauaacaaauauuucauuuauacagugacaucaaucuagaccccagagaacaucaucuucccauggucucuccuaugcucacugcagccagaauuccacaaguaucuuuauaacaaugcucuaauugagguacuuaguguagaaacaugauauuuuagaauugggaggaaacuuugauuaacaccuaaccuuugcagucuauaagauauuaacuuaaagcaaaaagggguucuccaagaucacacaacaaaaauccuaaggaucaugguaaaaacaguuaccagagguguucauuacaugccaggugccaugauauacuaaauauguauucuuucugauaugcaaaacaauccuguaaagcagcaauuauucccaaccuagaagcugaagaucagaaagauuaaaugacuugcccaguaucacacaguuacguaaaaacagagccagaucuggaccugaggcucgugacuucagcacaauguucuuucuacauccuucugcccucuuaccuugugaauuaaagaaggguguucaugaaguuaagcuauuugcauagaaaagaauacuguauuuauuuccaaguaaauccauucuccauagucuucugucuggaauagggguucuuugguauccccagucuaaauuuuccucucuccuccauuucuacuuucauuauuaagcuuaacucaauaagcuuuuugucagugguucacaauaguguguacuugcuaggggccauaagcugugugcccuugaauguuucucaguaacauucaaggaugacacucuauaucuucacacaaaaaguagaucuaagcggccaggcucaguggcucgcaccuguaaccucagcacuuugggaggccgagacagguggaucacagggugaggagauugagaccauccuggcuaacauggugaaaccccgucucuacuaaaaauacaaaaagaauuagccaggcaugguggcggucaccuauaguccuagcuacucaggaggcuaaggcaggagaauggugugaacccgggaggcagagcuugcagugagccgagaucacgccaccgcauccagccugggcaacagugcgagacuccgucucaaaaaaaaagaaaaaaaaguagauguaguccugaacacaaaggaacuuaacaucuacauagacgcuaagguccuaucauacacaauaaauaagacaguuuguuuaaauuauacaguaugaacucuaaguauagagaauuagaaauuaacauggcugaagucaagguacgauuaaauauuuuucauugaccaugaccaaaacaguagcaaguacauuaaaauggaaguuaccuccugauagccacuuuccaagcuugggguagccaugggacaguucuggccaaugagaacuaaguaagaaucugcugagggauuccuaggaaaaaauuuucuuuccugaaaacagcuauagcccuuauuccugcccuuucccuuuauccuucuucuugccuugaaggcaagcuggagcuauggcagucaucugguauacaugaguagauggccaagagaacaauaaacauagggcuuaacaucaaugagcuaaugacuauuaaagaucaaauaucagcuacuauauaccucuagacuucugguguuuuuuacaauuuuccaugaccugcuaaaaagacuucuuauacuaaaaaaaaauaggccaggcacgguagcucacaccuguaaucccaacacuuuggaaggccaaggcaggcggaucaccugaggucaggaguucgagaccagccucaccaacauggugaaacccugucucuaauaaaaauauaaaaauuagccaggugugguggcaggugccuguaaucccagcuacucgggaggcugaggcaggagaaucacuugaacccaggaggcgaagguugcagugagcugagauugcgccauugcacuccagccugggugacaagagugagacuucaucucagaaaauaauaauaauuauuguauaaaccauuauagccacauuuucugucaccuguagucaaaagcaauuccaacuaacagaaguccagaaugcccucucuggcauuuaccacauguauaugacaauaggcaagucacuaauucucugccuaccuucuuaccauaaucaaauaagaagcuacuucaagugcuaugaaauacacuauuguaagguauuaucacugcugauaccuuuccucuccuugaccacauuucuauucaaaggauuuuuagugaaagauuccaugguacugacagugguuaaaaaccccuugcugcaaggaggaaauuuuccuuuucuugugaacaaauaugcuagaagacaugggaaaaucuuggauucccaugaucuuaaugccuaacucaggucacugggaaggcuucccaggcaugaauguaaugaagacgacuaaagcugggggaaggaagaggcaggaauguaacaugcagcaaccccacuuagccucaaaaccaugauuccaccaaagcaugaugcugaaaacuaccuggaaaguguucaaauuuaacccuucacauccuuuuuuucuuucuuuuucaucucuguuuuuuaaagaaucuagccuguugcucaggcuagacucgaacuccugggcccaaaggauccucccuccucaaccccuccuaaguagcugggcaugguggugugugccuguagucccagcuaaucaggaggcugaggugggaggaucauuugaguccaggaguuugaggccacagugacccacgauugcaccacugcacucuaacgugggcaacagagugagacucugucucuuaaaagacaacaacaacaacaacaacaaaauaguuaagcaguauuuauuucccuagaucuauguuugcagcccaaaagaaacugagcuuucucaaauuuuuauuaaauauucaugacaagcaaugauugucuaaucucuugauuuaaggaaauaauccuucccauuuacguggccuauaaauugacuauuaacuuacccaaauguuacauauucucuuucuaauauuucuauauagaacuaccaaccuggccaacauggugaaaccccaucuuucuacuaaaaauacaaaaauuagcugaguuugguggcacaugccuguaaucccagcuacucgggaggcugaggcaggagaaucgcuugaaugcaggaggcagagguugcagugagccgagaucaugccacugcacuccagugugagacuccgucucauaaauaaauaaauaaauaaauaaauaaauaaauaaauaaauagccgggcacgguggcucacaccuguaaucccagcacuuugggaggccaaggcgggcggaucgccugaggucaggaguucgagaccagccucaaaauggagaaacccugucucuacuaaaaauauaaaauuagccaggugugguggugcaugccuguaaucccagcuacuugggagacugaggcaggagaauugcuugaaccugggggguggagguugcagugagccaagaucgcaccaucgcacuccagccggggcaacaagagcgaaacuccgucucaaaaaaaaaaaagaaaucgagaccauccuggccaacauggugaaacccugucucuacuaaaaacacaaaauuagcugggcaucguggcaugcgccuguagucccagcuacucgggaggcagaggcaggagaauagcuugaacccgggaggaggagguuccagugagccaagaucgugccacugcacuccagccuggcaacagaguaagacuccaucucaaaaauauaauaauaauuaauuuaaaaaauuaaaaauaaacaaauaauaagauuucuauauagaacuaaaaaugauuccuggggcauugacuuaauaaaaggguauauaaauuugaaaaaguuaaaaauaaaaacagcuauuaacuuuuuucuuuuuuuuugagacagaguuucacucuugucgcccaggcuggaaugcaguggcacaaucuuggcucacugcaaccucuggcucacggguucaugugauucuccugccucagccuccugaguagcugggauuacaggcaccugccaccaugcccaacuaauuuuuuguauuuuuaguagacgggguuucaccauguuggccaggcuggucuugaacuccugaccucaagugauccacccgccucagccucccaaacugcugggauuacuagcguaagccaccgugcccggccaacagcuauuacuuaaugagcacuuaugacaugccagacacuguugacagugucuuacauguauuaacucacuaaauccucacaauaauccuauaaaguagguacuguuauuaucuucauucuauacugagggacuugaggcacagagagauuuacuacuuauucacagucaugcagcuaagaagcaguaaagccaggauuccaaauggaauagacaccgaaggugguguucuuauccacugccuauuuauuuaaaaauagacauuuaagcugggcgcgguggcucacgccuguaaucccagcacuuugggaggccgaggcggguggaucaugaggucaagagauugagaccauccuggcuaacacagugaaaccccgucucuacuaaaaauacaaaaaaauuagccaggcguggugguggaugccuguagucccagcuacucgggaggcugaggcaggagaauggcgugaacccaggaggcggagguugcagugagccgagaucgcgccacugcacuccagccugggcaacaaagcaagacucugucucaaaaaaaaaaaaaaaaauucacauuuaaauagauaaauaacaaaugucauggagcaagagauaauaacuuccaaauacugucuacuguaggccaggcaccuuaccagacacuucacauaaaucaucucguuuaaacugcauuaacaauauagacaauagauagaugucuuuauaaauaaaugcuaccaucaccauuuuauaaacaaggaaacaagcucagagaaguuacacuauuccaagaucaccaaacuaauacauagcaguguugaguuuuaaaagaacaagucugcaggauuccaaaaucuggggucucucuaaugcacaaguuuuccuauaaacauugcuucaaaaaggagguagguaaucaaaucauaagauccuguucaacaaagacaaauccugcccuuuaugaaaacuaagcaucccugauaugcucauaaagaaaacuuuagcaaauuacaaauccuguuauaaauauauuuggaaagcucugaucugaaucuucccauaaauuuuuuaaaaaauccauugauuccucuuuuuuuaaguauacuuuuccauaugaaguuuuuccucuauauaagauggugguuagugaaaaccucagugauauucuagaguaaagagacuaugaagaggguucaagcagcagaagaaaggcuguccucugaggucuaagacuacauuugauuaguggggaacaaacggcgaggggugcaaaccuaaguacacuuaaucuuuaggugaaauuuuaaaaacaaaauauuauuuuccuaacaugaccuguucuuuaaaaaagcuucuuuuaagcuauauuuuggucuagaauggccaacucaggagaccauccccucucccuggaaaaagagaauaaauaaauacauauccauugagaagucugacucucuucaauuaaggcugauaggacaaguacaucaagaaaacgaaaagcuaacuacuggguaauuucgguuucacgacacuaccucccccagaaauaauaaauaugaggaugugaaaucuuccaaaauuaaaguccacagggccuagugggaaauggaacaggccagagccaaaggcagcuguuuaaaugagagagccccaggcauggugggaacuggaugccuuccugcgucccuuaaucaagauugaauuucugucaacaggucucaccaaaaaaaaaaaaaaaaaaaaggcacaugcgucaaccacauucccccaaacaaaucaaguugccaagcaagagaaucagcuucacauuucaaaauuaucugaaucuaccacagcuucagauucuugcaaaacuagaaauauucugcauggaaaaauagcuauuaaugaccaauauuccuacaaagacccaaggaaaaagccuauccuguaugcuaugaaccaauuagguuccucuaaaaacugccuauucaaugccauccaucgugucuuauagcccauuuuuguuuccaaaaagcgaagacuaaaacgauagauagauagauagauagacagacagacagacagacagacagagauagagauauaaaaucucggccgggcacagugacuuaugccuguaaucccaguacuuugggaggccaaggcaggcggaucacgaagucaggaguucgagaucagccaggccaacauggugaaacccgucucuacuaaaaauacaaaaauuagcgggcgugguggguacgugccuuuaaucccagcuacucgggaggcugaggcaggaaaauagcuugaacccaggagguggaggcugcagugagccgagauugcaccgcugcacuccagccugggacagagcgagacuccuucucaaacaacaacaacaaaaaaaaaucucuucccuccaagaacgcacaauugaaugggggaaugcaaacaauuacaauauagggcuauccuugcugcaagagggcauuaacagagagcgcucuggaagugcagagaaggagaacagcauaaaagaggaucagagaugguuuccugauguaaaaaauacuuaaaagauacagacagaccugcggaguucuacaagcuaagaaugaacguugacuuuuucuaggguaagagauaaauggaaggggaagacaaauacaaauuaggaagauugcagacaaagcaauguaaccuguucccacauucaucugaaauuaaccucccauugccucccaucuuucuucacucucaaaccaaaaauaacuagucuugacaagcucuauaaaucaaaaggugcagguucagaccggguuggggaaagcugcaagagggugcauucuaagcagggugaaauaggggacuaccagcuccugagcaaaacaaagacuuuggugugacagaugcucucaaacaccuugcuauccagucagugagauaugacuugccuauuucuauuaaagagaaagucaugaguuaaacugguaauauaauagaauaaacagaguaagacaagacuucauuagaaguauaguuaguuaagauggucccaucccaggcagugccauuucuccagggacauccucuccuacuuucacaagggauaagagauccuguuacauuaccacaaguaaaauagaguggaguuacuuucaucuuacccagagagaaaacaccuacauuuuuuucuuguauauaagggauuagcagcagucaguaaauggcaacauaauccagcaugcaauuuuaacuguuaaucaaagucacaaacuaagucugaaggaaguuuaauggacuuuguguuuccacauuuauguuugcuaacuucuauguugaaauuggaucuguuuacagaaacagaucuaugaagcuuccaaaauugggucaauuuaaaauccaaugacaaucccucacuguccaacacucagaagucagcacaggacacauggacacuuguucuaauucaucacuguccagaaacuucaagcaaauauauuuccuaucauuucucucccaaacuuguauguuucauauugcccuuuuuuaaggauuacaaacucaguuuugcuauaauuuauccauagaacucaacaaaccauaauccaccuaugacuaauaggaccuagauggaaaucaaugaugcuguuuacuacuaggacagauaaugacagagagcuuuguaaaauacuaaaaggaaaucuuaguagaaacccaaaguaaucugauauuccaauaguaugaagcugaaaaaguuuguaaugguugacaguguggcugcagauuacaauccuagucaaauagcagucauuucauuuuauagagauuuauucccuucaaaagguaucugguuuggggaauaacacacaaacacucaaacccaagaaccuaauaaaaguguuuauuagauggcucaugccuguaaucccagcacucugggaggccaaggcagguggaucaccugaggucaggaguucaagaccagccuggccaauauggcaaaaccccaucucuaauaaaaauacaaaaauuagccaggugugguggcgugccuguaauccuagcuacucgggaggcugaggcaggagaaucacuugaaccagggaggcagagguugcaguaagcugagauugugccacuguauuccagccugguugacagagugagacucugucuccaaaaaaaaaaaaaaaaaaguguuuaccuauggauggugagagugaagaaguaacaaggcuggaggaagauuuuaaaccaugaagcuuuuuauauucuuuugauuuuugcaccaugcaaauauauuaccuauuuuaaguuauacauuuaugccuaugugaauauauacuguuuuagguaaaucagcauaaucuuccuacaaggcaauuugguguuacaugucaaaaguuuuuaaaaauauguuuuguuuguuuguuuuuugagauggagucucgcuguugccuaggcugcaguagugcaauggcgcgaucucggcucacugcaaccuccaccucccagguucaagugauucuuccaccucagccucccgaguaagugggauuacaggcacccgucaucaugccuggcuaauuuguguauuuuuaguagagacaggguuucaccauguuagccaggcuggucuugaacuccugaccucaggugaucugcccgccucagccuccucagagugcugggauuacaggcgugagccaccgcgcccggccaaaaauacgcauucuuuuagaccagcaauuucacugguaaaaguaauauaaagaaccaaauaauggaauaccauauagccauuaaaauuauguuguagaaaaauuuggccagguacaguggcaugcaccuguaguuucagcaacucgagaggcuaaggcaggaagaucacuugagcccaggagauggaggcugcagugagcugugaucacgccacugaagugcacacuccagccugggugacagagcaagacccugucucaaaaaaaacaaaaaagaaaagagaagaaaauuuauuaaugacacgggaaaauauucauagccugauuauuaaguuaaaaaaauuagaggccgggcgugguggcucaagccucaaucccagcacuuugggaggccgaggugggcagaucaugaggucaggaguuugagaccagccuggccaauauggugaaaccgucucuacuaaaaacacaaaaauagccgggugugguugcgggugccuguaaucccagcuacucgggaggcugaggcaggagaauugcuugaaccugggaggcggagguugcauugagccagagaucgcgccauugcacuccaacccgggcgacagagugagacuccgacucaaaaaaaaaaaaaaaaaaaaguuaaaaaaauuaacaaaaguuuuuaguguaugauuuuuuuaaaaaugaaauacaguuggcuguccguaucuaugaguuccauaucuguggauucaaucaacugcagaucaaaaauauuugggggaaaaaaaacugcaaggccaggcacgguggcucacgccuguaauccuagcacuuugggaggcagaggcgggcagaucaccugaagucaggaguucgagaccagccugaccaacauggagaaaccccaucucuguuaaaaauacaaaauuagccagguguggcaugccuguagucccagcuacucgggaggcugagacaggagaaucgccugaaccugggaggcggagguuacgguaagcugagauugcaccauugcacuccagccugggcaacaagagcgaaacucugccucaaaaaaaaaaaaaaaaacugcaucuguacugcauauguacagacuuuuuuugagacagggucucuuucugccacccagguuggagugcaguggugcccucagcucaccguaaccucaaacuccuuggcuuaagugacccuucaccuuggccccccaaguagcugggacuacaaguaggugccaccacgcccgguuaaauuuuuuuauguuuuauuuuuuuuguagagacacggugccacuauguugcccaggcuggucgcgaacuccuggccucaagcaauccuccuauuuaagucucccaaaguggugggauuacaggccugagccacuguacccagccuagacuuuuuuucuugucauuauucccuaaacaauacaguauaacaacuauuuacauagcauuuacauuguauuaaguauuauaaguaaucuagagauaauuuaaaguaugugggaguauguacauaagcuauaugcaaauacuacacaucauuuuauaccagggcuugagcaucugagaauuuuguuuuguuuguuuugagacagagucuugcuggcuggagugcagugaugagaucuuggcucacuugcagccucugccucccggguucaagggauucuccugccucagucucccaaguagcugagauuacagaugcgcaccaccacacccagcuaauuuuuguauuuuuaguagagaugggguuuugccauguuggccagccgguuucaaacucuugaccucaggugauccgccugccucagccucccaaagugcugggauuacagacauaagccacaguaaccggccgcauaugagaauuuugauauccugggaaggucuuagaaccaauuccccauggauaucaaggaaugacuauauagacauagaaaaaaauuauaaagaaaucuaucaaaaggcuaaccaugguuuaucugagaggugggauagugggugauuuuauuuucuuuuugcuuuucauaauaaauaaauuuccuuccaaaauauguguuacuuuauaaaauuacauuagucauuuaaacacuuaugaagcugauauauuaauguuccuuauuccuauggucacugccuuaccugugguuuaaucagucuaucaggccuacaggucugacucaaaguugcaaucuucucuuucaccccuuuucugaaaucuugaagucuggcaaauauguaucaagaaccuggaagaagcagaaaagugaugaaacagguuccaaguucucuguaguaaaaaaggguuaacaggccgggagcaguggcucacgccuauaaucccagcacuuugggaggccaaggcagguggaucacuugaggucaggaguucaagaccagccuggccaacauggugaaaccccaucucuacuaaaaauacaaaaauuagccaggcaugguggugcacgccugcaaucccagcuacucgggacacugaggcaggagaaucgcuugaaccugggaagcggaagcuucagugagccaagauugcgccagccagugcacuccagccugagcaacacagugagacugucucaaaaaaaaaaaaaaaaaaagagcaaacuuuuacuacuuuguuuuacuaaguacaaauaacauuauuuuuaauuuccaaaguaaccucuagauacaauuuuauacuuuucucacuguucuuuauuccccuuuuaccaaguuucccuacacaaacaaaaacggaagcccuccgcaguuaucuauccuuuuuucacagaguaccuugggcugcugaucucuacaucucugucucaaauacagaucuauucacagaaucgcuuggguuaugaaaucucucuaaggccaggcaagguggcucacaccuguaaucccagcacuuugggaggccgaggcagguggaucaccugagauaaggaguuugagacuagccuggccaacguggugaaacccuguaucuacuaaaaauacaaaaauuaggccaggcacaguggcucacaccuguaaucccagcacuuugggaggccgaggcaggcagauuacgaggucaggagauugagaccauccuggcuaacauggugaaaccccaucucuauuaaaaauacaaaaaaacuagccgggugugguggcaugcgccuguagucccagcuacuugggaggcugaggcaggagaauugcuugaacccaggaggcggagguugcagugagccgagagcgcaccauugcacuccagccuagguaacaaagugagaugccaucucaaaaaaaaaauacaaaaauuagccgggugugguggcagaucccuauaaucccagcuacucaagagacugagguaggagaauugcuugaacaggggaggcagaaguugcagugagcugaaaucgcgccacugcacuccagccugggcgacagagugagacuccgucucaaaaaaaaaaaacaaaaacaaaaacaaaaaaaacaacucuauagucaauuuugcuuccuaacuuugcccauagcaaagaaaauuaaguaugucaaagggcauuuaaauaucccuccucuuucucccaggaacucaaagagaauuagggaagagacacagaaaaagcugaaggaaaauuaaccaggagauguagaugagcccugaacaucuccugguaacuaaagaaaugaaaugaaggacucucucacauaauccuggacaaacuuaauugcaauaaauuaauuuuaucaagguuggaauacacagauuuaugcauaagguuggccaaauaaacccuauucagauaauuugaaagucuaaacaaauuuaccaaccuaguugaauacaauccaguuuuucauacccgcaauuuuguagucaauucagauagugccuuccugccuacucaauucaacagguauuuagugggugauuccuaugcacuaggauuguuucagucccugucuaaccaaacucugguuaucaagaauuagacaaggguggcuuugugaagcacagaaacacaaacuggcucuugaacucccucaccucuaaauuguccagacaccuagaauacaaaacaguagagcacccagaugguguccuaucuugcucugauucucacuugccaauuucaaaccauguuuuuguccccaaacauaccaaaaaacguuugaguacaucauauaucuguacacccauaauaucucaugccaaucugagcacaguacccucaaaggucaacuaaauggcugaguuagcugacagccacauaauuuugauccaagaaugccagcuuaauacugaacugacucacccaaaccaaccagggggacucaagucugacgugggggugauguaauacacuaaggccacaauacaagaauauccuuacuacagcagcaaguaguccuauuuuugacaacauuugaugagugagagaaauucaaagagaggccacaggaugucaagaaaagguaagggugaagcaggaaguaaaccaagagcuggucuuaaagcaaaauccaggagucaaaaauccucuucuauccuaaguaggccugauuuggggggaguccauguuacugaacuacuagaaaauuauauguggaaaaccagacguuauaugucaagaaaauaggggguaaaccaauucuacauuauaaccugguuugguuuuccuuccccccuccaaucuauaaauguugagaaaggaaaugagaaagggaauaauaucuggugauuccauacaaaaagagagcuggacaaauauggauaacauauaaugaauuuuaaaucccaaauagaagacaacuccaaguggacuuaaacucucccucaauuauguucucacaccaucuaauuaucuuccuguuuuagacaacaguuuugaaauguacuuauuugugacuaccucuguuuuccuccaucaaacgccacacuuccugagggcauggcuacuguaucacccauuucucgaaauuuaucuagauucugggccucaguuuccuccuccuuccuccuuccucaguuucugucaagagggaccaagaauagcaccaacuacauuggcuuggcgaggaaauuaaaugagaacgggcaugcagggugcuuaguucagucaauguuuauaaccuguuagcaugguaauaacaauaauuaucguuaccguuauuagccgacagccucccgcaacucuuuuuuuccuccguuucccggacggacuucacagcaaaauccugucgccaagagaagcguggcccgaagccccugcucgcacccugccccgccuaggcggcgaccgagcaccgcaaccgccucagaagccaggccuagcggcgcgaacggcgcuaggggcuggaaggugaacuucagccguuccaaacuccgggaggagggagacccgcgcccuagcugcucccucuuuucuucccacggcucaccuagccucgccucagaucugacaacgaagcgcgagccaacccgccgcgggacucauucaguaucguugaaauuuugaacccaggcagccuagucgaaugcaccaaucagagcgccgggaaagcaauuccaggcucccgauuggcccuacagaccgcagcaauaccggaagucagaaggagguaccagcgaacaacgcggcccggaguuccugggaaguguagucuccugcgccugcgugaguccacu

SEQ ID NO: 191253 - RNA, 30772 nt, Homo sapiens
ugugggucauuguugaaacugugaguucauuuuauuacucacaauuuuuuauuuauauuugaauucuuccauaacaaaaaguuuuaaguguuugaucuaacaaauucacuucugggaauuuaucuuaaacaacuuuuuuuuuuugcuucccguccaacaacuuuauuaaugaacauuuuaaauaaagaaaaacucuuacaaauaaaaauauuuuuucaaauaacaauagugaaaaauugggggcacaugaagucuccuuuuuuuugagauggagucucgcucuguugcccaggcuggaaugcaguggcaccaucucggcucacugcaaccuccaccucccagguucaagccauucuccugccucagccucccaagcagcugggaauacaggcaugugccaccacgccuggcuauuauuauuauuuuuuuguauuuuuaguagagauaauucaccauguuggccaggcuggucuugaacuccucaccucaagugaucugcccaccucggccucgcaaagugcugggauuacaggcaugagccaccacacuuggccuaaauucucauaauaggaaaacaauaaacuauggaacacuccucgacagaauuuuuuauaauuaagagcauuuauccaggcuacauaccaacagggaaaacaugauacacuauuaaguaaaacacuaggacauuaaauuguauauauuacaugauuaaaacuauguaaauauuuguaucuuugaaaaagacugaaaaauaauuacauauguucagaaucuaaucauuucccaccuccuucaaugcaauggccuuugucucuugggagaggagggcacuggaguccuagucuaggggagcccagcaccccagucucucgccugcaacccuguuaacagcccugcacuggucucucugcuuucacccuuucucucuccaaccuccucagcacuggccagcuagagagguccuucagaaugugaaucagcucaugccccucuucugcucagaacccuaggaggcuuccuguaucucuccaacuaaaagcuuccugccauggccguccaggcugcagaaugucagcucgccugcucugaccugcugcucgguucccugccuaugccugccucuccagccaugcuggccuccuggcugcucuucaggaacacacuccagucucggggccuuugcacgugcuguuuucucugccaggaaugugcucccucccuccuucaugacagcucuucagagaggucuuaccugggcucaucuaaaauagauccacucccucuuuuugcucccaaacccuuuauauuucuuuauagcacuuauuaacaugucccacaguacauuuauuacaucuucuacuuucuagaaugcaaauuccuugagaacaaagacuuuacgcuugauucucuccuguauccccaguaccuagcauagagccugacacauaguaggugaugaacaaacaccugcugaaugcaagacuguuguacugagcaaccauccaacgggggcuguaagcggcauguaggcuuuguuucuuggguaaccuccccuccuuaauccuucuggcauaggcagacucacagcagguacccaguagaagguaagguggcugaucauuuuuccauaggaggucuccauggcacacaggguagaaagugcauucugugaauuagaggcagcagagcauggcagcuaauggaaacuggcucugggaggucaaauucuggcuuaacaccaccagcugggcagccuugggaaaauuaugacaauucucagggcauuaauuuuuccuugugcagaaagagaaggauaaugacagcuccuauuucccagggcuggggaauaaauaagagaaugcccccauaaagcaauuagcaagcacagugccuggcauggaggugacgagcaacgagaagcagucaaauuaaucaacagccacauuugugccuuugucucuuucaaguuuacaacgugcucuuauauacaugcuuuagcugaucugggccuuugaacaaccugucgguuuuuaucaccauuuuauagguaagaaaauugggucagaggaaaaagugcuagcucacagaacacaacugaauuuugcuagaacuucuggugcccuuucuuucagaacacaagugauuauuacugcugauaugaaucaaggugauuuggagcugggcaugcagucucagcuaccagagaggcugaggcagaaggaucgcuugagccugggagaucaaggcugcaguaagccaugaucaugccacugcacuccagccugggagacagagcaaggcccugucuuggggggaaaaaaaauuaggcgggccccacuggagccccagacucuaaagugugugccuaguguaaggcuguggauggcaaaugaauuccaaaaugaaaucagccagccagcuacaggcuuacaaccuagugguggcagggaguguacgggcucccucaucugcagcuccuucucuggaugaggcuugagagcaagucuggacaggcaaaccaucucucaguccacccaggacuuaaaacacuucauuguuuucccaaaagggaaaaauagcaaagcccuuucuguacaguuucuccugcuuagaguuggguggcagcucuauacagcaaaugcugacuuugcuguuugagaucuuugauacagugugaccucugagcucugaaccaggcugccccugacaaaaaaaguguuuccucccacagguaaacaaggaagaaggcacugcaaggagcucugggccuggcucaguggaggcucugccaccuuuccaggaucaaaggccaagggaggugacauggcaaggaaaagaucuacaggggucagacaaggaauuuuagaaccacaaggucaaaaaaccaugggcucucaggagucacagauuauuaaaacugcagcauuugagaccaaaacacucaugacuuagagcaccuuaagccucaugguguuggcagagauuacauuggaagggaagagucaaaaggugcuucuccacugauaauucugauggcuucugggcccugggcaucuucugugaggucagagccuuggcaaacguucccucgugagaauacggccugaaggcuccagcugcaggaggacggcugggagaacaggcuuuggauaucaaccgaaugccaacauucuaccaaccaggccccacuggggcaagagaucagaagagaucugauggugccagguuugcaguggccaucaaccaccaaaagacugugagaacaauaccaugauaguguggcuugaugguaugugcuccuugccaggaacaugcugcgugaguggcacuuagucgcccacagagcgcugcacagcaccacaaccgauaacuuccauuugcauaguguuuacagcacaggacagcauucaucccccaagccccagaaauggccuaggaaguaggggacaacaauggcucuggccaggcaguggggauggcucuugagggccacauugggggacaccuugaaaagcagccaaaagacccacaccagccccagccucauccacauucaguuaaggucacuuuagguaccuacauuaauagaauucaaugauuuucaaaaaccacagagaguucuaggauagucaugaccuuguaucaaaauuauagaaaucucucuauaaaaaaaucucucugaagaguucagcaucccaggcugcucagagcagaguggaccagaagacggaggcuggacugcuuugccagugugagaaauucccagaagagcagaaagcacgugcgaugggagaugcuccugcuccuaggaaccugcaaguccuaugcccugggauauggagcgucucccuccuugaggggucccuggcacucuucuccaucuuuggcaggugagaagaggaguuugcaaucccggagcaccucuggcugccaggccuggcuggaaggaccagcucagacucuggucccuccaggaucagagggucuggugcuccggccagaaucagaacucgucccgcagcuuagggggccuguccaugccgaagaaagaagacggccuccccuggaggucccgcucccgcuucacaaaggcagugaaggaggagacacaguugccaauaaaguggucggcuuggccgaggauguacaggucgaccugggccaccucaggcuucaggcucaccaccuucaccugcaggaagaagcacagagcauauaagcugggguggcuacaggccaaggccugccauccacacccccaaccuuauucccugagcugcaguuacagacacaaaaggaggggcagagaagaggaagaugugguucagugucugagggaagcauugcccagcugcugccuaggcccaccccacccuuccgggcuccaggagccucagcuccaaacacaccauucacaccuucaugucuucacuugugcuguucccucugccuggaaugcugcuucaacacccauuaaaauaccgaccagacucuuuuauuuuauuaauuuuuugagaugggcuuuugcuauacugcccaggugggucuuaaccucccaggcucaagcaaucucccaccucagccucccaaguagcugggacuacaagugugcaccaccacacgugguuaauuuaaaacaauuuuuuuagaggaggagucuugcuauguugcucaggcuggucuugaacucugagauucaagugauccuccugccucagccucccaaauagcugggauuacaggugugagccacugugcuuggccugaccagacucuuaaggcuaagcucaaauucuauuuuuccuaaagcccuggccugguggacuuccccaccaaaccagagaggggaacagagagcuccacaccuuccaauucugggcuggaugccuccaucucccauguaccccaaauccaagcccaagguccguccaaucuaccccugagauauuccccaaaggugagcccuucucuugagggagggccacuccuugggcccaaucaucacaaucucuugccugauggacugcaacagccucucccugguccccucacugccucuccuggucugcucaccacagagcagccagaagaaacuuuucgagauaaccucacaccuguccuucccgcccuccaaguggaacacccuuuaaugaugcccuauugcccuucagauaagggugacaaauugugaacguggccuacaagguccucgcugggccucuucuuaucccacccccaucauccagccccuacccaggcucccgcccuccucaggaccuuugugcgugcugugcuguuugggguguaccucccuuuaccugguuagcuccuaguucuccuucgcaucucggcuucaguggugccuccuuggggaagcgcucccuggcccucuagccuaggccagcauccucugcucuucacucucacagaacccugcugcucuacuuuggagcacacaucucugcuuauaguuuccacuccuuagugauucucugauuagcaucaucuccugccccugacuggggcuagagcuguguugguuugcucuccacugcuggccaggcccagcacagagccugccccaguaaaaaucuggugaguggacaggugaaugaauggaccugcccaucucucuagcaagcuccugaauccaccuuguggcccacguuauagcucucugcagucucuuuuccugggucuagaaugugagcccuggagagcgggaccacaucuuauuuacugguacccuuacucagcacuggaccagcuuaauggaggaggaaggcuuaguucaggauaaagguggccucugaacccauggagaagggaguugagggguggggagggaugagaagacuggcauagggacaggaaauagaaaauggcaagagguucaagguguaacagauacacugacuccaaaaacucacaaaaaaacucccugggacucuccaaaugcuucagcuuaguauagagguaguuggggguuguagguagguggggggaaugugggcagaguuggggcugaaagugcuuugcuguuccacagagauuucugauguaacaaaaaucaucaucuugcuaucuggauuguagcaaagaaauaauaccaguuuaaucauggccaaaaucccccaaacaauuccacucacauucugaaacuuacccacucugugucaugcccauuauaauuagcucugggacugcuuggguaaacucuauccuuucuuggaauuuugguuuccucagcuauaaaauagagggguuggguuagacaaccccugagaucucucagcucugauuuucucuuaauuauauuuuucuucugcuuuucuuucuuucuuucuuucuuuuuuuuaaauagagaugggggucucgcuauguuaggccaggcuggucucgaacuucuggccucaagcaauucuccugccuuggccugggauuacaggcaugagccacugugcccagccccagcucugauuuucuguucaguagguggggaggagauuagaaugugcugacuuagcacuuccucucugcacuggagcuuccugugucuggggugaaagagaaggggaggcccuugauauaaagccagcgguacccagugucugccucuuaaggccugcacagcauuuacgguuuucacucauccuacaaaguccuauggaaugcuuaauacuaauucagucauuuuaucaauacguacucacucauugccugaguauuacucuucacugauauaguaagcacugaccaagaacauucuaguauuuacucauguacugaauacucacuauucacggcuucuucaacaguuugcuaagcacaaagauccuuuccuucauucaucagccaccaauuucuacuacugaugauagcuaacuuuauugagcacuuauuuuguagcaggaacuguuucaauuucuuuacaucugaccuucacaacugcccuaugagauagguacuauucagucccauuuuauagaugaggaaacagaagcacagagaggucaaauaacuuuuucaaggcugcagaguggguaaauucaaguucucugacuccagagucucugcuauuaacuccuccacuauacuggaucucuccccagagcccacucucuacauccucauucaacaaacugacugccuacuaagugucaggcacuguacuagacacuggugaugguaaggcaggguuucagucccaaagaggucgaagcaccaggcuagacaucaaggaauguuaacagugagucagccuuggacccugccuucaaggagcccacagcuccugggaggaaauaagacauauuucuacaccagucucauacaguccagaaagugcccgagagaagaaaugauauagggccacgaaggucccagcagggauacgugagcuccaggaguggaugaaaaccuggaaagacuacggaggaggccucugagcugggguuugaaggaggguaggaacugaagaggaaugguagguccaggcaaaaggcuuguaggggagcccgugaagcaugcagugggcagugggaccauccuggcuccuccuuucauucccuuccuacugcacucccacuuggcccacacauaccuucccuuugaagagcuguuggagcucaggcacauaacucucggaaucaguagcaacguagaccgacugggcauccagcgaccucacccagagcuucacagcccucuggaucuccuucaggucaggcaggcacauagucaucgugaggggggccgcugugcugcggcuguagcccacacacugcggagaggccaugaagugcgagccugcagucccguccuucagcauggcacaggcguucuucuacggagagcggggaacaggguuaaauacuggcaacugcccuggaaccccagaagcaagaccugguaaguggaaaaagacaggcuauacaggaagaaccuaacuacauuuuuuuuuuuuuuuugagacggagucucacucugucacccaggcuggagugcaguggugugaucuccacucacugcaaccuccgccucugggguucaagcaauucuccugccucagccucccgaguagcuggaacuacaggcacccgccaccaugcccggcuacuuuuuguauuuuuaguagagauggaguuuugccauguuggccaggcuggucuugaacuccugaccucaggugacccacccaccuuggccucccaaagugcugagauuacaggcaugagcagccgugccuggccuaacuacauuuuuuuuuuuuuuuuuugagagggagucuugcucugucgcccaggcuggagugcaguggugugaucucugcucgcugcaagcuccaccuccuggguucacgccauucuccugccucagccucccaaguagcugggacuacaggugcccaccaccacgcccagcuaauuuuuuguauuuuuaguagagacgggguuucaccacguuagccaggauggucuugaucuccugaccucgugauccgccugccucggccucccugagugcugggauuacaggcaugagccaccacgcccagccuaacuacauuuuuaaagaaaacacugaggaccaggcgcagugccucgcaccuguaaucccagcaucuugggaggccgaggcaggcugauagcuugagcucaggaauuggagaccagucugggcaacguggcaaaaccccaucucuacaaaaaauacaaaaauuagccagguguggugaugugcgccuguggucucagcuacccaggaggcugaggugggaggaccaccaccugagcccagaagguggaggaugcggugaacugugauuuugcuugccacugcacuccagccucggcaauggagugagacucugucucaaaaaaaaaagcauugaaggaggaggaguuaacagugguucuuucugggcggugggcacagcacagaaagccuggcauuuugaaacaaaaauuacuuuucuuggucuuacugcauuaucugggacauucacugaauucugaacaguggcaguacuaacgggcagccuuauaugauucccaacuacagugggaacacuuccaauagcuccccaggagguaugcuaucugcugugguuucgagagauagccuuuaucaaguuaagguggguccauucuauuccugguuaguuaugaguuuuuaucaugaacagguggugacuuuuaucaaaugcuuucuuggccucuauugagaugaucauaugauuuuucuucuuuggguguuaauauaguaaauuugauuacauucuugcgauagauuuuuacguguuuuguguugugugcuaauauguuauuggcuuugaccuguuaauauuucacuuagggccuaugcauuuguguucauaagcaagaacaggcuauaauuuucugagcugaccuuaucugaguuugguauuaguguuaugcuagcuuuauaaaaaauagaaucuuauaucucuugauguuguaggaaaguauagaugggaauuacuauuccuugaaugucugguuggagccacucauaagacauccuggcucuggcucccuuucuuugugggggcugggggaaagaggagaguuuaguggguaaauguaagauuaccucaucaauuggcuaugagugaauuuuaauuuuaguauuuuucaaguuuucugcaaugagcauuucuaacauaucuauauaucuucuuagguaaaucaaggugaccaucuauauugauucuguuauuuucacacagaggugaaaaccucauuggaauacaaggauucugcacauuuaaacagccuccaaauucuguuaggaugacaucuucauuucuugggagccaugccucaucuccacagucaguuuuucaacacggagucuaccagccagacacugagcuaggacaggggacuccuggacuguggccucuuuauggcuugcugccugaccuggggucuggcuugaucucucaguuuauccaucuguaaaaugaggauaaaaacagcugcugcuaaagugagaccuggcuggcaggcacucuggaguuacauuuugauaugugcugcagugggaugaugggacacaaucccacgaaccagaacaagugagagaucucugcucuggcugggacgcggggccgaucccuacaggccagggccaugcucagggacacauccaaguuagccagugagagaggaagggggaaguuacccagucagagccaaugcgcagaugaaugcccacauagggccggacaaggugggcaugaaucugggccucucccgucuucaccauuucgucugaccauaccauguacuucuguaguggccuguguuccucuaggacggggaacugggcuggggcuccuggcagggcaagcaccggauguuccuuuggagaaaaucuagacaggagauggaaugagggaagucagaggacgcacagagagccuggcugccacccccacgggaaaaaggaugguguugcaccaugccccagagacccugcggaggggccccugcaacacgcaagaaacacgagagguugugaaauaccaacgggcugauaaggaaccuugguggcggcggcaacaggcacaauaugcaauacugucccgccacauggaauuuacaacccucuuugcuugucgaacaauuaaaacuuuacaggagagcauuccaaccuuuuauaugucacacuggcuuccaaucugcggugcaguaauucauuccaggguggggugucuggaccaagccuuugcccuuuuaccuacauggcaggacugggacaugcagcugcuuacagaagcaacggccaggucacacucacagggacuauguauacuggauuugaaucauucauucaacauuuaaaaaacauuuauugauugccuacuauguauugggaccuggaggaaaacaagacaggcauagucccugcgcuauggaagggagcaggggucugcaggugccccuaucaugcccucccaagccccugcuucccccucauacacaguccaucucauaauuauuucaccucuguccuugcugugggaaggcagugcuccaguaugcgcagaauagugucuggcacacccaagagcuugguaaauauuuuucuuuucuuuuucuuuuuugagauaggaucuugcugucacccaggugucacccaggcuggagggcaguggcgugaucucggcucacugcaaucuccgccuccaggcucaaggcaagaccuucccaucucagccuccugaguagcugggacuacagauaagugccaccaggcccagcuaauuuuuuacauuuuuuuuguagagacgggguuucgccauguugcccaggcuggucucgaacuccuggacucaagugaucugccuacuuaggccucccaguguugggauuacaggugugggccaccgcgcccggucaauacuucuugacugaacaaaugaggagcaaaccuguguucccucuucagcuaaacccagacuaccucucagcagcacgaaaccccuugcuguuccauguucacaaugcacuuucaaguucuagaucucuguauacuucuucccuccagcuggaggggggaagugccuucugccagccaaaauccuuuccuuaaaaguaugaaaugggaacagccauucuggaaaacaguuuggcaguuaggcaugcaguuacaugacccagcaauuguacucuuaggcauuuauucaagaaaaaugaaaacuuauguucacacaagccuauacaccaaugucccuugcagcuuuauucauaaaauagcccccaacuggaaacaacccagacgucacucacaaguaaacaguuaaacaaacugcuguaccucuguaucauggaauaugaaccccaccaaaaaaaggaacacaguaucaauacaggcaacaauuuggaugaugucaagggaauuauccuugggucagggagggugggcaaucucaaagguuauguauuguaugguuccauuuauauaaacauuuuaaaacaauagcauggagaagagauuaguaguuggcagagguuaggaaugggguguauauguuuagggaggugggugugguuauaaacuggcaacacaaggauccuugugauaauggaacuguucaguguauuaacuauaguaguggauacauaaacccacacacgauaaaacugcacagaaauacacacacacacacacacacacacacaggcaugcacucacacacucagaaguaaguacaagaaaacugaguaagauggguaaauuguaucaaugucaauauccugguugugauacuguacuauaguuuugcaaaauguuaccauugggggaaauuggguaaaggguacaugggagguugcugucuuauuucuuacaacugcauguaaauguacaaugaccucaaugaaaauuucaaauaaaaacuaugaaauauuucaaaccauccaggcaaauacagaaaauaauuuaauaauuuauauacccaugacccaaaucagcagaaacuaacuuugcuuuguuucagguuuaaaaacaaaacaaaacaaacaaaacaaaaaacacacaccuaaauacaagcucauccugccaucauccuucccagaggguaauguguuuuaauguaugauugcacuuuuacuauagacaucaaaaaggaggggaguguucuucugcgugcuuucuauggaguggaaugaugaagauuguagguuaagccagaaugcuuuguuccaauguugacuaugccacuagcuaacuugggcaggugacuuuaccacucugugccuuagcuccucauccacauaauagagauaacaguucccacaucauaaagcuguuuuuuuguuguuguuuuuguuuuuuuucaauugugguugggugugguggccacuucuguaaucccagcacuuugggaggcugaggugggcagaucacuugagcccaggaguucaagaccagccuggggcaacauggcaacaccccaucuauccaaaaauaucaaaaaauuagccaaguguuguggugugugccuguggucucagcuaccuaggaggcuacaugggaaaaucgcuugagccuggaagguugaggcugcagucagccaugaucgugccacugcacuccagccagggugggagggugagaccuugucucaaaaaaaauuuaaaaaaguugaccgggcgcgguggcucacgccuguaauccuagaacuuugggaagccaagguagguggaucacgaggucgggagaucgagaccauccuggcuaacacggcgaaaccccgucucuacuaaaaauacaaaaaauuagccacacgucguggugggcaccuguaaucccagcuacuugggaggcugaggcaggagaauggcgaaccugugagacagagcuugcagugagcugagaucgugccacugcacuccagccugggcaacagagcaagacuccgucucaaaaaauaauaauaaaaauaaaaaauaaaaaaagguuguauauauuuacgauauacaauaugauauuuugaucuacauguauguaguuaaaugaauaguacagccaagcuaauuaauauauccauuuauagggcuacugagaggauuaauguauuaucaaagcaaagcauuuagaacaguaccuuggcacacagaaagcucucaaagaauucuagcucuuaucaucaucacauugcauguaaccuaguuaaagguuacauauaaaucuaaucaacuuucuaaaaauucaacuuuauguuucagagacuuggccauguugaucauguggaucaugugguuguauuagcuucucuaaaaguuuuccauuuuguacaaauaaacugcaauuuaccuaccuauuucccucuugcuagacagugaggucguuccaaucuuucccucacacaacagugcugugacagacaugccacucauucuccacacccaacagagacugcuugcucagcaaacaccuuccacaccuccaaggucagucgcaauucccaagccucaccuccuuagggaguguucccugucccacuucucuugcugccuucugcacaaugauaugcccugcagccacuuucccugcccauggaacugucagcuggugaggcuggggacccaagcagccuguuugccauugcucccacauacgcuauccaaggccugugucacuuacacaggccucggaccagugacaagaaaguguuccuugaugguccagcugugcgacacuuaucuugcuagacucuaguuuucuuuccuuuuuuuuuugagauggagucuugcucugucacccaggcuggagugcagcggcgugaucuugguucacugcaaccuccgccucccagguucaagugauucucuuaccucagccuccugcguagcugggauuacaggcacgugccaccaugcccggcuaauuuuuguauuuuuaguagagacggguuuucgccauguugcccaggcuggucucaaacuccugaccucagaagauccgcccgccucagccucccaaaguguugggauuacaggcgugagccaccgcgccuggccuagacuccaguuuuguuuauauguacauaauugugcauuguuuauugggccucauuaugugauaggcaaugcuccaauuguuuguguauauuaagucauuugauuuucacaagagcucuguaagggaaguauuacugucauucucauuuuacaggugaggaaacugaggcacagagguuaaguaacgugcccaagguugcacagcuaggaauugguggagccaggauuuaaauccaggcagugugcuccagauccuauguucuuaacuacuaccccuuacucccaucucccccacccuugacaaugagcugagucuguggcuuaaucuucugauucccagccccagcauggaccuuaucacaugguaggcaugauaaauauuuuuagaauaaaugagaaagauuuggggaccucaccagaaagacccgaucaggcugucagggguuagagaaggaaggaauucauauuaccugaguagcuacuauaggccaggucuucagcuaaucuuucagaugcuaccucaaaaggauuuucaaaggaaagccagaguagaucucccaguggggcuggaauaucaggauaaaaccaggaucugcggcccccugccaccccccgaccucuuggaaagcaccugcagccaaccuucggugaauuccagacuuggaauguguguccccucuaccuggaucuggaccagcaaagagcugucccagugggacaacaucagcucagacccaacaagcagcaagaggcuaaggcugaucugcucacuuacuuuuggugagguaagacagcgcugucuggaaagaaugaggggggaacagggaucuuggcuggaaagaaaaucuugaccagcaccaccucccggugacugcucacccuuggucaggcccuuugccucuugcuauccagcugaagucagcuggcuuuccugcugcugggcccagugaaccucugggauucuucaccaccaugccugugcugcugagauucuccaacaaacuaggacuucucuguauacagcauccauuuauguguccaguauguaucugugggaccaccaguggaugaaacccauauugagugcagaagacccagggacaugaacaaggcagggcuuuguucuggaugucccugccaugaaggacugccuuucccuccagcucucugcauggcuggcucccucucacucuuccagucucauucugguucccacagggagguggcagccugggagaaugacaagccaugcgcucaaauuccuggaccauuauaccugagaaugguuuggcacgauggugcauugccuuccaauagucaaugugcaguaagcgucagcugaauuagagcugugccaggcuauucacaggcucagaacgagcagagcuggaaggauccucagaaaucacgugguaaagaagaaauaccucuuauccucuuucccucgaacccaguuuucagcuggauacguggcagccuaaaauaaagacacuucuuaucagccaaacauaccccgggcgaggugggggaaagaaaaagaaagacagacauuucuaaguacuucuugcagcuagguauggcccaugugcccucguacuagccaaugagauguaagcaaaaggguuauaauggacuuccgggaaggcuucuuaaaaagggaggacaugcccuuucgcaacuuuuguuccuccaguugggaugugauggcuggagcuucaucugccaucuuggcccaugaggugauagaaaagcuaauacuggauggcugaacaaagagauggaagccugauucuuuuucucuuuuuuugaggcgaagucucacucugucacccaagcuagagugcaguggcaggaucuccgcucacugcaaccuccgccucccagguucaagugauucuccugccuuggccuccugaguagcuuggauuacaggugugugccaccaugcacggcuaaauuuuuuuugguauuuuugguagagacaggguuucaccauguuggccagguuggucuugaacuccugaccucaagugauccgccugccucugccucccaaagugcugggauuacaggugugagccacucuacccagcuggauucuugaugacacuauggagcuggcauucagcucuggacugcauacccagaucuucuuuuacuuaagaaaacaauaaacccuaucaaucugcucuuauuucgggcuuccugcuaccuguagccuaacuuaagucugacacaccuagacuuguagccuacaaacuucuucugccuuacugagaacccugauauauuuaaggguuauugguugaaggcaauagggaggaagaauugagccccuggaacuugguccccuacugcuaccccccauaaaggcccuagaggcauuuuuuuuuuuuaagauggucucaaucuguugcccaggcuguagugcaguggacagaucauggguucacugcagccaugacuuccucaggcucaccugauccucccaccucagccucccaaguaacuggaacuacagguaugcgccaccaugccuggcuaauuuuuucuauuuuuuguagagauggggucucccuacguugcccaggcuggucuugaacuccugggcucaagcgaucaccugccucaaccucucuguaaucccuuaggauuacaggugugagccacuaugccugacaagcacuucuugaaaacucugaagauaguuucaaaaccacucaucgugcccauccccuucauuuuauagaugggacauugaggccagagaaggggagcagcugccuaaucgcacaguaaggcugggaagagcuucacucucugauuccauucuucucuucuccccaaggacaaauaugcauagcaaggaaguauccuguaucuuaagaaauguuuaauguuaaauguucauacacauucaaauucaucccuacuaaucauucacaggcuucuuaacagauugccucacagggccuauaaacccgcguguuuugaccccugcccaccucucugaucucuuuucccguguggcagauuagaaguggucaagucuuugaaccccuucccauuaggugggcucugccuccucccaauagcacccgacagaagugacacugugccgguuuccagauucaguuguuagggagcccgcaguuucuauuuccugucucuugggacacucacucccuggaugcucccucucagaacacaggugccaugcuguaagaagcccaagccacauggagaggucaaguguauacaugcuucuugguggccccagcuuggcucccagaugacagcagcaucacccaccagacaugagggggacuuccuggauauguagcucagucaagccuuuuuuuuuuuuuugagacaguuucacucugcugcccaggcugggaugcaguggcacaaucucggcucacugcaaccucagccuccuagguucaagugauucuuaugccucagccuccugaguagcugggauuacaggugugugccaccacgcccagcuaauuuuuuauauuuuuaguagagaugggguuuuggcauguuggccaggcuggucuugaauuccugggcucaagugauccacccgccucagccucccaaagugcugggauuacagguguaagccauugcacgcagccuuggucaagccuuuagauaacuugagcccuggaugggcaugguggcucaugauguaaucccagcacuuugggaggccaaggcaggauaauuacuugaggccaagagaucaagaccaaccugagcaacagagcaugauccccacccaucucuaccaaaaaaggauaacuugagcccuagcugacagcugacugcagccacaugagaccacaagcaauaacugcccagcuaacucaaguguccaucaauagaugaagagauacacaaaugugguauauacauacgaugaacuauuauucagccuuaaaaggacuaaaauuuugauacaggcuacaacacugaugaaucuugccacaugaaauaugccacaugaaauaagccagacacaaaaagauaaauauugcaugauuccacuucuaugagauaccuaaguaccuaugagauagcuagagaaauucaaagacagaaaguagaaaagcauuuacugaggcuauucauugcaagaauaaagguuauucguuccaagaaauaagauguuuaaccugaauuuaaacuuuguacagcagggauuccauaagaaaacggaaaaaugaaaacccaaaagaauugcccagcuaagcccaguuaacccacagucccaugagaaauaauaauaacuuguuguuggccgggcgcgguggcucacgccuguaaucccagcacuuugggaggccgaggcggguggaucacaagggcaagagaucgagaccauccuggcuaacacggugaaaccccgucucuacuaaaaauacaaaaaaaucagccgggcgugguggcgggcgccuguagucccagcuacuugggaggcugaggcaggagaauggcaugaacccgggagguggagcuggcagugagccgagacuccagccuuggugacagagugagauuccgucucaaaaaaaaaaaaaaaaaaacuuguuguuaugcuacuacguuuuguagugauuuauuaugcagcaacagauaagagcaacauccuaccauucucucacucacuccauaccacauugccuucuuucugcuccuucaccauaccaagcuuauuccugccucagggucuuugcuccugacuuccugcugugaacuacuuuuccucuaacucugacacaacuggcuccuucucauccuucuggucuuagcccugccaaucacauaccaccuguuuauauccuucuaagcaccaucucacucuggaacuauccuauguaaaaguuuauucacuaucuccccuguuagacuaugaguuccauuggggcagggaccuuaucugccuuauucuggccuuguucauucccugccuuguucauguccuuauucuggccuauauccccagcauccaaaccagcccuugacacucaggaagugcuucuuaaauauguguugaaggaagacaggcagcugccaagggaccaucaacucccucaaacucccucuagggaccucaucuucccuacuaauuuuccuuucccaaaaacuuggcuguaaggcacaaacuucuucaaacccucauguaauucuuacaacucaaugaacucaaacaaagcuauggggcaauaaacaaguguuucaacaacacuccccaugcaccauuguccuuucucuuccuacuaggauugugugcuuuuucuagcuuuuuggaauuugcuuuuggaguugcuuuuagaguugguggcuuuuuuuucuuucuuuuuuuccuggcauauugucaauaugggcaaaucuccauccuuugagggcaggucugccuucuggcaauagcuccaggucauucggaggugaaugggggagaaccaugcaggcagagaaugggagugugcuaucugggaucaacaaugaggaagauuuaaaucugccaugacugaggauccucaguggcacaugaacuagguccaaagcuagguccaaaggcaagucccagaagggaacuggcagcuguuaaaggcacagcuauuuaauccacugugauuaagaacaggugcuuugggacugggcgcagcagcucaugcuuguaaucccagcacuuugggaggcugaggugggaggaucacuugaggccaggaguuuaagaccagccugggcaacauagcaagacccuguuuguacaaaacaaaacaaaauauucgucaggcaugguggcacaugccugcacucccagcugcuugggaggcggagcggggaggauugcuugagcccagggauuugagguuauagugaguuaugaucaugcuacuguacuccagccugggagacaagcaagacccauuucaaauauaaauauauaaaguaacuggugcuuuggauucagacuucuggguucaaaaccaagcucugcaacuucaagcuuuaugaccuugggcaagggaccuuauuccuuucugcuucaauuucucuaaguguaaagcacagauggcaguaacaacccacagacucagggaaagauuaagugagucaauaccugugaagacuuagaacagugucuggcacauagaagacacuaaaugaaucuuagcuguuguuauuuauuaaagauuuacaaacagaccugagcuguccacucaacagcucaaugaccuugggaaguuauuuaacuucacugggcucaguuuccucaccuauaaaauggaaauugauaauaauacccacuucaugaacuaucucaaagucuuaaauaaaauaaagcaugugaguaauaacacugacagccaacacuggcuggcugcuuaguguaugacaugcacuucaugcacuacgaggcagauaccaucagcgcuggcuaucucacuccuuggccugugcuuguuuuguuuugcugagacaggcccuugcucuguaaccugggcuggagugcagggguaccaucauggcucacugcagccuugaucucuuaggcucaagugauccacccaccuuggccucccaaagugcugggauuacaggcaugagacucauuucucuacaucuguuuaccuuugcccuauuaaaugccaagugcuuugaccgcacaugaauuaguauguucccugcaccuccuaaccaaugucugccuucuaagcccauggucuuuccugccaugcuauaacauuaaggacaaguacacuaugcugauuauugucauuaugagaccauagcuccuagaaaaccagagcuggucauccucauuuucacacaucaccauuggccucugauuacuaugucucacacgugacaggcgcccuauaaauguuucacggccugugcccacguccugcuaaccuauauuuuuuaaaaacaggggcuaauggggugcaauuaauaaacacguccaauaauuaucaggaugacgucauuucucggucugcaccugaagcuguucucuagaagcugcuuccaguuucaccuugggaagaguaagguaacacaggagugauucucacgccuagaggaggaaauugagacucaugcgacugcagaauguucuuuuuaugacaucccuuaucaaccgaugaacucuuucucaaucucauggcgggucaauguuccaccgugucaggcguggacaugggaacagaucacacaggauuccaaguucaacagacagagcaccugcaccuuuggucucauacaucagaguugggaagauggggagagugccagaaggugcugaaugcucaugagcuccaugcgccuccccuaaacccagaaacgcuacccccuccaaguaccucuggcuccauuguucucuguaggaagcacugaaggaaaugccuguaaaaagcuccgacuuguugaaacucacaugaaacugaucccagaaugggccaaagggguuuccuuccugcagaaagagagugguggaaggcuuacugauggggagggaaagccauuuggggauggggccagggaaguguaggugggggaagcugggugaugugacucaggccaaaacacucucacaggauggccuaggagaaaugucacucugcaauuccuaggccaggggcugagcagagugccguggcuucaauucuggauuccagcaggagagucuuuccuguucacaugucacauccugcugacccagcagcacugaugagggucuggggagaagcagaccuuggauuuugaaccaaggacuagagcuucaagagacauucaagauuggcuaauccaaugccuucauuuucaagguggaaaccaaggcccacugagggucagacacuuacccaagguuacacagccaguaagggcacuguuggggcugugagcuaggucuccuuucucaaauuucauaguucuuccaaccacuuucccaagacuuuagcacauacaccgaaagacauacuuggggguuuauuuccaaagugccagaaauguauaaauuucuuuuaauaagauaugacagccucucauuuaccugcugagaugcaggaagguauucaaguuaaguggguagacaauggugccaaauuaccuaagguugaaucccagcucuaccacuuguuugcugugugauccuggguaagacacugacccucucugugccauccucgguguccucucuaugaaguggggauauuauaaguauuuuccucauggaacagugugaguauuaaaugaguugauacauguaaagcucuuagcgugguaccugacauacauaguaagugcuacaugaauauuaguuauuauuacugauguggcacuuugcaguuuacaagcacuuuuucaccuggcccucaugacacuuuaggagugagacagagcagggacuggcaucucuauuuuguagguagaaaugaagguucagagaagcaaagucuucugcccaaggugaugcagcuucgcuaacaaaugccagaaacaggacuuaaaucuccaucuuucuauucuaaguccuucuggugcuuuuccccacauuuugccaugacauagucuugggggccuagaggacauggaacaggaagaaagggcccccgaacccacaggacccaccuucauggggcacgucuucuuaucugggcuucgcugggcugccaccucaaagcaguaugccacccgcuucucagggggccagugggugggugccagcuucuccaugaaauccuccaagcugaugacccgaugguaagccuggaggggcuccagcuugaaguacuucugguaggacacauggagcuacaggaaaaggaggagcagaggucccgucucagugcccccguggcuacuuuagacauuuauuaaaacaauacacuccaggccaggugcaguggcucacgccuguaaucccagcacuuugggaggauaaggcgggcggaucacuugaggucaggaguucgagaccagccuggccaacauggugaaacccugucuuuacuaaaauacaagaaaauuagcugggggugguagcgagcaccuguagucccagcuacuggggagacugagguaggagaacugcuugaacccaggagguggagguugcuugcagugagccaagauugugccacuggacuccagcuuggacgacagagcaagacuccgucucaaaaaaacaaaaacacuccaagaccaagacaguucagacuacaugacaauuaaaaguuuucaucaaaagacgccaaagcuaggauagacaggcuagcaggagagucugcaaacuaaagaacaaacaguaacaucccuuguguuaaaaaacaccugcugaucuguaacaaaaaaagacaaauaaugccaagauaaaacacaggcaaagguuagggguaaacaauucacagcaaaggaaacccaaauagccaacacacucagaagaugucuaaccucauuaguaauuaggaaaaagcaaauuacaauuauaacgaggcaucaauuacuucucacucaugagacuagcaaaaacugaaaagcuuaacuuguggggaaaugcgcacucuucuacacggccgguagcagaagucuacauuuuggagcaaccaguuugggauccaaucggugaguaucuaauagaauuuaaaaugcuccuucuggccaggugugguagcucaugucuguaaucucagcacuuugggaggccgagguagaaggaucacuugaggccaggaguucaagaccagccuagacaacauagcgagacccugucucuacaaaaaauaaaaaaauuagcugggcgugguggugcacaucuguagucccagcuacuagggaggcugagauggaaggauuucuugcauucaggagggugaggcuucagugaugugugacugugccacuguacucuagccugggccacagagugagacucugucucaaaaaaaaaauuuuuuuuuuuuaauguaccuuccucuucuaacuauuugcucuagagaaguacagaaguucuugcacuuuggaccuggagaucaguaccaggaugcucagugccacaaugaaaguauaggaaggaacaucaaaggagucacaccaaauacacuauauccacaacaguuguuaagggaacaggguuagccccaggggccaaaaagagacuucaucuuuuaccaacuuuaucuguaacgcuuuauuucuuuuauuaacaaaaagagaagaugaaacaaacaugagaaaguguuaacaauuaucacuucuaaugguggguauaugguuggugguuguauucaucuguguaauuuucuuuuuuuuugagauggagucucacccugucacccaggcuggagugcaauggcgugaucucagcucacugcaaccucccccucccagguucaagcgauucuccugccucagccucccgaguagcugggauugcaggcacgcaccaccacgccggcuaauuuuuuguaucuauaguagagaugggguuucaccauuuuggccaggcuggucucaaacuccugaccucgugaucuguccaccucggucucccaaagugcugggauuacaggcgugagccacugcgcccagccucaucuuuauauuuuucuacuuuuuuuuuuuuuuugagauggagucuugcucugucucccagguuggagugcaguggcgcgaucucggcucacugcaaacuucgccucccggguucaagcgauucuucugccucagccuccugaauagcugggauuacaggcgggcgccacgacgcccagcuaacuuuuuuagcagagaugggguuucaccauguuggccaggcuggucuugaacuucugaccucaagugauuugcccgccucccacugcgccuggcauauuuuucuagauuuuaaaaaauuucuggcugggugcggucacuuucaccuauaaucccaguacuuugggaggcugaggcggauggaucaccugaggucaggaguuggagaccacucuggacaacauggugaaaccccaucucuacuaaaaauacaaaaauuagcuaggcaugguggugggcaccuguaaucccagcuacuugggagaucugaggcaguagaaucgcuuuaacccaggagguggagguuguggugagccaagaucgugccacugcacuccagcccgggugacaagagcaaaacuccgucuuggaaaaaaaaaaaaaauucuggcugggcgcaguggcuuuugccuguaauccuaaaacuuugcaaggccaaggcagguagaauacuugaggcagggaguucgagaccaaccuggccaacauggcgaaaccucgucuuuacuaaaaauacaaaaaauuagcugggugugguggcacaugccuguagucccagcuacucaagaguagaggcacaaaaaucacuugaacccgggaggcagagggugcagugagccaagauucugccacugcacuucagccuaggugacagagcgagacucuucaucaaaaaugaaaaacaaacaaaaccaaaaaaauuucuacagggugugguggcucaugucuguaauccuagcacuuuuggaggcugaggcaggaggacugcuuagacucaggaguuugagaccagccugggaaacauagcgagaccuugucccuacuaaaaaucaaagaauuagccgggugugauggugggugccuguaaucccagcuacuuggaggcugagguggaaggacugcuugaggagauggaggcugcagugagcgaugaucaugccacugcacuucacccugggcaacagugagaccucgucucaaaaaaaaaaagaaaaaagaaacacaggccuguaauuauggaggagucugagucugggccacagauaaauuugggagguacacggagaagaguaaaagccacaggagucaacagauauuuauagcaaagcaaguaaugguaauaauagcaacuaauauuuauugcauguugacacagugcuagguacugcacucaucacuuuacauagauuugcacauuuaauccugagguaggaauauaaccaucuccagguuacuuaugaagaaacccaagcauacagaaucuagauaacaucugaggucacauagcuaguaagcaaacagaaagaggagaaacacuaacaucuaaacaguggguggagagaaaggagccccugauacaguggaaagaggaaaaugcugagagguuagauuguagcagggacagguggugucuuggaacagggaaguucaggaaggagaagcuugcagggucaagugccagugggaggucaggugagagaaagacugggaaauaaccccugccaauuuggaggucacuggugaccucagugagaaugcuaacaguggcgaagaagagccuuguuggagcagguuaguaagccacagaaagcaaggaaguggggacuuggaaagacaacuggcugagaaggcaaggagacagaggcaagcaagccagagggagauggaugggcaaugucuacacuguaauagugagugcgaggccaggcgcaguggcuuaugccuauaaucccagcacuuugggaggccaaggcaggcacaucaugaggucaagagauugacaccauccuggccaacauggugaaacccugucucuacuaaaaauacaaaaauuagcugggcgugguggugcgccuguagucccaguuaaucaggaggcugaggcaggagaaucgcuugaacccgggaggcagaaguugcagugagcugagaucgugccacugcacuccagccuggcaagagagcaagacuccaucucaaaaaaaaaaaaauagugagugcgaaauuaucagaacaucaaugguuuccauuaacugaggacucuaggaucuguacguugauaagcucaguugauucuaagagggaggcggcauaugacaacacugaaggcguguuacugccacugacacauucaguccuuaccacaagaggguaacaagaaucauuaccagcuuauuuuuaaaaugaggacacugaggcacaaagagguaaaguacccuguccaggccaugcaacuaguaagaacccaagucagacuaugaucucugguacucuggcuuuugacugcugcucaaaaccucuguaaauacuggcaugcaaaggaaaaaguaaaaucuaugcagagaaaagguuguaagaaugaaauuaaguguuuuguucacacuaaguauuauuucugaugucuauuggaaaauuauuaagucaauucaucaaauacuaauuaaguuccuacugccaggcuccgggagauacaauaugaacaacgacacaaggucacuggaagacacaaagaauaagcaaggaacugggggccggugagcaucgcaugacaagggagccccuugauggggugagaggcagcacugaagccagacuaccuggguuguggccuuggacaugucauuaaauaaccugugccugcaugucuccuuuaaaauugauaauagcaucugccacccuuggccaauggaaugcacagaggguaggaccaaucagggaaggaaauggaggcuuuagguucaagucacaggcucuggagucagacaaagauagcuuugaauuccagcucuccuacucacaggcugugugaucuugggcaaguuaccuaaccucuguaaaccccgguuuccucacaggcaagugaugagggugaaaugagcuaauucucaugcagccgcacacaacaggugcuggauaaauaaauguuaggcauuguuauugcagugaagacaguucuggcuggagguagggaaaucucagaggagugggagguaaagcccagaggacuugaggguuaaguguaaguaagcaagacugagaaagggcggagaaaggccaaggucagugggaaguacucacguuggugaaaggaggcuugugaugcugguacucaauccaaggagggacagccaagguacgguuuagcagcuuugcaaaugccagagagcccaagaagugaucggccugguucccaaagcgcccuggaaaugguacauugcgggugaggugaggccuggggcauggagggcauagagcaugcagggcucagaaagguuguggagccagggguagaaagucagggauaccaaggagaacuaggggagcuggcagcauaagaacaagucuggacucuugggucugauauccaaggcucuucagguccugcaacaacugcuuccgccacuccagguuucuugcuguuuccccaacaugcucuacaauucccauccccacccaaugccucugaucuugcugucccucagccagaagagcuucuaccucuaucuccauucaccugcacauggacgggcaacucgaaugccucauucacugggcuccuuucaccaauccccugccauacucacucucccuccuuuaccucccaccuuggcucugagcuacuucaguucuucaauuuuccucaaguaucuuugcucacuuccuggccuucguacuggcugauuccucagccugugaaugccucagaagcaaggacccugugugauuccuuuucuuaaucccagcauggcaccuguucauucauuucacaaauaugauugagaggccacaaugugccagacucugugcuaggugcugggauacaggaaugaacaagaaggacaaggccucugccccuaaggcacucacaguucacugcagagacacuaaacauguaaacaaauacaugaaaaauguugauaauugccagaaagagaugaaaaaaguuuggugauaggguaaugaggagauuacuuggguagaggucagugaaauccuuucuggugacauuuaggcugagaucuaaaggaugggaaacagcuggucaggcagaaauggaggagaggauuccaggcauagggaccgccaccugcagcagugcagacuggaagaccugagcaugugugaggaacgcaaaggaguuaaguguggcugcagcuggaggaucagcagagaagggaguuguggagauggccaguggaggccacaucauucagggcccugaaagucauggucaggagucuggaagccacugggggccuuaagaucauccacuuccacaaugaugauccaccauacccauuucaacugugcaccuggcauggucuuuagauucuccccuacccugcucucuuuauuuucccuuaguauucaucauccucuaugaaacuauguauuuauuguuuuauguuuaccccuuuuuggguuugcuuguuucgagacagggucucacucugucacccaggcuggcagugcgguggcacgaucagagcucacugcagccucgaauuccucggcucaagagauccucccaccucagccucccaaguagccgcccagauaacucccaagggacuacaagcacacgauaccacgcucugcuuuuuuuuuuuuuuuuuuuuuuugagauuggauuuucacuauguugccuaggcugaucucgagcuccuggcuucaagugauccugccucggucucucaaaguggugggauuacagaagugagccaccgcgccuggccuacuuauucucaauuguuugucuuccccaacuaaaaugaaggcucuacaaggacacggaguuuaucuuauucacugcgguauucccaguacagagaacagggcccggcacagaauaggugccccauaaauauuugcugaaucaaugaaaaaucaccaggagccagcgugggucagugacaucaaguccugccccacuaacuccauuuacuggacccuggacuggcuuagaccucaagcaagucacguaaccucucccagccucaguuuucucaucugucaaauggaaaguuggacacguuggccccucugugcccuugcaacuaaggcagagaggagaagagcaugccccgucccgcucugagguucucuccuggaccugugaaggugucucugggcgcaucugaggaguggcuuuuccucucccggccucaguuucuccaucugagcagagggcuugggaggccuuacccaugcaggggcaguagagcagguaaccggccgggucccaggagcccgcaggcauccccgggagcggcagaagcagcagcaggaaagacacgcucagcggccgugcccacgcggcggcgcccaugucggcccgggaacccgagccagccgcggcgcacagucggggagggaag

SEQ ID NO: 191254 - RNA, 159910 nt, Homo sapiens
cggugguggugucugguuagcucggcggcugcagaucucgcggcgacgccugcgagggacccgggccgcgggucgaggcgggcggcgccugcgagggacccgugucgcggguagaggcgggcggcgcgcggcggcggcgcucggcgaugguaggcgucccuggagcggccgccuuccagcguaaguggggcgugaaugcgggcggccgaggggggcgugugagggccugcggcuccgcaggcgcggugauuccgagugccccgggcgcgaggccgggaguggaaacugaggcccgaagcggggcggcggauccaaggucacgcagcggggcgggccuucccgggcuccugaggccaccccgucgcuuccugcgccgcccgaagagcucggggcucacggugugagggaaauuguggggcccgcggccucggaacuuaggccgggccggcguccaugggacuugccggcgggcaagaaucauuuuguugucccagcgcuggggccacgaaguccggcuccuggggaaauacuacacccgcccgauguugaggguuggaggagaugagaauggccccucggagggccuguuugagcgcaggcucaguaguuggcuaccuggguucacauccaggcuuccccauuuagguagugaccuuggcucucccggugccucaguucccccaucugcaaaauggggauguggagcggguucccucccucccccaggguucuuggguuuugugaggccaguaaaacgcuugacaccgaccguggcacacacacaauugugaaaacugucauuauuguaaucguccuuuauuaaucugauccagugugcaccgcacucggaaaaguccgaaauuaggcucuagccguguuaagauuuuguuuuguugucuguuaguccugcuccaugaucuaauuguuauucuuacuuccauuuagccauuccaguauuuaucuaguguuccuccuugaugugugagauccuugggggagggguggcuucucugaauaagaacaauaaaauuuuaauuguuuuucauuauuguaauuauaauagccaacauuuuuuugagcaccagacauuuugcauucuauucacuuaauauuuauuaaaucauauaguaaguuuaaaaauaccauuccaggcccugggaauacaauaaacaagauagaccgaacugggguuuugaguuuaguuaggagagggagagacauaguaaaugaggaaacagauaaacauguuuugcauguuuuuuuaauuguuuaaucuugaugacauccuaaguaagacauuauuugaggaugcccauuuugcagaggaugaaacugaguaacagaagguacucugaguacuagucucagagcugauguccuuaaacacgugaaagggaggcuuuacgcuucuuuuuuuuugcacccauuaaauguuggauugaagauagaaaaaguagauacacccagcuugcaguuacugcuuuugaugguuugauccauuccucaugaaauuuccaacuaaagaggcggauagugauuacucuuuuaggcuugcaaagguacagcaucucuguaaaaugaaaggcuuuuuuuuuuuugagacggaaucuugcucugucgcccagacuggagugcaggggugugaucuuggcucacugcaaccuccgucuccuggguucaagcuauucuccugucucagccuccggaguagcugggacuacaggcauaugccaccacgcucggccaauuauuuuauuuuauuuuauuauuuuuuuugagacggaguuuuguucuuguugcccaggcuggagugcaguaguacaauaucggcucacugcaaccuccccccgccccagguucaagcgauucuccugcaucagccuccagaguagcugcgauuacaggcgccugccaccacaccugacuaauuuuuugcauuuuuaguagagacgguuuuaccauguuggccaggcuggucgugaacuccugaacucaggggauccaucugccucagccucucaaagugcugggauuagaggcaugagccacugcgcccggccuuaauuuuuauauuuuuaguagagacaggguuucaccauauuggucaggcuggucucgaaccccugaccucagguaauucacccaccucagccucccaaagugcugggauuacgagcgugagucaccaagccugaccagaaaggacuuuuuauuugaaaaaauuggggggcucuucugccuaugaaguagucuuccuuuguuucuuuacuuccauaauaaacuugcuuucacuuaaaaaaaaaagauuguguccaaauuucuuuuguguaguauuuaguuuaaaauaugcccaaaagcacaacuuuugcuucuguuacguaacuacauuuuuguuuucuuuuuuccuuuuuuugagacagucucucucugucacccagacuggagugcaguggcgucaucauggcccacagcagccucaaccuccuggguucaagugauucuccugccucagccacuugaguagcugggacuccaggcgccaccacacccagcuaauuuuuuuauuuuuuguagagauggggucuugcuuuguugcccaugcuaguccggaaguccugggcuugaguaauccuccuuccucagccauccaaauugcugggauuaaagucaugagccacuuugccuggccuuuuuuaguguuucuaagagaauucuguauuacauuccuagacaguacacuugguguaguacucagccuccugaggagcugggauuacaggugcucaccaccaugccuggcuaauuuuuuuuuguauuuuuuguagagacgggguuuaaccauguuuuggcugggcuccugaccucaagugaucugcccgccucagccucccaaaguucugggauuacaagugugagccucugcacccgcccuugauugaaguuuugguuuuuuuuuuuuuuuuuuuuuuuugagacggaguuucacucuuguugcucaggcuggcgugcaauggcaugaucucggcucacugcaaccuccgccuccuggguucaagcaguucuccugccucagcuucccaaguagcugguauuacaggugcgugccaacacguccggcuaauuuuuguauuuauaguagagaugggguuucacuacauuggccaggcuggucucgaacgccugaccgcaggugaucugcccgccucggcuucccaaaaugcugggauuacaggcaugaguaacugcaccuggccuugauugaaguuuuuaacuggcaugcugggaaagagaauauaggaguucagucuuaaaaucggugcuucaaccccugagccagaguccuuggggaaguagucuagaacuguggccucacauguuuguuuuuucuuuuuuuaaaacugagguggggucuugcucuguugcccagguucugcugcccagugagcauagcuucugcagccucuuaucucuggggcucaagucagccucccaccucagccucccuaguagcugugacuacaggcauguauugccaugccuggcuaauuguuuaaaaaguuuuguagacaugggguuucacuguguuucucaggcuggucuugaacugcugggcugcagcgauccuccugccucagcuucccgguauugggaguagaggcaugagccaccauaccuggccaccuaaaauguuuuuaguguucauuccaucaguaaauaggguugaguaugcacacacauucuaugaauguuuuauuuuuuguuuuuuuaugguuuuuuuugagacgaaguuuugcucuuguugccccagcuggagugcaguggugcgaucucggcucacugcaucguccaucuccugaauucaagugauuguccugccucagccucccaaguacugggauuucagguguauggcaccaccccugguaauuuuguguuuucagcagugauaggguuucaccauguuggucaggcuggucucaaacuccugaccuaaagugauccacccgccuuggcaucccaaaauguuaggauuacaggcgugagcuaccgcgccuggccugaauguuuguuuuaaauggcgauuauagugugacuguacuauguauuaggcauauauauguguauauauauauauauauauauauauauauauuuuuuuuuuuuuuuuuuuuuuuuuugagacagagucucgcucuguugcccaggcuggagugcaguggcacgaucucagcucacugcaagcuccaccuccuggguucacgccauucuccugccucagccucccgaguagcugggacuacaggugcccgccgccacgccuggcuaauuuuuuguauuuuugguagaggcgggguuucacccuguuagccaggauggucucgaucugcugaccucgugauccgcccgccucggccucccaaagugcugggauuacaggcaugagccaccgcgcccggccacuguauuagguguauuguuuuguuuuauuuuguuuugagauggaguuuugcucuuguugcccaggcuggagugcaauggcgaucuuggcucaccacaaccuccgccucccagguucaagcgauucuccugccucagccuuccaaauagcugggauuacaggcaugcaccaccacacccagcuaauuuuguauuuuuaguggagaugggguuucaccauguuggucaggcuggucucaaacuccugaccucaggugauccgcccgucucagccucccaaaguguugggauuacaggcaugagccaccacgccuguccuagguauguuuuauaacauacaaaaauagacauuuuacagaaggauaagguaaaauaaauggaaguagcaguuccaacguugucuuucuacacccaguggugaauuuuaacaauaccuccugggguggagaucauugaucuuguaguaguaccuucucaauccauuaggucuauugcucugaugaaaucuaguuuauucgguagaaguaaaauguaauggcuggguaugguggcucgcgccuguaaucccaccauuuggaaggucgaggugggcggaucaucugaggucaggaguuuugagaccagcauggccaacauggugaaaccccaucucuacuaaaaauacaaaaagaagcuggcugugguagcgggggccuguaguaccagcugaggcaggagaauugcuugaagccaggaggcagagguggccgugagcugagaucccaccauugcacuccagccugggcaacaagagggaaacucuaucucaaaaaaaaaaaaaaaaaaaggccgggcacgauggcucaucccuguaaucccagcacuuugggaggcugaggugggcggaucacgaggucaggaguucaagaccagccuggccaacauugugaaaccccgucccuaccaaaaaacguacaaaaaaaaucagcugggcgugguggcggguuccuguagucccagcuacuugggaggcugaggcaggagaauugcuugaaagaaacugcggagguugcagugugcugagaucgugccacugcacuccagccugggcaacacagcaagacucugucucaaaaaaagaaaaaaauguaaugguuaagauuuaaauucuaaaguuuugaaauuuaauucuggaguugugcugagguuaaaauccugggaaccaauccuaacaaguuuugagacuucaggcucauuacuuaaccuucuugugcaguucauuuuccucaucugaaaaauggagauaaaauuucuaccccauuugcagguuuauuaugaugguuaauauauguuaauauauguaaaguacuuaaaaccgugcuugacacauucuguucuggugguuguuaguggcugaggguauaccaucugacuuagggucucagucuaggaggggccgugcacaagucaacagguaaugauaaaguguuuuaagugcuuuaagcguaaggcuuuugggaaggcaggggagacauaacuaauuauuccuugagauuccagguaagguccagcuaaaggggugacauuaaaccaggcuuuaaaggagaagggaggcuuuucccaggagaaggaagggugaagucuacuggcugaagguaguugagggcuuggugaguaguuuaucagaucuggaccuacagggaaccugauugaagcuuauauaccuuguuaauagugaauucuggcuggaguuguuccuggcaggggccagauggcaaagaagccuguuacagaacuuuucacaccaccacagcccuuuccuucucucucuggcacauaccucauucugccuucuuaguuaucuaagaauauaagcuucuaaauuauaaacuccuugaggguuuugacaauguuugcauuuuuguaauuuuauuuugccuagcaagguaaguaggaaguucauuagugucgagaaagguauauaaucauuggaccuucaaggaagucuaaacaguuaaaaguggaaugguaaaugaccauauuuacuagugaaaaacuugguuacaaauguuuuguaguagauaggaccugugcauuacuauuuaaaagggguaagaaugaucaucuucaguaucccuuuccuuaucuggcacuuauccauugggauuacagaagagaucggaaagugcaucagaaaggcuugucugacguugaauagguaccuuuuguuugcucuucuaggucugcuuuccauccuuuuucacccuauccugugcccugggaagcugacuuaccuauauggacuacaucaaugagcuuccuuccccuuugagguuaugaaauuuauuuuccuacucccgucucauggguugugcccuuagcugacucugucccuugacugaaggucacugcuucucuaaaugugguccucucggccgggugcgguggcucaugccuguaaucccaguacuuugggaggcugaggccggcagaucaccugaggucgggaguuugagaccagccugaccaaaauggagaaaccaugucucuacuaaaaauacaaaauuagcugggcaugguggugcaugccuguaguuccagcuacucaggaggcugaggcaggagaauugcuugaacccgggaggcggagguuauggugagcagagaucacgccauugcacuccagccugggugacaagagcgaaacccugucuccaaaaaaaaaaaaaaaaaaaaaaaagaaugugguccuuucugugugacauccuccauguagguuuggaaaguuuuuguucccuuugguuguugggccuagagaucuagagaugcucucauuagucccaggguauuacagcuaucccuugugccuaucuuguacccugcucacauauuucuuucuaguuccauuauuaaacccuccuugaauuaaccuuacuggaguaugccauguuuccugcugggaccaugacuguguuugaagcuuguauacuuuuuuuuuuuuuuuuuuuuugagaaggggucucacucugucgcuaggcuacagugcgguagugugaucugggcucacuacaaucucugccucccggguuccagcgauucuccugccuccgccucccgaguagcagggacuacaggcacacgccaccacgcccagcuaauuuuuguauuuuuaguagagaugggguuucaccauguuggccaggcuagucucgaucacuugaccucgugaucugcccgccuuggccucccaaagugcugggauuacaggcgugagccaccacacccagcuuauuuuuauuuuuuuuauagagacaggauguuucuauguuucccaugcuggucucuaauuacuggguuccaaugauucuccugccuuggacucccaaaaugcuaggauugcagaugugagccauugaguccagcccuucuuugacuuuugaguaaguuuauccuaguuuggaaccaguuaguuuucuuuuuaucuuacuguauuuuuaaaauuuuuguuuguuaauuuugaaaccagguuaugagaccaacuuuuguauuuuugguagagacaggguuucuucauguugcccaggcuggucuagaacuccuaggcucaagugauccaccugccuuggccucccaacgugcuggcauuaacaggcaugaaccacugugccuggcccaguuaauuuucuuucuuuuuuuuuuuuuuuugagauggaguuucccuuuuguugcccaggcuggagugcaguggcacuggagugcaguugcucacugcaaccuccgccucccagggucaagccauuguccugccucagcuucccaagucgcuggguuuacaggcaugcgccaccacaccuggcuaauuuuuguauuuuuaguggagauggggguuucaucauguuggccaggcuggucucgaacuccugaccucaggucaucugcccaccucggccucccaaagugcugggauuauaggcgugagcuaccgcgcccaaccugaccuaguuuucuuauauacagaaucaaaaaaucagcagagagguugggcgugaugguggugccacucagcuguagucccaguuacucggaaggcugagguaggaggaucgcuugagcccagguguuggaagcugcagugauagugccacugcacuccagccugggugacagagagacccugucucaaaauaauaaaaaauaauaauggccaggcacaguggcucauaccuguaaccccagcacuuugggaggccgaggcgggcggaucaccugaggucaggaguucgagaccagccuggccaacauggcaaaaccccgucucuucuaaaaauacaaaaauuagccagguaugguggugggugccuaucaucucagcuacucaggaggcugaggcaggagaauugcuugaacccagggggcggaagguugcagugagcugagaucacgcugcuucauuccagccugggcgaaagagugaaacuccgucuaaaaagaaaaaaaaaaaaaauaagcagagagauugaguuuaagcuuguucucaaguguuaaauguuguauagguuaugugaauccagaguuuuaggcaggaagaaugguuuaaaugauagugcuuaaugaaugauugcagcccugggaucaaaaugaguuaauucacuaaguucaggguaaugaaaauaggaggaagagguggggaaguaagauuucucaccugccaauuuuguucucauuccuuagaguauuguuuugaaucucauagaaagugaccauucuuuuguaaagauuuacuucaaaucccugaaagcuuggaggcuaaugaagaagaaucacucugguuauuguuuaggcuuuaguaagauuaccaaggaagggaucucauaaugcuguaguaauaguuuacaugugcgacaugagcuaguguuuguacaugugacagaccuuguuucuggauuuuauuaaggcugguuaaguagcuuuuugccucugucucugguuucugucucuggccccuugaggcuaucugaaauuuuaggaguugggguaccauaacuugaacuuuugaaaugagucaauaagcagauacgucagccgaguaugacuuuaagucuaguugaauucuuuuaagaaaaagucuuggcuagauuuucugcugggcauuuuuuauguacaucaaucaucucauuuaauuauagaucaaacuugggagagaguaucucuguuuuacugauaaggaaauccugggcgacagagugagacuccaucucagaaaaaagaaaaaaagaaaugaguuagagaauuuaauuguccaaggucacacaguuaauaaguaguagauucacucuuccuaacuaguuuaaucuuggugucaaguucauucauuaugcauugaguguccaaacacccauuuauuuuuuauuuuuuauuuuuuuuaaagacagucucugucgcucaggcugagugcaguggugugaucuuggcucacugcaaccuccaccaccgagguucaagcaguucugugccucagccuccugagcaacugggacuacaggcgcccgucaccacacccggcuaauuuuuguauuuuuaguaaagacgggguuucaccaucuuggccaggcuggucuugaacuccugacuugugaucugcccgccucugccucccaaaguggugggauuauagacgugagccacugcgcccagccaaaaacccacuuuuuuuuaacccucuaucgcauggcuucuuuuugcuagacuagggguuuuuagacauguguucuacaggagcccagagcuuccugaagauaauugauuucccauaaucuuucuucaacuuucuuucccuaacaacucuucuuauuuaaaaaaaaaaguccaggccaggcgcgguggcucacgucuguaauucaagcacuuuggggaggcugaggcugauggaucagcugagguugggagcucaagaccagccugaccaacauggagaaaccccgucucuaauaaaaauacaaaauuauucagccaugguggcgcaugccuguaaucacagcuacuugggaggcugaggugggagaaucacuugaaccugggaggcagagguuguagugagccaagauccugccacuacacuccagccugggcgacagagcaagacucugucucaaaaaaauaaauaaaaauuuaaaaauuuaaaaaaguccaaauaauugggguaugauuuaaagauagcuauaugagaccuuguucagggguauccuaaguuggccuuagagaugaauuaaaaaaauaaaaaggcaacagaaacugucagcagucuuuaacaauucaucccauauguuuccugaucuuagcagugaagcagaugauggcagugaacaucaaaagcccaagaaauguccaugcuaauuuugcauggcucuaugaggagcugucaaauauggaucaucaaauauaguauauagacuaugcaaugaagcuuuacuuugcaauguggcucuuuaagauuugauuuuacccuucuauuuuguguuguaauuaaaugcagaaaucaaaguauaaauucagaauaacccagagcuugguauccuucugucugaauuuauagcuuuggaguuggcuagaccuuucagucaaauuagcugauggugacaaauauguaaugugaccucuguagcagcuccagugaaauguuaauaucaggcauagcacagcucccuugauacacuauuuuggccuuuuccucucuuacaaauguuucccuuauuucuuuguuaauuuagccaucuccaugcagaggucgugccugcuuuuaauuuuucgaagccacaugagaacagacauuuaaacaacacagauuuauucauuuuggccuuguaucccuagagcuacacuaacuuuaugucugggacuaaagguggaaguagcugagauuagggaaaugcagaauggugagggagaagugccgggagaggugaugguuuuagcuccugcauuccccagccaauugcugaaauucagcuccccauuaauuuucccuugauaaguuggucuggcuaaguaguugaaacuauauucuuagccuuccuuuuuuuuuuuuuuuuuuuuuuuuuuuugagagggagucucacuuugucgccaggcuggagugcaguggugcgaucucggcucacugcaaccuccgacucccugguucaagugauucuccugcugcagccuccugaguaccugggauuacaggcacaugccaccacacccagcuaauuuuuguauuuuuaguagagacaggguuucaccauguuggccuggauggucuggaucuccugaccucaggugauucgccugagucagcgucacaaagugcugggauuacaggcaugagccacugcgccuggccuaauuacaaaauuuacuuaauuuuuuauuuuguagagaugaggucucacuuuguugcccaggcugaucucaaacuccugggcucaaguuauucucccaccucaagcuccgaaaguacugggaucacaggcgcaagccaccuuauguggcacuagccgggauuauagacaagcgucagcuaauuuuuguuguuguuucugucaguccuuccuugcuuauuaguuaauauucuucugcagagcauuuucuuaucuuuguguauauauauuaauauggauuuauggauucuuauuuuaauacucuguuacugucauuauuuguuguguucacauuguuccagauuuggccagggagauccccuucaagcuggcuuuugugucauuuugacacauucccacauuuuuuaacugcuuuuuuugacacaccaaaaagguguuguaggcuuaguuucugcucuucauuuuuuuuuucuuuuuuuucgugugugugacggagucucgcucugucgcccaggcuggagugcaguggcccgaucucggcucacugcaagcuccgccucccggguucacgccauucugccucagccuuccgaguagcugggaccacaggcgcccgccaacacacccggcuaauuuuuuguauuuuuaguagagacgggguuucaccguguuagccaggauggucuggaucuccugaccuugugaucugccugccucgaccucccaaagugcugggauuacaggcgugagccaccgugcccggccuaguuucugcucuucuuacccucuucuuggaaucggccauuucuccaaacuguuucucuccuaauuccuuucaguggagaaaauuauuuagaaaucaagauuuggaggccgggcgcgguggcucacgccuguaaucccagcacuuugggaggccgaggggggcggaucacgaggucaggagaucgagaccauccuggcuaacacggcgaaaccccaucucuacuaaaaaauacagaaaauuagccgggcuugguggcgggcaucuguagucccagcuacuccggaggcugaggcaggagaauggcgugaacccgggaggcggagcuugcagugagcugagaucgcgccacugcgcuccagcuugggugacagagcgagacucugucucaaaaaaaaaaaaaaaaaaaaaaaaagauuuggaugcugugugugcucauuccuauuggaauauuguuuuuuagaacuucuuaauggacagagcuaggaaauauauacacacacauacauauacacauaucaaaaaauauguaucuaaauuucuuucuuucuuucuuuuuuuuuuuuuuuuuugagauggagucucgcccagucgcccaggcuggaaugcaguggcgcaaucucagcucacugcaaccucugccucccggguucaagcgauucuccugccucagccucccgacuagcugggauuacaggcgcccgccaucaggcccagcuaauuuuuguauuuuuaguagagacgggguuucaccauguugaccaggcugguaucgaacuccugaccucgugauccgcccgccucggccucccaaagugcugggauugcaggcgugagccaccgcaccuggccauuuuguguguauuuuuaggaaaaaaauuauuguauaaaacuagauagcagugaaauauauucauuuuguaugguuuauuuauuuaucuuuuuuucuuggugcuucugucuuggcagagucucagaauaacuugaaaucuuuuuaaauuuuuugugacagggucuuacuauguugccccggcuggccucgaacuccuggcccaagcgaaucuccugccucgaucucgcaaaguacugggauucaggcauaugccacuaugcguggccaagauguaauuuauauacaaucaaauuuacuuuuuuuuuuuuugucaguggguagagaaaaaaacuugcucuuuuucauggcauaguucuauuaguuuuguauuauuaguaugcaguuguaaucaucaaaccagauagagauaauuuucauucuuccuguaaguuuucucacaccccuuucuuuucaccucgcucuuggaagcuacuaguuuauacugguuuuugucacucacaguuuuauggggguuuuuguuugcuuguuucucuacuuuuucuuuucuauaaugucauauacauggaaucauacaguauguaaccuuugugucugauguguuucacuuaccauaaugcuuuugagauucauccacguugugucauguaucuauagguuguuccuuuuuauuguugaguaacauguuauguucaccagcugauggacauuugaacuguuucccauuuugaugauuaugaauaaagcuuuaaauauucauauacgguucugcauguggacauauguuuuucucucucuuggauaaauaccuaggcaugggauugcuggguucuaugauaauuucauauuuaacuuuuuuuuuuuuuuuuuuuuuuuaagauggagucuugcucugucacuuaggcuggaaugcaguggcauggcucacggcagccuccgccuccugaguuuaagcaaauucuccugccucagucugccgaguagcugggauuacaggugugcaccgccacgcuuggcuaauuuuuguauuuuuaguagagaugggguuucaccauguuggccagacugucucgaaauccugaccucaggugauccacccaccuuggccuccaaaagugcugggauuaaaggugugagccaccacgcccggccuauacuuaacuuuuuuggaaacugccaaaauguuuuccaaaauggcuauaccauaccauuuugcauuuccacuacuaauguaugacaguuucacuugcuuguugguauuuuuguuuuguuuuguuuuagaauuaauuguuaaggaagcacuauaucugggugaaaucaauuuuggucaucucauuucuacaaugaaaggaauacucucuguuacuuguuuuagaauguagggucccuugcuauuuauauucuuuugggguuagugcaguucuuauuuacacaucauuugcagaaauaaugguaacuaccauuuguguaucagaacaauuuucacauaucuaauuuuuauagcaauuaagguagguagaagugucuucauccucuuaacuuguauaaggagauugguucggguaaucaggugauuuacucacugucacacggcuagaaugugagaguguggcuuuuuggauuuggagcugugaggggacauucugucucucuuuuaaguagagguguaauagaggaagauaugggugucaucccaguccuuucuuuuaccucaaauucauaagcagugcagucuugaacaauucauauuugaauuuugaguuaauuucaucuuuucaccugucuaccugaaaaggugagaaucaguugagggacuguuaaaggauguuuugaacacuguauguuaccucaugauuaauuuuauaguacucuccauuuguagugguuuccauaguuguuuaugggaacaaguuugcagaaaaaaaaugguugaauagaaauagaaggggucggccgggugcaguggcucacgccuguaaucccagcacuuagggaggccgaggcgggugaaucacuggaggucaggaguucgagaccagccucaacauggagaaacccccaucucugcugaaaauacaaaauuagccaggcgugguggugcaugccuguaaucccagcugcucaggaggcugaggcaggagaauuacuugaaccugggaggcggagguugcagugagccgagaucgcgccauugcacuccagccugggcaacaagagcgaaacucuuguuucaaaaaaaaaaagaaagaaauggaaggggucaggugugguggcuuaggcuuguaauccuaacacuuugggaggcugaggcacauggaucacuugauaucaggaguucaagaccagccuggccagcauggggaaacccugucucuacuauaaguaugaaaauuagccagacugguggcgcacgccuguaauccuagcuauuagggaggcugaggcaggagaauugcuugaacccagaagguggaaguugcagugagcugaaaucgugccacugcacuccaaccuaggggacagaguaagacugucucaaaaaaaauaaaaauaaaaaaagaaaagaaauagaaggggcuggguaugguggcucaagccuauaaucccagcauuuugagaggccacagugggaaaauugcuugaguccaggaguuugagaccacacugggccaacacagacccugucucuacaagauaauaauaauagucauaauaauauaaauuaauacaaaaaagaagagaagcaauuuaauacaagagcugaauagcaaaauggccaguacuacuacaauacacacagagacacagguccccucuuuuuucauauuuacuuuguuuuauguaauacauaaauacauugaaaaaaauuaauacagauaaaauaaaaauccacuuccuacacuaagugaaaccauuaacaacuguauuauggagcuguuagaugcagggauugcgcuaagugccauagggcugccaagguagguaagauucggucccgguccucagugauuuucuaguuuuccuucugugcccuaacaguuuuuggauagcucuuguaauaaaaacuuuuaaacagauguuuuaaguuuagauagugauuaaccaucuuuuccucuuguaauugaugccaucgagugagaguucuguugggaaauagugaaacaaggauucugguucaaucaauggaggcagggaauuucggaggaaggagaugggaugccauccaugccccagagccacugagcacuuagcugcagcuguggagagcaacacuuggcuagcuaugaguuuucuguaggucucuaaauaguucaugcuaauuuuguggauguuggacucugaggaaugguguguucaauggggagaauguccaaaaaaacuguaacugguaaguagccauuuggaauacugaaaucaauuucugauuaugugaaugucccuuuuuuguaaauuauuuuagcuuacuugccaguucaguuucuugguguuacccuguuaguuaaauucaauaugucauuuauuuaagggccugauauuuguauucuauuagaaggacaaacagcuaauuauacuagaagguggacuauaaugaauugucauuacagugacuaaaaguuauugauuuucuaggauauucuugauuucagauauuuacuuugacaaacguuuauugaauuccuuguaucagauccugggggauauaaagaguucugagguccuggaggacuauguaguccaguaagggagauugauagcuucaguaccaaaugcuaagcaguguuaauggcaaguaacauccuaccaaggaugggcaucugaccuaauguguaaguaugcaugugugaguguguuucaaaaaaggcuucuuagagaaaaugauaucuguuuugagccaaucuguuuuuccuuacaacauaaaaaaauaauuuuuggacuggcuauguauuuagcuaauuuaacauuugaaacgaacaaagaauacuuauugaaguuucucucaccucugcaccagccagucuuuuccccuuccuggaagcagcuagcauuaccauuuuuuucuggacccuuucgauacauuccuguaggccauauaaugucgguagguaaagaacuuccucauuuugcauuguauuucauuguaugacugcaccauacuuuuuccccccuacugcugauggacauuuaccuuucaauccuuugcuguugcaaacaaugcugcauaaccuuguagcaauugucuuuucauagaucuguagaguaaauuccuagaaguagaacugcugggguuaagggguuugccuguuuguguaauuuugauagauguugccagaauacccucuggagagguauaucagcuuuuauacuccuaccagcaaagcaugacccaagugaagaauggguaggagaugggugaaguugaggcugggucagguuuaugagugugagggggacugaaaguaguuauguauuauugaagugugaagugcuggguaaagaauagcaggagaugagaguaggaagcagacgggucaggucccuuugccuuugugcuguuuuuguuuguuugauagccucuuacucuggcccaggcuagagugcaguggcgcaaucucagcccacugcaaccuccgccucccggguuuaagugauucuccugccucagccucccaaguagcugguauuacaggugugcgccaccacaccuggcuaauuuuuguguuuuugguagagauggaguuucaccauguugcucaggcuggugucaaacuccugggcucaagugaucugccuaccccggccugccaaagugcugggagaacaggugugagcuacugcaccccgccugccuuuguuuuuaugcuuguauuuuuuuguuuguuuguuuuuuuagcuuuuaaguugagggcuacaugugcagauuuguuacauagguaaacuugugucaugggcguuuguuguacagauuacuuccucacccagguauuagccuaguaccuguuauuuuuccugauccucucccuccucccacccuccacuuucccauaggcuccaguguguuuuguuccccucuuauaugucuauguguucucaucauuuagcucccacuuguaagugaaaacaugcgguauuugcuuuucuuuucccauguuaguuugcuaaggauaauggcuuccaguuccauccaugucccugcugcaaaggacaugaucuucuuuuuuauggcugcauuuauaagacaagagggguuuauuuaaacuucugcuaucagaaguaggaaauugggaucccauuagggcuuaacuuaauugguuugauuucagcuuuuuagcuuggaggcugcugaagaguuaauuuauuguaugagaguuuggccguguguggagcacaaacuuacuuguuuuaaagaaaggauuucuuuguacauuuauucauuugccagaucagucguuuacaugugaacccucuucacaguuaguuauagggaaaacaagcagauaauucaugccaguuaaauauuacaauaugucagacuuggcugggugugguggcucacaccuguaaucccagcacuuuggaaggcugaggugggcagaucaucugaugucaggaguuugagaccagccuggccaacauggugaaaucccuuauuuacuaaaauuacaaaaauuaucugggugugguggcacacaccuguaguccuagcuacuugggaggcugagguaggagaaacacuugaacucuggagguggagguugcaaugagucaagauugcaccacugcacuccagccuaggcgacacagcgagacucccucucaaaaaauaaaaaauaaaaagaacacgacacacugauucagaucccaagauuaagggggaaaacaaggcuucagauuuuauuaaacuuauccuaaauaaugauguuuuuaaaaggaaaccuuuggggaaauaaucugucgguaacagaugucuaaauuuuuccuuauuugaaaagguccuggcugggcacgguggcucacaccuguaaucccagcaauuugggaggccgagguggguggaucauuugaggucaggaguuugagaccagccuggcccaaugugaugaaaccucgucucuaccaaaaauacaaaaauuagcugagcauaguggugggcuccuguaaucccagcuacuugggaggcuagggcaagagaaucucuugaacgugggaggcggagcuugcagugaacugagaucacaacacugcaguccagccugggagauagaguaaaacucuuuuuuuuuuuuuuuaaauacaaguucuaggguacaugugcacaaugugcaguuuuguuacauagguauacaugugccauguugguuugcugcacccauuaacucgucauuuacauuagguauuucuccuaaugcuauccugcccccugccccccaccccaccacaggccucggggugugauguugccugcccuguguccaaguguucucauuguucaauucccaccugugagugagaacaugcgguguuugguuuucuguccuugugauaguuugcucagaaugaugguuuccagcugcguccaugucccugcaaaggacaugaacucauuguuuuuuauggcugcauaguauuccaugguguauaugugccacuuuuucuuuuuuucuuguuuuuuuuuuuuuggagacagagucucgcucugucgcccagacuggagugcaguggcgcuaucuuggcucacugcaagcuccaccucccggguucaugccauucuccugccucagccucccgaguagcugggacuacaggugcccuccaccacgcccggcuaauuuuuuuuguauuuuuaguagagacgggguuucaguuguuagccaggauggucucaaucugcugaccucgugauccgcccgccucggccucuggaagugcugggauuacaggcgugagccaccacgcccggccacauuuucuuaaucuagucuaucauugauggacauuuggguugguuccgagucuuugcuauugugaauagugccgcaauaaacauacuugugcauaugucuuuauaguagcaugauuuaugauccuuuggguauaugcccaguaaugggaucgcugggucaaaugguauuucuaguucuagauccuugaggaaucaccacacugucuuccacaaugguugaacuaguuuacacucccacccacaguguaaaagcauuccuauuucuccacauccucuccagcaucuguuguuuacugaccuuuuaaugaucgcuauucuaacuggugugagaugguaucucauugugguuuuguuuugcauuucucugaugaccaguguugaugagcauuuuuuaugugucuguuggcugcauaaaugucuucuuuugagaagugucuguucauauccuucacccacguuuugaugggguuguuuguuuuuuucuuguaaauuuguuuaaguucuuuguagauucuggauauuaacccuuugucagauggauagauugcaaaaauuuucucccauucuguagguugccuguucacucugaugguaguuucuuuugcugugcagaagcucuuuaguuuaauuagaucccauuugucaauuuuggcuuuuguugccauugcuuuugguguuuuagucaugaaguccuugcccauaccuguguccugaaugguauugccuagguuuucuucuaggguuuuuaugguuuuacgucuaauauuuaaguaguuaguccaucuugaauuaauuuuuguauaagguguaagaaagggauccgguuucaguuuucuacauauggcuagccgguuuucccagcaccauuuauuaaauagggaauccuuuccgcauuucuuguuuuugucggguuugucaaagaucagaugguuguagaugugugguuuuauuucugaggccucuguucuguuccauuaguuuauauaucuguuuugguaccaguaccaugcuauuugagcaaaacucuuaaaaaaaugguuuauguaaagagaaaaguaacagaaaaaaggcugucuuccaaaaggauuacaggugugagccaucaugccuggccauaaacuuuuuauuaaauagacaaaaugcauaaaucauaaauguacagcucagugaauuuucacaaagugaucauaccuguguagcuacuauguagaucaagaaauaaagcauuagggcaugguggugcaugccuguagucccagcuacucaggaggcugaggcaggaagaucacuugagcccaggaguucugaggaugcagugagccaugaucaugccacugcacuccagcuugggcuacagagcaagacccugucucaagaagaagaaggcugggcacaguggcuuacgccuguaaucccagcacuuuggaaggccaaggcagggagaucacuugaggucaggaguuugagaccagccaggccaacaugugaaacccugccucuacuaaaaauacaaagauuagcugggcgugguggcaugcgccuguaggcccagcuacgugggaggcugagguaggagaaucgcuugaacccgggagggggagguugcagugagcugagaucuacgccacugcacuccaggccagcgacagagcgagacucugucuucaaaaaacaaaaauuagccgggcauggcggugugcaggcggugugcaccuguuaaucccagccucucgggaggcugaggcaggagaaccacuugaaccugggaggcaaauguugcagugaaccaagauggggcuacugcacuccagccugggcgacagagcgagacucccucucaacaaaaaaaaaguaaaagaaaacauuaacagcaaccacuucagaagccuaccuucuuacuugccagucacugucccuccuucuccaagggguaaccacuauccugaccucuaucaccauucauuaguuuugcuuuauucuuuuugaacuuuauauaaagagucauauaaugugcauucuuccauaucuggcuucuuuugcucaacaguaaugauacaugaucuuguguuaguaauaauaguccauucucaaauuucugucuaggguuuugccacaguaauauaccacagucgguccauucugcuguugagguauauucugauuguuucuaguuuuggacuauuaggaauaacgcugcagggaacauucuucuguguaugugggugcacguauguaugucuuuuuuuuuuuuuuuuuggagacggagucucaacuguguugcccaggcuggagugcaguggcgcgaucucgggcugacugcaagcuccgccuccuggguucaagccuuuuuccugccucagccucccaaguaguugggacuacaggcuccugccaccaagcccagcuaauuuuuuguauuuuuaguagagacaggguuucacugcauuagccaggauggucucgaucuccugaccuugugauccacccaccuuggccucccaaagugcugggauuacaggcgugagccaccgcacccggccacguauguaugucuuuuuguuggguguaugccuaggaaugggauuggagggacauacagugugcauauguucagcuuuaguagaugcugcugcugucaaaguuuuccagaguuguucuaucagccaaugcuugcaucagcagucugugagaguuccauuuauuacacauccucuccagacuaacaacuugcuguuguuaauguuuaaccuuuuugaagagccucugcuuugugagauagguagagggcauacagucgugaagaaaacagugcugcuuucauagaccguaauggguuuuuuuguuuuuuuuuugguuuuuuuuuuugagauagagucucacucuugucucccaggcuggagugcaguggcacaguaucagcucacugcaaccuucaccucucagguucaagcgauucuccugccucagccucccaauuacagcugggauuacaggugcccaccaucacgcccagcuaauuuuuguauuuuuuaguagagacgggguuucaccauguuggccaggcaggucucgaacucuugaccuugugauccgccugcguuggccucccaaagugcugggauuacaggcgugagccaccgcaccuggccagauuagcuggggcaugguggcaggugccuguaaucccagcuacuugggaggcugaggcaggagaaucgcuugaacccgggaggaagagauugcagugagccaagauugcgcaacugcgcuacuggccgggugacagaguaagacucugucccaggaaaaaaaaaaaaaaaaaaaagaauguuguaccuguuuaauauauuuagguguugauaaguacuugcuguuuuuuguuuuguguuuuuuuuuguuguuguuguuguuuugagagggggucuuuugcccaggcuggagugcaguggugcgaucucggcucacugcagccucugccuccuggguuccagcaauucuccuaccucagccucccaaguagcugggauugcaggcaccggccaccaugccuggcuacuuuuuuuguauuuuuaguagagacaggauuuuaccauguuggucaggcgggccucgaacuccugaccucaggugauccaccugcuuuggccucccaaagugcuaagauuacaggcgugagccaccgugcccugccuuuguuuuuuuuuuuuuuuuuuuuuuuuuugagauagagucuuacucugucacccaggcuggagugcaguggugcgaucucggcucgcuacaaccuccaccucuuggguucaaacgauucuccugccuuugccuccccaguaacugggaugacaggugugugcuaccacaccgagcuaauuuuuguauuuuuaguagagacgggguuucaccaugucuggagaggagcaguccaggcaaagguaauagcggguguugaggcccugagguaggaacaugcuugauauguuuaaagagcaccaaggaggcuagcauggcuggagcaggggauggagcgaaaagcugaugucagggagguagaugggggccagagcacacagcgcauuuggggucaugguaaggauuuuggauuugcugaaugaaaucaguuuugagcaggagggugacauuauccccuuuaccuuuuaaagagauugcuuuuauuuauuuauuuauuuuauuauuauuauuuuuaaagacaaagucuugcucuguccuauaggcuggagugcgaugguggggucuugcucacugcaaccuccgccuccuagguucaagugauucuccugccucggccucccgaguagcugggacuacuggugccugccaucacaccuggcugauuuuuuaauuauuagagaugggguuucacuguguuggccaggcuguucuugaacuccuaaccuugugauccgcccgccuuggccucccaaagugcugggauuacaggcgugagccacugcacugggucuaagagauugcuuuuagagaaaacaccuagugaaucaagggaggagguaggaaugugaauuaagaaguuacuguuggccgggcuugguggcucacgccuguaaucacagcacuuugggaggccgaagcggguggaucaccugaggucaggaguuugagacuagccuagcaaaaacauggugaaauccugucucuacuaaaaauagaaaaauucacugggugugguggcaggcgccuguagucccagcuacuugggaggcugaggcaggagaauugcuugaaaccuggagguggagguugcagugagccaagaucgugucacugcacuccagccugggugacaaagcaagacuccaucucaaaaaaaaaaaaaaaaaaaaaguguggcacugcacaccagccugggugacggaaaacguguccuuggccaaauagugguauccugcucaaugagggauaauguuauuuaugcuauaauaucuaccuauuauuuauucuguaguguucugcauugacacuauaguuuuuuauuuuuauuuuuuuauugagauggagucucacucugucauccagcgaggcugaggugggugggucagagaccucaaguuugagaccagccugacaaacauggcgaaacccugucucuacuaaaaauacaaaauuagucgggcaugguggcguauaccuguaaucccagcuaauugggaggcugagacaagagaaucacuugaacucgggaggcagagguugcagugagccgagauugugccauuacacuccauccugggccacaagagggagacuccaucucaaaaaaaaaaaaaaaaaaaacggggcggggggaauaucuuauaauuacuuuccuaaagauagcuuucaaaaauuacagugucgagaaggcucauaccuguaaucccagcccuuugggaggacaacacagaagaauaguuugagaccauccugagcaaaauagcaagaaugcaucucuacaaaacauaagaaaaauuagccaguagcacaccuguaaucccaguuacucaggaggcugaggcaggaggaggcuaagcccaggagguugaggcuggagugaccugugaucaugucacugcacugugccugagagacagagcaagacccggccucaaaaauguaaaaauaaauucaaaaaaugaacaauaauuuaaaaacuacagcgucagacgggcaugguggcucacacuuguagucccagcacuuugggaguccgaggcgggcagaucaccugagaucaggaguucgagaccagucuggccaacauagugaaaccccaucucuacuaaaaauauaaaaauuagcugggugugguggugcaugccuguaauuccagcuacucaggaggcugaggcaggagaaucccuugaaccuagcaggcagagguuacagugagcugagagcgugccacugcacuccagccugagcaacagagugagacuccaucuuaaaauauaaaaauaaaaaacuauagccaggugcaguggcucacgccuauaauccuagacuucgggaggccgaggugggcagaucacaagguccagaguucgagaccagccugaccaacauggugaaacccugugcugggauuacaggugugaaccaccaugcccagccaagacauucuuuaaaaaugccuagcaaauauaguaaaaaguaaaaauucucuuucaccucaucgcugaaaguuucuguauauuuucaggcuuuuugguauaccuuuauacacaucuguaauacucacgcaguguuuuuucuaaauggaaugauacuguacauaauacuuugcaguuuuuauaauuuacagucagaugggaaggacacaaaacuauucuagaagaucuuugcuuuaaacaguagugaagacauuuaucucuucuguuguuuuaagugccuuggaacagauuuuaugaacaacagcaacauucgauauugauuugcucaguguuaguagugagaugccuuuaguagugagaucacaccuuucagagaacuuucuaaaugcucuguaaauaaaagcagauaugugauggacugcuucaugauguugccaagcaccauucacauccuuuucccuuucucagaaagugcagagucauccauuuuggagcaguuaguucuugcagaucuaccaauuaccugugguuauaggagaugauguuucucuaucugccugaaaguggaaaaaggaauuaaugaaccugugaaguucaguucuguaacuagacagagcugugcuggaaaugaaaauaaguccuuucuguuauucaugacauaugggaagaaaagcuucagguagaucaagcucugcaggccuaaauccacagaagccuugccaauuuucagcucauuauugccaucaagguauuuuggugauuauuuccacuauuguaaacuaauucauaggacugguuuuuuugguuuuuuugguguuuuuuuuuuuuuuugagacagagucucgcucuguuguccagacuaaagugcaguggugugaucuuggcucacugcaaucuccggcucaaucacucaagugauucuugugccucagccucuugaguagcugggacuguaggugaaugucaccaugcacagcuuuuuuguauuuuuaguagagauaagguuugguuugguuaguagagccuagguuggcuaggcugcuauauuuugccuuuuuuuuuuuuuuugaagacggagacuugcuugcaaccuccgccucccgguucaagcaauucuccugacucagccucccgaguagcuuguucuacaggugugugccaccauaccuggccaauuuuuuguauuucuaguagagauggaguuucacugugugggccagguuggucucaaacuccugaccuugugauccacccgccucggccuccuaaagugcuaggauuacaggcgugagccaccgugcccagcuuacauuuugcuuuuauuuuuuuugagacagagucucucucugucacccaggcuggagugcaguggugcaaucucggcucacugcaaccuucaccuuccagguucaagugauucuccugccucagccucccaaguagcugggacuacaggcacgugcaaccaugccuggcuaauuuuuuguauucuuaguagagacuggguuucauuguguuagccaggaugguuucggucuccugaccucaugauccgccugccuugccucccgaagugcugggauuacaggcgugagucacugcauccugccuacauuuugauuuuaaugucuuacuguuaaugauccaugcaccaaauucccaugcuguuaguauuuuucucagaaugacaaaggaauugaaaugccauugugggauaaaauuaaauauugucaaaggccugcucugagccagucuauggacuagguagauauauuggggagauaaugaaguaggcucuuguuggaaacagagcagaccaaaccaaacagaaaaugaauuugucagaccaggcacgguggcucacuccuguaauccccacacuuugguaggcugaggcgaguggaucaccugaggucgggaguuugagaccagccugaugaacaugaagaaacucccucuacuaaaaauacaaaaaaaaaaaaaaaauuagcugggcaugguggcacaugccuauaaucccagcuacuugggaggcugaggcaggagaaucucuugaacccgaguggcagagguugcggugagcugauaacacgccauugcaguccagccugugcaacaagagcgaaacuccuucuccaaaaaaaaaaaaaaagugaauuuaucugugucuugguuuucuuuuuuucuuucucuucuuuuuuuugagacggagucuggcucuguugcccaggcuggaaugcacuggagcgaucuuggcugacugcaaccuccgucucccggguucaagcgauucuccucccucagccucccaagcaacugggacuacaggcucacagcaccaugcccagcuaaguuuuguaguuuuaguagagacgggcugucucaguuuucaaauaaugaaggugaauucaacugguaaauguagguuucuauuaaauaaugauuaaggaaagaaaaauaauauuuggcccucuguuucuguggguuuugcauccaugaauucagccaaccauggaucgcaacuauucaggaaaaaaaauauacagauuguggcugggcaccaugguucaugcuuguaaucccagaacuuugggaggccaagaugggcagaucaccugagaucaggaguucgagaccagccuggccgacaaggugaagccccauuucuacuaaaaaugcaaaaauuagcccggugcaguggcauaugccuguaauuccagcuauucaggaggcugaggcgggagaaucgcuugaacccgggagguggugguugcaaugagucgagauugcucaacugcacuccagucugggcaacagugcgagacucugucucagaaaauaaauaaauuauuuaaauaaagaguauuagagguauggguagguuauaugcaaauauuauaccauuuuacguaagagacuugagcauugguggauuuugguauccacacggauuccuugcaccagucuaccguggauacucagggacaacucuguguaugguauacaccuugguguguauucuaaucaucugggaagcuugugaaauguagguucacccccuggauuuuuaaauccuggaaggucugggguaggguccaggaaucuucauuuucagcagcaggguuccuaaauaauucucuuagagguaaccugaagacuccuuugaggagcauuggugucucagagggugucuaaaccugacaaagaccaucuaaaucuaguuggcugagccgggcacgguggcucacgccuguaauaccagcacuuugggaggccgaggcaggcggaucaccugaggucgggaguucgagaccagccugaccaauguggaagaaaccucaucucuacuaaaaauaaaaaauuagccaggcaugguggcucgugccuaaucccagcuacucgggaggcugaggcaggagaaucgcuugaaccugggaggcagagguuguggugagccgagaucacgccauugcacuggagccugggcaacagagcaaaauuccgucucaaaaaacaaacaaaaaucuaguuggcugaagaguuauggggaggaaaaacuauuuugauauagcacaaacuuugugauaaaagugauaaacggagauaacugagaaacuauuaaggaaagagaucaguuaacgcucacugagguagggaggagaggcagaugucugauuuuauguuaaacuugaggaauauaucuuucauuugauugccuuguuuuauauaccucauaaugcuauauugucuugguaaccaagcucucauaucuguauauuacugcaguccuggggcaucucuaacuucuaacauauacuacuuuuuugauaagcuauugaacuguccuaaguaggccggguuuggugguucacaccuguaaucccagcacuuugggaggccaaggcagguggaucacuggaggucaggaguucgaaaccagccuggccaacauagugaaacccagucucuacuaaaaaugcaaaaauuagcugggugugguggcacgcaucuguauuccaagcuacuugggagguugagccagagaauugcuuggaccugggaggcagaguuugcagugagcugagaucaugccgcugcacuccagccuuggugacagagcaagacuguaucucaaaaaugaaaaaaagaaauaucuuaaauaacuuuucaacguucaaacuaacucguggacuauggcauaaaaucauuuguuacucaugaguguuuucguuuauuuguucaggaaauaaucacuguuuuuacacacgcacgcgcacacacacacacauuuucaccugccaucacauacacacacacacacuuucaccugccaucacacacacacacacacacacacacacacaauuuucagcugccauccuagauaguuuaccaauauugaugagucuuucuuaauggggggacauuucucggaggauuuaaguauagguuaagucgauuuaaggcuuuagggggagaagaaaacauuucucaauuauaaaguauacaacuaggaagaaauucuuauuucucauauucuguuuauuuagcacuauccauucauuuagcacauuuacuuguauugacacuaccaugcuuaugaagccgugauggcuagggaguaaugagcuuguuuugcuaguguuaucuucuauaaauguucuaaauuaaguaguuggggaagugguuaaugacaaccaaauuuguaaucuaggauuguuacccucuaaucaauucuuuuuaaauuucuuccugacauuuaucuuguuauaauaauaacucucugacauuauuauuauaacaaaauuguuguauuuguguuuuggggauaaaaggcauauuuuagcauccuauaguuuaaaaugguguuuguuuuaaucugggugauaagauggaaaugcugaccugggcuugccugaucuacagcuaacauuguucuaauaaacugcauggaguccagguguuuuacuuuaacugcagcuguaccaucugugggagcagguggacagauucugugucaucaggaaaauacagcuggugagacuaaggagaagagcuaauugauugcuuuuccagcucucuccagucauauauaccuaagcauagcauuuaccuuggcacagguguugccuuuggucuggauaguaacagcaaaauugaacaaaaaaagauguaaauuugagcugcguguguguguguguguguguguguuucuugguuggcauugagaaagauaauuuaaggguuuuuuguuuguuuguuuagguuuuauuuuuguuuuuaguuacuugaagauauuuccagcucguuaacuucucugagagaguuccuuguaaggcuacuuauaaauaguaguauauauauauauaguuuauggcagggaagaucugggaaguaagcaaaaagagccuuuaguuaggcaacauagaacaaaauagaggucacagguuccaugcacugaagaauggaauugaaauagagacuccagggucauagacucuuggaaggaagacuagaguacauucaugacccucacccuuaauuacuucacaggugagaaaaccaagagcuacagaaaauaaguuauuccucaguaccagggccugguuccuuggagaauuggguuaaaauucaaaauaaccuucuaaaaaauucuuucagaaacgaguagugaaagccaguggaucaaauucagugauaguuaacagagaaacagcagcauagauaaguaagccaauuuaauguagggagcaaccacuaguguacaugaucucagcucaucugguacuaccaaguaaaaaugaaccugggccagccacagugacucaugccuguacucucagcgcuuugggaggccaaggugggaggauuguuugaggccaggaauuugagaccauccuggucaacauagcaagacccuguuuguuuaaaaaaaaaaaauuaaaaaaauaaaaauuuagcugggcuucgugauaugugccuguagucccaaccuacuugggaggcugaggugggaggaucauuugagcccaggaguucaaggcugcagugaggcaugauugcaccacugcacugcagccuaggcaacugagugagacccugucucacaaaacuaauaaauaaguaaauaaauaaaacagaaccuguauuauaguguuauuuuagaaacaauuauaccauugagaugcaugaagagagcuaguaguuuugccuaucauacuuaagguuuaacuucuucagcuuaagagauauaugagagcagcuuuugagaggauuuaaaagaucccuaaaaaaagaaaauccaauggaaagguucaaaaacuugugucugaugaagagaaaauacagaaguuugauaagccuuuaaggauuguuuuguagaaguuggcuaguuguauacuuaucccuuuagaacuagacaggaaggggcaaauuuaccuuagccauggggaauauagauacgcauuguagauucuggguaugagcagcagcauugccaccugggaacuuguuaaaaaugcagaaucugggcucuggcccagaccuacugaauuugcauuuuaguaagauuucccaggugauucauaugaacauuaaaauuugagacauauugggauaaaucauaggcuuuauuuuuuauuuauuuauuuuuuuuuauauuuugagacagucuugcuguguugcccaggcuggagugcaguggugcaaucuuggcucacugcaaccucugccuccuggguucaagcaguucuccugccucagccucccauauauguuugcagccucccugaauuauaauuuaauuacagagucuaucuuaauuaaauaauaaagaucauucuuauuuuucaaaagcauuuaaaaaaaugggguucuuaucuagaugagagagguuuuacuccauaaggaucacagucuagugauccaauaagcaaacaaacguguacuaaaaccccagguggggauaaauacuuugaagaaaaauaagcuaagauuggagagucuuucaguuuaagaccuaauuuauucccuauguguuguguuuuuuguuuuguuuucuuuuuuucccaggauggaauuucacccuugucgcccaggcuggagugcaguggcaugauccucaccgcaaccuccgccucccugguucaagcaauucuccugccucagccucccgaguagcugggauuacaggcaugcgccaccacucccggcuaauuuuguauuuuuagcagagacgggguuucuccauguuggucagacugaucucgaacuccugaccugaggugauccgcccgccucggccucccaaagugcugagauuauaggcaugagccaccacgcccggccaguguguugugcuuuuuuuuuaguuuuuaaugguuaucacuuguagguagguuuuagagcagacuucaguuuuuuggguuuuuuugucccucuuuuuuuguuuucucguuuuuuagacuucaguuuucaggacaaaaauauguacagguuuuaaaauuauuauuauuauuaaaagaauuaccuuaacucagugccuggcacauaguuaacauuuaacugggaauguuucauaauaaaucucaaguaagaucuuaagaaaaucaacacugauuguuaccugucacaagucacgugggcugagauuucuggcuaggcaggaaagaaagaaaaguucagucuuuuguucucuuuuucauauuauuaugauuuuuggauucuguggauuccagaaucagaguuugaacagagaagugguuucuacacuuuguugcauaccagauggguaugguuuuggaauaaugaaggggcuuucagacuguggguucuugagugauuuaugacauuucucccgcuuuguaguuguuuuucuuggaacuugccuagaugggcaugccaugaacuugcaaacguuguucucauuuucaaauaaaauaauuuuguugcaauuuauuuuuaggauuaaaaaaaaaauccagaugcucacuuaaauacauaagaagacaaaccaggaucaaucuuaauaggagaaagguauacauguagaggggaauuaacuuuaugcuugcuaugcuagaaaugagcugguugaguugcacucagguaauaguaugguaagguauauuuuuuugguuaauuugaaaagaaaauguauauauguaugacugcuauauaugucagaaaaugugacaaauagcuuuuuuuuguuguugagauggagccucacuguguugcccaggcauggaguacaguggcacgaucucagcucacugcaacccuugccucccggguucaagcaauucuccugccucagccucccaaguagcugggcuuacagguguguggcaccacgccuggcuaauuuuuguauuuuuuaauagagaagagauuucaccauguuguccaggcuggucuugaacuccugaccucaagugauccaccugccuuggccucucagagugcugggauuacaggcguaagccagugcacccggccgcuuuuuuuguaaauggcuuuguugagauauaauucacauacccuaccuccauuuuuuuuuuuuuuugagacagaguuuggcucuuguugcccaggcuggagugcaauggcacaaucucggcucaccacaaccuccgccuccuggguucaagugauucuuaugccucagccuccugaguagcugggauuaccaggcaugugccaccaugcccggcuaauuuuguauuuuuaguagagaugggguuucuccauguuggucaggcuggucucgaacucccgaccucaggugaucuuccugccuuggccucucaaagugcugggauuacaggugugagucacugcaccuggcccuacccuacuucuuuaagguauacaauuuaauaguuuuuaguauguugacaagguuuuauaaccaucacugcacacagugcagugaauauuuauaucacuccgaaaagaaaccccauacccauuaacaauuacugucuauuuuuccuuuccccagucccuaaucuacuuuuuuauuuuucccuugagauggagucugacuuugucacccagauuggagugcagugguacagucacagcucaucgcagccucgaccaccugggcucaagcaauucucccacuacagccucccaaguagcuggaaccacuggcacaugccaccaugccugugaccaguuuuuaaauuauuuguagagaugaagucucacuuuguugcccaggcuggacucaaacuccugagcucaagcgauccuugugccuuggccucccaaaguguuggaauuacaggugugagccacugcaccuggccacguaaucuacuuucugucuauggauuugccuuuguguuuuuuauuggugauuggccuucaaguauaaugcugaagugcugucuccuguuuccaagagcuagaaagcuaugcuguacuuuagaggaaaauauauuaaauaagcuuuguucaggcuguuugacauguuaaugaauccucccgccuuggccucccaaagugcugggauuacaggcgugagccaccgcgccuggccuuacauauauuuuaaguaagguguuaacacuauauaauucaucuguguaacccaaaacuacuguaucccuaaggcuauugaaauuuaaaauaaguaaauaaauaaggugucuuucaucagaaacacauaaaaaagaagguguguacugaugaucuacugacaaaaaugugacuagaggcucacaggaaccuaaccguguguuuuccucuaggagcaaagguucaggauuugcuaguucaacguuuguagcaauaaaaauaaucuauuauaccacauuuuguuuauucauucaucaguugauggauuugugaccuguuuucacuuuuuggcuauuauaaauaaagccacuauaaacauuuguuuacugguuuuuauguggacacguuuucauuucucucacugcgcccagcaaugaauacauuuauuuuauggcaaaacuaaaaguuugucaaacacccaaauucaguaugauaaguuagcuuuuuauaggauacugacagguuauuguggguacuccaaucuuguucagcaaggccaaauuuucaaaaaaaaaaauguagauuuauuacaauaagggaaauauauaucuuaagcuauauuuccauguguucuaugaagacaacucugagaggaaguuagcaguuugugugguuggaagccucagaaaguucuccuacuucuaucucuuacucaccuggcuugcauugcaauauuuaggguaagagucacaagcauacucgggugcauuugaaugauggucuaagcagaucucuacaccugucguuaucuggguuugugaucauuccaguguuuccuaaguuuauaggaugaauuggcaguaagugacuuuuguuccaguccucagcugcauuauaaagacaauacaagacuaugcugaaauagcuauuugguaaaguuuuguaaacccagaagccuuuuuaaaaaguauuguucuucuuaaucucuuaauuauaguuuuuuaaaaucacauaucacuuaauuuuguguguguauuuuuguuuguuuguuuuuugagauggagucucacuacaucacccaggcuggagugcagugguguagucccggcucacugcaaccucugccucccagguucaagugauucuccugccucagccuccugaguagcugggauuacagggcugugccaccaggcccgacugauuuuuuuuuuuuuuuuuuuuuugagaugaauucuuguucugucgcccggguuggagugcaguggcgugaucuuggcccacugcaaccacugccuuccggguucaagcaguucuccugccucagccucccaaguagcugguaucacagaugcgugccacuacguccaacugauuuuuguauuuuuaguagagacaggguuucgccauguuggccaggcuggucucaaacuccugaccucagaugaucugcaugucucaggcucccaaaaugcugggauuaugggagugagccaccucacccagcccuaagucuuauuguuuuuucuuuucuuuucuuuuuuuuuuguuguauuuuuaguagagacagcguuuugccuuguuaaccaguuuagucucgaaugccugaccucaggugaucugccugucuuggccucccaaaaugcuaggauuagaggugucagccuccacucccagccugauuuguauauauuuuauguuuguuuuauuuucuuuuuuuucuuugcuguauuauuauuauuuugagauggagucuugcuguguugucaaggcuggucuccaacuucugggcucaagcagucuucccaccucagucagcugaacaguugggauugcaggcucaugccacuauaccuggcugaaguguugguuuuucuuuucuuuuuguagagacaaggccucacuccauuguccaggcuggucucaaacuccuggguucaagcaguccucccaccucagccuccccaguaacugggauuacaggcucuugccucuauaccuggcucaaggguuuguuuucugauucuucaaaguuuacuucucucagaucuggagacugugauauguauaagacaaguuucccaugucuuaagaaacuugauagcuaguaagagagguaaggccugugaacucagguaacuaagcaagacagaaagacagaugaagaugaggacauaugaguagaauaaaggaagugaucaguaaagguugcauguggaaaauguugucugaaucagucgaagaauugccuucaacaugaccuagagaagagcagaucaugaccgaaauccagaccuuuucacuggcuugauuguuuggugggcuauuuuucucucuuuuuugaaucagaggaucccagaugagggcuuuauuaucagccuuugacugaagucucaguuauauucuuguucccagcccaugcguguggaaucagggauaugacuuacaugcccuuuuaagcugcucuguaccuuuuugccaguuauauauacauguaacuauguuaaccugccuuaaauguccacucgugugugugugugugugugcgugugugguguagugacgggaucucaccauguuguccaggcuggucuugaacuccugggcucaagcaaucugcccacuuuggccuccaaaguguugggauuacaggcguaagccacugcacccggccuaaaaugucaacucuugguugagaaugaaggcuaauuugccuaagaaccaacuuaauccaucuguuccagccaguaccaaguuuugggcucgugaugccaccaauuggcuggugugaggaaguguuuaaccuuuuucuuuuccuuuugggaguuugcacuacgcguggaccaguuuguuuguuuuuuuuguuuguuuguuuuuuugagacggagucuuguucugucgcccaggcuggagugcaguggcgcaaucucaguucacugcaagcuccgccuaccggguuuacgccauucuccugccucagccucccgaguagcugggacuacaggugccugccaccaugcccggcuaauuuuuuguauuuuuaguagagaggggguuucacuguguuagccaggauggucuugaucuccugaccucgugauccgcccaccucggccucccaaagugcuaggauuacaggcgugagccaccgcgcccagugcaccaguuauuuuuaccuuacgacauuuucucacagauucauguucuccuuugguaaccuuccaucaagccucuuucaacucugguuuaacuagugcaggagcucuuuccaucccucuuuccuuuacuuuguucucuuuguaaguuacaaaagagacaagccaggcaugguggcucgcgccuguaaucccagcauuuugggaggccaaggcugaggcaggugaaucucuugagcccaggaguuugagaccagucugagcaacaaaaaaugcaaaacguuagcugggcauggugaugugccacaccucaggaggcugagaugggaggauugcuugagacccugucuuuaaaaaaacaaacaaaaaaaaacuaggcauaagauuacuucuagugucuuguaucaagaaagaagaaagcaguuauauauauauauauauauauauauauauauauauauauuucuuuuuuuuuuuuuaaugagauggaguuuugcucuuguuacacaggcuggagugcaguggugcaaucugggcacacuacaaccuccccuuccuggguucaauugauucuccugccucagccucccaaguagcugggauuauaggugugcgccaucacaccuggauaauuuuuuuguauuuuuaguggccacaguguugcaccauguuggccaggcuggucucaaaguccugcacuaaggugauccaccugccucggccuuccaaagugcugggauuacaggcaugagccaccucgccuggccuauuuuauuuuauuuuuuaauagagaucaggucucccuguguuguccaggcuggucucgaacuuuuggacucaggugauccuccugccauggccucugaaagugcugggauuacaggcaugagcuaucacacccagccucuuuguuucucuuuuguaucuuguucaaucucugaaucuccuuaaggcuggcuucaccucugguggcaaaaugacuaaagcuacauguccuuauaccucacugucauaaugagagcaugagaggcaaugcuuggcauuccacguaggaguccagcaaaauagccugauugaaccagcuuuuaggucugaugcccauuguuuguuuuuuuugaaacagagucucacuccguugcccaggcuggagugcaguggcacaaucuuggcucacugcaaccucugccucccggguucaugcaauucuccugcuucagccccccagguagcugggauuacagccaugcgcagccacaccagcuaauuuuuguauuuuuuguaaagacgggguuucacuauguuggccaggcuggucucggaucaccuuaagugauccgcccaccuccaccucccaaagugcugggauuacaggcgugagccacugcaccagcccacaugcccauucuugauccacuuguaggaagcacuauaaaagcacaugaacaaagugcggugcguguuccaugaaaauaaagauggcgccaggcgcgguggcucacaccuguaaucccagcacuuugggaggccgaggcgggcggaucauuugaggucaggaguuugagaucagcuucaccuacguagugaaaccccaucucuacuaaaauacaaaaauuagccgggugugguggcaggcgccuguaaucgcagcuccuguaauccaggccguggcaggagaauugcuugaaccuaggaggcggagguugcagugagccgagaucacgccauugcacuccaaccugggcaacagagcaagacuccgucucuaaauaaauaaacaaacaaacaaacaaggcuucuaguugcaguaggagggacgaauugagagcaaggguuuaaggacuaaaugcagggugcaguacagugucagugucagugugcagugcucaggaaauauuuguugaaggggaagaguaugcuucuucaguccaagguggaagcaugaaggaaacuguaagcacauugaucuagaccacaguuucagguacagaggggagcguuaacuaaagcucagagcggggaaagcacagggugcuuacaaaauggcaaaugcugucauuuaggccagaauccuacucacacugcugcuguauauccucuucaucuguguuuaggauuuugaaaugcauuuuuguuggauuauugccccacuagaaaaaacaguucagaucuguugcaguuucacauuugaaacuacuuucauucuggaauccuuauccuuagaccuuccuaauaauuucuguggucacacuggaccugaucucuuccugugcuaaacaaaagcacacaaucacaaaacuguguaggcauaaaugagaggcauaugggagugguguaaaaggaacuggaagagucuuaauaugccugggugggcgagcuaaacuaauagcucccagcaguuuuucugaaucagacauuguggagccaggagucuagcauuuggaauuccacugccugugcaaagggucugucuuuuauccuccaaaccaccauuuguuaacugguuaaugacccaguggacccguugacaacaaaggagggaaagcugguaaagaucaaguuaaaaggaaaaagaaaaguucaaagguaggaaaguaagaacaagaaggguuuaaucauaucuucaccuacucuuuauuuuuuaacaauuuauuguggggaauuuugaacauacacaaaguagauggaguaauguagugaccucccaugaaccuauccccucagccccaauaagcugcaguuaccagacuuaaugaaaggaaaccagaacucuggugaggcuuagguuugguuuccagaccucucuaggccuugucaccuuuggccuuaucccaucaaacaccucuuuuccccauuuuuagcuccuggugugcacagaacacugcguuuaggcuagugaugaguaugacaguacuuaaccucuaauagauuaaggaaauaacuguuauuguucaaguaugguuuugagagcagaaaaguguaauucugucaaagguacacaacgaagagggaacuuaggaaggcauuauugagaaguugacauuugaguuuacagcagaaacguugggcaagggguagggaaugaucucugagauagcagcauacccgaucuacuagcucuuuuucaccaggcuauuuagaguuugacauuuauguuacauuuauaacaagguacauuucaaguguagcuuuccuuuuugcuuuaagcaacugagacauguaagucaauuucaguuauuuucugcuaaacugugugucucuuugaauguucacuaucaaggugaauuauacaagguguguuagauccuuuuaacauuucagagcaaccaaaaccaaguuugaaugucucauuuaacacugugagaggauguaucuugucugcaucuuguguuucaguuguauuuaucgguaaaauaagccaggggaguauucugacuugcaguuuaaaagcugacaggccuaggggaauguuccacaaaauaguauauuuuguauauggcaugguauuauagauaaaugagcuauugugcugccuggcacugucuucucccuugugcugucuucugcuguuucucaaggagugauuccucucuguguuuuggaaccguguuucucacugccuacagaugauguccauuuggcuuauuucacugucaucucauacacagcuguuucaaacugcauggaauccucagagaacuacacgccccuuccugaacaaacagugcuucuuccugcauuuucuucuuaaacuuuuaucacuuuuccccccuuacauauacuuuuguuuuauucuuucacuaaaaaaaaaaugagguuuaauugacuuacaauaaacuacacauauguaaaguguacaguuugcucagguuuggcagguauaccugugaaaugaucacugcaaucaagauagucaacauaucauucacuccauaaaguauccuugugcccauugguaaucucucccucccaugcucccccugcccugucuccaagcaaacacuaaucugcuuucagucacuauagauuagugugcauuuuauagaauuuuauguauauauguuuuauauagaugaaaucauacaauaugcacuccuuuccuuccauccuuucuuccuuuuuaggucugguuucuuucauccagcauaauuauuuuaagauguauguaucaguaguuuauuccauuuuauuguugaguaguauucuguuguauggauauaucacauuuguuuauuugccuguggauagauguuugaguuguuuccagucuuuggcuauugcaaauaaagcuucuuugaacauucauauauaaauguuuauauggacauaugcuugcuuuugucuuuucuuuuuuaaaaaaaaaagcacagaugggaaccgggcgugguggcucaugccuguaaucccagcacuuugugaggcugaggugggcggaucaccugaauguuaggaguucaagaccagcuuggccaacauggugaaacuccgucucuacuaaaaauacagcaguuagccuugcaugguggugugugccuguaauuccagcuacucaggagggugaggcuggagaaccgcuugaacccuggaaguggagguugcauugagccgagguuucagugagccgagaucacgccagugcucuccagccugggugacagagcgagacuccaucucagaaacaacaacaacagcaacaacaaauagagaugggguucgagcccaggcuagucuugaacuccugggcucuagugauacuccugccuuggccucccagacaaaguguugggauuacagguguuaaaccacugugcccagacucuuuuuccuuuguaaauacauaggaauggugugguugcaucauauguuuuaacuauuuaagaaauugccaaacuuuuucuaaaauauuuucaaguacuuaccaucuauauaucuucuuuggugaaaugucuguuuaaaucuuuuacccauuuaaaaaaauuacauuguuuauuuucuugcuguugagguuuuuguuuguuuguuugagacagucucacucuguugcccaggcuggaguacaguugugcgaucccagcucgcugcagccuccaccuccuggguucaagugauccugaacuuccugaguagcugggacuacaggcacgcgccaccacgcccggcuaauuuuuguauuuuuaguagagacgagguuucaccauguuggccaggcuggucuugaacuccuggccucaagugauccguccaccucggccucccaaagugcugagauuauaggcaugauccauugcccccagccuguugagguuuuuuuuuaaaucagguauauaaucagguauaugcuuugcaaauauuuucucccagcguauuacuugucuauuuucuuaacaguuucuuucaaagaauagaguuaaaaagauuuuuuguaucuuuuuagcuuuuuuuuuuuuuuuuuuuuugagcagucagaacacacacagcauuuauuggaaguuuuccaucuuauaugggcacaguuuguggcuccccaaaacaauuagaauaguaauaucaaagaucacugaucacagaucaccauaacagauauaauaauaaugagaaacugugaaaugucgcaaaaauuaccaaaaugugauccagagacaggaagugagugcaugcuguuggacaaauggcacugauagauuugcuugacacaggguugccagaaaccuuccauuuguuaaaaaaugcaauauuugugaaguacaauaaagugaaacacaguaaaaugaggugugcugggcauccugccauuuaugcacaugccucuuuagguagaaaauaauccuguaaaaguugaggcugugguugccuuucugagaaucuugucuacagaaauggucaacugguggccagcuagccaaagggcuaaucuagcccacagacauguuuaguuggggcuacauagagcuuuuuacaaauuugagucaauauuuagaaaauaaaagucuggauuuugggauucccuuacaaaaacuggaaaauuuggccacacugggucauauucccacauagucguggugguugggguucaguagcaguagcugcugccccuuaagacagguccccaugguccccacucaguugcuuccuuauuuaucuuacaagccuggcaaggaauuugaguugaacugaucuagaagauuggugcuaagaaccagcucaguggcuuagcuguccuggggucugcaggagaaggcuucuuuguuaggcccaggcaggaagucugggcauggauugaguuuuauuuuuauuuuuuuauuuuuucuuuuuuuuuuugaccuuuuaaauauuuauuuauuuuauuuuauuuuauuuauuuauuuauuuuuaauugaucauucuuggguguuucucgcagagggggaguuggcagggucauaggacaauaguggagggaaggucagcagauaaacaagugaacaaaggucucugguuuuccuaggcagaggacccugcggccuuccgcaguguuugugucccuggguacuugagauuagggaguggugaugauucuuaacgagcaugcugccuucaagcaucuguuuaacgaagcacaucuugcaccgcccuuaauccauuuaagccugaguggacacagcacauguuucagagagcacaggguuggggguaaggucaccgaucaacaggaucccaaggcagaagaauuuuucuugguacagaacaaaaugaaaagucucacaugucuacuucuuucuacacagacacggcaaccauccgauuucccaaucuuuuccccaccuuuccccccuuucuauuccacaaaaccgccauugucaucccggcccauucucaaugagcuguuggguacaccucccagacggggugguggccgggcagaggggcuccucacaucccaguaggggcggccgggcagaggcgccccucaucucccagacggggcggcuggccgggcggggggcugaccccccccaccucccucccagacggggcggcuggccgggcagaggggcuccucacuucccaguaggggcggccgggcagaggcgccccucaccucccggacaggguggcuggccgggcggggggcugacccccccaccucccucccggacggggcggcuggccuggcgggggcugacccccaccucccucccggacgggguggcugcuggguggagacacuccucacuucccagacgggguggcugccgggcguaggggcuccucacuucucagacggggcggcugccgggcggaggggcuccucacuucucagacggggcgguugccaggcggagggucuccucacuucucagauggggcggccgggcagagacgcuccucaccucccagacggggucgcagccgggugcucucacaucccagacggggcggcggggcagaggcgcuccccacaucucaggcgaugggcggccgggcagagacgcuccuuacuuccuagaugggauggcggccgggaagaggcgcuccucacuuccuagaugggauggcggcugggcagagacgcuccucacuuccuagacgggauggcggccgggaagaggcgcuccucacuuccuagaugggauggcggccgggcagagacgcuccucacuuccuagacgggauggcggccgggaagaggcgcuccucacuuuccagacugggcagccaggcagaggggcuccucacgucccagacgaugggcggccaggcagagaugcuccucacuuccuagacggggugguggccgggcagaggcugcaaucucggcacuuugggaggccaaggcaggcggcugggagguggagguuguagcgagccgagaucacgccacugcauucagccugggcaccauugagcacugagugaaccagacuccgucugcaaucccggcaccucgcgaggccgaggcuggcggaucacucgcgguuaggagcuggagaccagcccggccaacacagcgaaaccccgucuccaccaaaaaaguaagaaaaccagucaggcguggcagcgcgcgccugcaaucgcaggcacucggcaggcugaggcaguagaaucaggcagggagguugcagugagccgagauggcagcaguacaguccagcuucggcugggcaucagagggagaccguggaaagagaggaagagggagaccgugggccguggugagagugagagggagagggagagcucuuuuuagcuuuuauagcuuuuguugugucuaaggaaucuuugccuaacccgaguucacaaagauuuucuuguauguuuuuuucuggaauuucuguaguuuuuagauuuacauguagaucuaauauuuuaauacaugguaugagauauuaaggauccaaguucaguuuuuugcauaugaauauccagcuguuuuaguaccaguuguugaaaggacuaucauuccucuaccggauuguccuuguaccuuugucaaaaaucaguuguuuauauaucugugggucuguuucuggacucuguuccauugauauguuuaccuuaucuuuaugccuguaccacacuguuuuacuauaacuugaagugaggcaguuuuaguccucuagcuauauucguuuucaaaguuguuuuagguaaucuagguucuuugcauuuccaaauaaauucuagaauuagcuucucaauuucuuaaaaaaaaaaaaaagcacguugggauuuugauugggacuacauugaaucuguuugggggaagagcugacgucuuaacaguuuaggagagauacaaauuaacaaauuaaauuagugauuuuauuuuaauuaauguuucucaguaguauuuuuguguuuuuccuguacagguuuuaugucuuuugucaaauuuuucucuuaauauuucacaauuuuugauacuguuuuaauuuuuucagaauuucaguauuuggucauugcuacucuauagacaugaaguugauuuuuguguauugaucuuguauccugcaacuuggcuaaauucacuuauuuuaauagcuuuuuggggagauuccauuggauuuucuuuuuucuuuuuccuuuuuuuuuugagauggaguccugcuuucucacccagacuggagugcaguggcccaaucucggcucacugcaaccucugcauccuggguucaagcaauucuacugccucagcuuccugaguagcugggauugcaguugccugccaccaggccuggcuaauuguauuuuuaguagagacaagguuuuaccauguugccuaggcuagucuugaacugaccucagguaauccacccaccucggccucccaaagugcugggauuacaggcaugagccaccgucccuggccuccguuggauuuucuguacaucauuugcaaauaaggacaauuuuacuucuuuccaauuaucacuuguuuuacuuauuuacuuauuaucaguauuuucuguguugucacugcuucagagauucuguccuuuucaauuuucuuuuguuaucuucuuggucuuagauauuaucauauuguuguuuguuuuuuuuuuuuaauuaguuaauggcuuucugugagguauucucucagucuauguugucuucagaaaacacugguuucauuuuguucagggccauaucauaauuccuagcuaccaauuacaugaaguuccaacuuauuuauuccuccacauugggaucaaauauuucuuccugucaauaauuggcauuucuguuuaccauugcaacuuauucuagccuaggucccacuuaaaauuauaguuggggagagagcaucagaguugagguucggaaauuugguuugaauucccauuuugcugcuuagugucuguauaaucuugggcaaguuuuuuaacuguuaggccuguuugcuuaucuguaggaagagaguaacacaagaacuuuacaauaugucaugugaauugaaagagagaacauagaaaucauagccaugugccugcaacacaguguggguagucuguaaauauuuagucuggcacuagugugagcaccaagugaaggaaugaaugcuuguuugcauauccuauuucugcacuguugcuuaugcuguucuccaaucucuuuucaggcccucugcaucuuccucauguuucgaggucaaugaagcccaucuuuauuacucauuuccuaucauuguuuacaucccuguugaguugauaucuuacuaaacuuagggacugggaguauaucuuuggaaaauauuuguuuuccucaaaaugccuaccauaaauguauuauaggucccuaaaauaauugguugauuguauaguuaauuuggaagcagugcaucaaaauacuuuguagggugacagcgaaguaagguuuuuuuuguuuuuuguguuuuuuuuuuuuuugguagaagacagucuuugucugucacucaggcuggagugcaauggcaugaucacagcuuacuucagccucaaacuccuaggcucaagcaauccucccaccucagcauccugaguagcugggacuauaggugcguaccaccaugccuggauaauuuuuuuuuuuaauuuuuauuuauuguagagaugcagucuugcuauauuggcugggcugguuucccaaaggccuccucaagugcugggauuauuggugugagccaccaugucuggccuguuuguuuuuuggucagauuuagguuuuaggagugaaguaaguugaauuuuacaugcuacaguggaaguggcagaaauguuuuuguuugauuaaaaguagcuuuaagagaacaguaauuaacuuuuuaauuuuggccaucaaacaaggaggguugcucauaaaacagaaugggaguuugguaacuauaaaccauuuauuaaauguuuuuuaaaaaucacauuguuucaacauugaaugugguagaauauucaguauuuccuuuagguuuacauguauagucuuaugucuuuuaacaacagaaauauguucugagaaaugcaucauuaggugauguacaaacauuauagaguguacuuacacaaaccuacauaauauagccuacuacacaccuaggauauauguaaaccuguaauaguagcuaacagcauguuacuguacugaaugcuguaggcaguuuuaacaaugguguuuguauaucuaaacauagaaacuguacagugaaaauauaguaaucuuaugguaccaccuuuauugacugaaacuucagcuaaaaaugauaaaccugauuaauaugcaaagcagcccuuauaacaugcuuuuucaaaaacagcuuaagacuuuucagauuucguuaagaaguuauaugguaacaugcugacuagagaaugauuuauugggcuaguuagcauuuuaaaguaaagggaauggaaaccagaagaugaugcaaggguacuuuuauucguuguguuaaaaagccauaguaaaagccguaguaaucauucuaaacuguuggaugcuuccuuagugcugcguauauaaaguauguuaauaaauuugauaucuaggguacuuguuagaacccuaacuggcauagccuauaacuccagaaucaccauucuaauuguauucuggaguugugcucuacaguggugcuauucacauagaauauaaugugaaagguaacccuagaguugugcaaguagaagguacuagcuuaaugaauuuggcucuaauaaguuaauaaaguaauuugaacauuccuugagagguaaaguuuaagaugcacugugggacgcuagaaaguaauuugcaggcagccaggaaaucugguuucuggaaccagucaacuggcaccucacuuuccccauaguaccauggaaacuuugauuagaugucucuuccauugcugauauuuugcauuuaggugauggauugaagucaggaacuagaucuagcauugagggcacugaaaggugguugucauguaguccagaggucaagggucaagugauuagaagcaguuuguucagaggucaagugauuagaagcagguuaagccaaaguuagacucaugauuuuagcagggaaugugaauggaaauccauauacccgcccaucuccauugguuggagaccagcgggucaucuuucuuaaauuguauauggguguauggaagggauuugaaauugacgagucguauaacugaguaaggacagagaagccggacucuauuuuuccauuaggucuagggcuuucuagugcuuaagaugaguucuugcuccugcucuguuacucaggcaguggcuugauugugguagacacuuaugaccuacacauuuuagccuaggcugaugccuuuccacaguuauguuccugguuuguuuguuuguuuuuaguucuuucucugucaguuacagguacauuuucccaaaucaucugaacucaaaauucuccuaacuuuuccaugaagccuuuauuguucuuugccuagcuggaagagacuuuuucuauaauuuuugguacuuuuuacuuguuacuuuuuauuauaucuuguguuaugcauacauuuauccccuacuauauuacugaaagcagggacuuugucuuagugcuacagguuuuuguuuuuguuuuuguuuaauuugagacagggucuuacucugucacccaggcuggagugcaguggcaucaucauagcucacugcagccuccaucuccuggacugaagugauccucccgccucagccucccaaagugcugggauuauaggcaugagccacuacaccuagcaguuuucucaaacuuuaguguauagaggagucaccugaagaacuuauuaaaguuuggauuccuggacccccuauucugauuacuugguucugauuuaggccugggaaccuacauuuuaacaaguuccucagaugagcuugaguaugugggcuagaggaacaugugguuuacagcaucuagccuaguaccucguuuugcucuucuauugccugagugguuaagucagugaucaguuaaaaccaauaaucauugguaacucugcuagaagaaccagucuuaacaccugugaggaacuagaucuauuuuguuccuggcuaccuaguauuuuacagguuuuuguguuuacaugaacuuuuuguacccucaguuuaagaugcccuuugauuuuaguuuuaaauuuuuuuuuauuauaauuuuuuucauuaagccucuuccauuuuaggaugauuuuaauuuuaaagcuucugaauacucucucaauuaucaauguauauauauuguggacauaugcauuugaguuuuguuguuguuuugccuuuaaacuuauaugucuuauuaaaauaaacucuacagaaauugcuauauucagucuuuguaggaacuaacagaagaagucuuucuuacuaagucuuuuuuugggggguucaggaacagggucuugcucugccauggaggcuggagugugguggcacgaucuugacucauugcaaccuccuccucccaggcucaagugguccucccaccucaaccucccgggaagcugggacuacaggcauaugcggccacaccugacuaauuuuauguaguuuugguagagacagggucuccccguguuguucaggcuggucuccuggacucaaacaaucugccugccuggccucccaaagugcuggaauuacaggcuugaaccaccaugcccggcuauuucuuacuaauacuuaauuuguauuaaguauuaguaagacaaauuuuuauuauuauuauuuuuugagacagagucuugcccugucgcccaggcuggagugcaguggcaugauauuggaucacugcaaucucugccucccagguucaagcaguucuccugccucagcccccugaguagcugggauuacaggcgcaugccaccaugcccggcuaacuuuuguguuuguaguagagcaggguuucaccauguuggucaggcuggucuuaacuccugaccuugugaucugucugccucggccucccaaagugcugggauuacaggcgugagccaccgugcccggcgaaaaauuauuauuuuauagugauacacuuuuguauuagauauuauagggaaaaccagaauaaguagauacuuaaagauuuucuggcgcaauggagugcugaagacaaacacguaaaauaguuaacauucaaggcaguucgcaacauaggaccaaaugaauggucugcaucaauaaaaguaaauaguuauuagaguucaaagaagugggggagaugaacacguacuagagaaccuggaaagccuccauggagaaggcaacaggagcugaacuugaagguguuuuagauuucagucagaggaaaagagcguucuuagagggaagaacauacaaagauucauuuuacaauuggaaaaaacggaagcucagaaagguaaagugagugugugcugaggugccagucuccugaccacugcucugcuuugugcagcauuuggagguuuuucauuguugccaaguagaagacaggcaacauuaugauaaccauauuucaaagcacugauaacuaaauuaaauuaaauuaauuaauuaauuuauuuauuuauucauuuugagguggagucucacuuugucucccaggcuagagugcaauccuguuuguucuaccuugagacuauauccagaauccagaauccaaguaacaucuuaccuuuaccccuuccauucuuguccauaccacuagcaucucuggccuggauuauuggaguugcuuccuaguuguuuucccuguuuccauucuugcccuaccaucuguuuugaacauagcagccagagugguucaauuuagucaggucaugucaauucucugcucagaacccuguuaaugacucccauuuuacugaaagagaccaaaguuuuuccaguggcuggaagcuaucugugaucugcuucccucucccugcccacugcuugaccucucagcucauauccuacuacuuuucagcuucagccacacuaacuucuugcaguuccuugaagacuguaggccuagucuugccucaggaccuuuaccuagacaauucuuuuuucaccuguccugcugcggcucauuucuucccuucucugcaaggucaaccaggcuaccuuauuuaaaacugugccccaucucacuuuaccagcuuauuaccuucugauauacuguauauaguauuuauuaauuuuguuuguucuuugucuccucuugcuaguuucagagaagacagggaaucuugucuauuugauuuauuuuuauuuuuauuuauuuguuuuuuauuuuuuugagauggagucucgcucugucacccaggcuggagcguaguggcgcgaucucggcucacuguaaccuccaccuccuggguucaagcaguucccugccccagccuccugaguagcugggauuacaggcaccugccgccacgccugucuaauuuuuguauuuuuaguagagaugggguuucaccauauugggcaggcuggucaugaacuccugaccucaugauccccccgccucagccucccaaaaugcuggaauuacaggcgugagccacugugcccggccuaugugguuuauugauguaucuccauugccucaaacauggucaggcaucugauagaugcacaauaaauauuuguugcaugcaugagugaauagaauagaacagaauagaauagaauagaauagaauagaauagaauagaauagaauagaauagaauagaauagaauagaacagaacagaaugcaagguagacaggcagucccaacucucaugaagcuuacaguuugugguuucuuuacuccaaaugacguuaaccauguuuuucacauuuuuugguauguguaauucaaaaccuuugugaaauaauaagcauuuaaacuuuaggaagcaguguuucuuaaaaagaaugugaucuugggguauguuuugaaucaacugaaaacuauaaaacauuaaauagaaaagcugugugccaggaaaggugauugcuugaucaguuuuugaaaaaugccacuagauaauuuuugaucuuaauucauuccuguggaacacuuaacuacaaaauuuccuugaaauaaaaugcaaguuauuagugggauuguuagugggauucccaaaugaaaugauuuuuagcucucauuaagacucuuucuuucucuuucuuucuuucuuucuuucuuucuuucuuucguucguuuguuuuccucuaggcuggagugcaauggcacgaucucgccucacugcaaccucugccuccggguucaaggauucuccugccucagccuccugaguagcugggauuacaggcacaugccgccaugccuggcuaauuuuuuguauuucacuagagaugggcuuccgccauguuggccaggcuggucuugaacuccugacgucagguuaucuguccccuguuggccucccaaaaugcugggauuacaggcgugagccaacauacucagacuuuuucuuaucuuuuugcagucuaccauagaaaaacacagaauuucauuucuguucauuuaaaauucugugguagaaaaucaaauauggaagacuuuugaacaaauauccaguguugaagcaaauguaaauaguagauauuauauugaugccaacugaggaaauaugauuagacuuagucaauaaaugaagcuguuaacauaaucugucaugugccaguuuaaauaaugaaagcauuacuguaguaggauguuuuguuaaauguccuacaaggccuguaucuuucugugcaagccuaccaugugguagacacuuaauaauaguugaugauaauaaugcugaauuaucugccucuuaaauuuguuuaucugagggaagaggugcuuauuuguauauaaacugcuaauuuaucuguuaguaacugacauuuuuucuuuacuuuuuccugaagauuugcaauuaauuuaauaauagaauaaacauuuuuguauuguuuuuauauaggauaaauaaugaagcuuauaaaaccaggccuuagcagccacacuguaaagacuaaagaaaaggacauuuucaguugguauaaauuuucuuuuuguuuauuugguguaaauuuugaauuucuucuuuuuuuuggucugaaaaauuaauuuagcucagcauggccuaucuggauauacuuuuuuuuuuuuuuuuucuuggagacacacucucucugucauccaggcuggaguguaguagcagccaggaucacggcucacugcaaccuuuaccugcucagcucuagcaauccuuccaccucagccucccaaguacucugcaggcauauguuccacaggcaccugccaccaugccuggcuaauuuuuuuuuuuuaauuuuuuguaguggauacaauuuuuauuuuuuguagagauuuauuuuuuguauuuuuuuauagaggucucccucuguuucccaggcuggucuugagcuccuggggucaagugauccaccugccucagcuuccuaaaguguugggauuacaggcgugagccacugugccuggccuggguguuuucuuuacaauugaguuuaccauuuguagcagcaaaagaaaagaaaaauaacuccacauuaccucucuguuuaguuucauuucggagccagaguuuguuaaaagugugaaauacugugccaggcucaguggcucaugccuguaaucccagcauuuugggaggccgaggcgggugaaucaucugaggucaggaguucgagaccagccugaccagcauggugaagccccaacucuacuaaaaauacaaaaauuagccaggcaugggguacacaucuguagucccagcuacucaggaggcugaggcaggagaauugcuugaacccaggaggcagagguugcagugagccgagauugugcaguugcacucuagccugggcaacagggcgagacuccgucucaaaaagaaaaaaauaaaaaagaccggaaauaaaaagucugcuugggaccaagcauggaagauuaugccuguaaucccagcuauaccuuugaagcugagucgggaggaugacuuggacccaggaguucaaggcugcaaugaacuaugauugggucacagcacuccagccuggguaacacaucucugagaaauaaaaaauuuaaaaauaaaaauauaauaaaauggccagugcuguugcucaugccuguaaucccagcacuuugggaggcuuaggcagguggauagcuugagucuaggaguuugagaccccaucucuacaaaaaacugcaaaaaauuaaccaggcauggugacaugcaccuguaguccugcuacucagaaggcugaggugggaggaucacuugaggugaggaggucaagacugcagugagcuaugauugcaccccugcacuccagcuugggcaacagagcgagacccugucucaaaaaaauguguguguguguguguguguguguguguguguguguguguguaaguaaaauuaaaagucugccuggcagaaaauuagguguauauuauaaaaaucuguauaggcacucccaguauuuugaaugaaggcaugucaacaaaacuagauguaaaaaccucucugugaagugaacauuauuucguuacuaauuuuuauuuauaaaaccagaaauacuuuacugagggguaaggcaguuacacuuguuuuuuguuuuguuuucuuuucuuuuuguggagaauggggucuugcuguauugcagguuuugaacuccugggcucaagcgauccuuccaccucugccuccuuaagugcugggauuacaggcaugagccacuggacgauaccuggccugagguguaggaagaagaaauaauuccaguauauaaaguuggaaauuauacaaagaaggcaggaucucuagauuauucugcuugucuuauaauugcugggccucuaauuaauuuuuagcauucaccuguagguuuccuuuuauuuugaguacugggaguuuuuauuuuuauuuuuuuuauuuuuuuuuugagauggagucuacucugucgcccaggcuggauugcagucacgcaaucggcucacugcaaccucugccucccagguucaagugauucuccucccucagccucccagguagcuaggauuacaggugcccaccaccgcaccuggcuaauuuuuguaauuuuaguagagaugggguuucaccauguuggccaggcuggucucgaacuccugaccucaggugaucugccugccuccgccucccaaagugcugggauuacaagcaugagccaccgugccuggccugauuucuuaauuaguuguguagucuuuggacuuaguuuccuguggguucagcaauaaguauaguuaucuuaauaaaacucauauuuuaggcuuuucaaccucagauuuucugcauauaucaaaauaaauucugggcuggguacaguggcucacaucuguaaucccagcacuuugggaggccaaaauggggagauugaggccaggaguugaagaccagugugggcaacauagugaaacccugugucuacccuucccccgaaaaaaagccagacaugguggcauucuucuggaguugccgcuacucaggaggcugaagcaggaagaucacuugagcccauaaguuugagguugcagugagcuaugauucccuccuuugcacuucagccccauccuggaugauagagcaagacccuguccaucuguccauccguccauccauccauccauccauccauccauccguauucauucauuguacuuaagaaugagcuauauaaaagugaaaccacgggaguucuagaagaacauauaggugcauauucuuauaaucugggacgaggaaaaucuaaacaugauauuaauauuaguugacaaacuacugaugagagcauaaugucagaauaaucgaaaaauuauuaaaaacuauuugguuagggcagaauuucuggaauguuggauuaaggugcuugggaaauccucccuccauaaagcagauaaaacuggacaaauuuauaaaaaaaaaaaaucaaccauuuugaacuuguguagauuguucccagcagcauuacuaaauagccaaaaauuggaaacaauccaaaugcccauuaacuggugaauagauaagcauaauguguauucaucaguagaauacuacucagcaguaaaaaggagugaaucuugauacaugguacagcaugaagcucagaaauauuuugcuaaauuaaagaagccacaaaagaugacauauccuuucauuuaugugaaauguccaggaauagcgaauuuauagggacagugaaagcaagauuaguagugguugucuagggcuguaaagggacaugagggaucuuuuaggggugaugaaaauguucuaaaauggaauugugaugaucguacaacuguaaauuuacuaaaaaucauugacuuguacacugaaaauaggcaaauuuuauggucuguauauuauaccucaauaaaacuuauuuaaaauguuggcaggggcagagggacaacagguuuuuuccccugcugcaaaggaguaguccaaguacagcacaugucugcagauggcauuuauguauaauagauggcugcugcuuuuuuuuuuuuuuuuuuuucucuaaaucagguguccugagagauugggaccaagagggagauagaacacuggcaguugggguucauguuaggguuucagacacaucaaagacagcauccuucuuuguuuuaaguuuauaaaauaggguucaauaaauaccugucuuauagaauuuggacaguuuuuuccacauaaagccuuccagaagauacuaagagcuauagauuuuaauaacuuaacaaauguaauaacguucuacauugucuuugcaaauagguguauaccccaaguaugaaugauaccuuauuuuggaugggacaggauggugaaaauggccacgauguuuggaaaaaccaguucaggggcaauaauuuuuaauacuuauuagcaaaguagucuugaaauuauuaauuuuuugucaaaauccucccauuaaaaaauucuugaagacagcauaauuugauuugaauacaucacauuuaauagaaauuuaauucacccuuucagacuuuaacuccccucccccuauuuuaauuaaauggagggauuggcuuggauucuuucuaagcuaaugcuuugugguuugauccuguuaaauuuauuuuuuaaacaaacagcauauuuuaauuuauuuacccaacaaauaagcauuaaacauguuaaucaagacacaccaccuguccucagagaacaguaauggguacauuuggucaacaaauaacucaaagucugaaguacuaaugugguuauuuauuuauuuauuuauuuauuuauguagagauggaguuucgcuguuuucgcccaggcuggagugaaguggugcgcuguuagcucgcugcaaccuccgcucccggguucaagcaauucuccugccucagcuucccuaguagcugggauuacagguucguaccaccacaccuggcuaauuuuuguauuuuuauuagagacgggguuucaccaccuugcccaggcuggucuccaacuccugaccucaggugauccguccccucucggcuucccaaagugcugggauuacaagcgugagccaccacgcuuggccuugauguggucuuaucugcugucaagcuacaugaguuggaagcuacaugaguugggguggagaguugucaaugcuguuucaggaaucauugcuccuaaaggggagccauaagucuuuaaguauggauaguuuuccaggugaagagcucauucgacggaaguguucauagugaaagaaggaaaucaguugguggucucauuugaguagaguaacuguauaucccuuacuuaaaauauacaauuaacuguugguuuauuccagcaagugaaauuuuugacuuccauuuauuuucugugcuuuuuuuuuuuuuugagauggaguuucgcuguugucgcccaggcuggagugcaauggcguaaucucggcucacugcaaccucagccuccuggguucaagugauucuccugccucagccucccaaguagcuggaauuacaggcaugcaccaccacgcccagcuaauuuuguauuuuuaguagagacgggguuucuccauguuagucaggcuggucucgaacucccgaccucaggugaucugccugccuuggccucccaaagugcugggauuacaggugugagccaccacacccagcucugugcuuuuguuccaucaauguuuuguuguuguugauugauucucucucugucacccagucuggagugcaguggugugaucucagcucauugcaaccuccacuuccuggguuaaagcaauucuugugccucagucucccaucguagcugggauuacaggcgugugucaccacgcccggcuaauuuuuguauuuuuaguagagacgggguuucaccauauuggccaggcuggucuugaacuccugaccucaagaaauccgcccaccuuggcuucccaaagugcugggauuacaggugugagucacuucuccuggccuguuccaucaacuuuuaaaaaucuucuaucacuauuaaguuuaauucuugauuuuuuuuuccuuuuucucuucuugcccucccugcccuuuuuuuuucugcuuacguaaaauucuugauuuuaaaugaugguccacagcugcuguagucugacuugugucccauaagggcugaugacucaaacaucagaauuguuguucaguuuuaauuuucaagaucacuuuugaguuugauugcuucccugguuuuuuuuuuuuuuuaaguugacaaaauuuuuuccaagcuuuguaaugcucagugugugaagcaaauacacaaccauuuaugaagucuuuaauaacuaauaaaacuggaaucuacacauugucauauaaauuggaaaauuagaauaucuuguuuguggagagcauuuucagguuauuugacuuaacaaugauguuaugagacuacauggaagaauaauuggaucuugagcuguuuaaacaugugcuaaauagaaagaaacaaagcuucagaggaccucaggugacaccugguccugucuucugauuuuugacagaugagaguuuuagggauuuagauaauuggcuuaguaauugaaucagugaaacagcuacuccaggcucuuucugcugaauuguaaggggaaaucagugucucuugaaauguuugcuguaaaaaaaaggaagacacuauuuucugaucaguuguacauuucaaauucuaaacauuuuuuugagcauuguuaaacacugucaagccguguggaugugaaggugaauaagacagaauagugaauaagauagccuuuguugucacaggaguuugcaagauuaucuaacauuuaggaagugagacaaaugggcuuaugcuguccccugcaccccagcaaaugugugaaauguccccuugcuugucacuccacuucaucguccuucugcacguuuaaugcuguccauacaugcugacuuccuccugcuucuuucugcuagucauaccuuuuaccaucucaggguuccuauauuauucuguucccucugccugaaauacuucugaauauucuucaucuccaccccaucccccuuuuuaaccugaucuacuucuccucugucaaauuucauuucaucagagauuaugucuauauagcacaccccuuaacucuagucccugcugugaagcucauaguucugguuuuuuucuuuauagcacuuaguauauauuauuauguuuguuuguaugauaauuacauuacuuuucucaauagacuguaagcucccugagagcagagacuauuuuucuuuacugugucuccugcacuuaguguaaccucaguagguguuugaguauuagaacuuuuuuuuguaaagcuacguuguugcuauaaaucagaguuuaguuuauguuuuuuguuuuagagggaguuucacucuguuacccaggcgggagugcaauggugcacagucuuggcucacugcagccuccaccucccggguucaagcaguucuccugucucagccucccgaguagcugggacuacaggugcacgccacuacgccuggcuaauuuuuuguguguauuuuuaguagagacaugguuucaccauauuggucaggcuggucucgaacuccugaccucaaguaaucuaccagccucagccucccaaagugcugggauuacaggcgugagccaccaugcccagccagaguuuaguuuuuuguaaagggucauauagugaccguuuuuggcuuugugggccacacgaucucugucccaacccugcuaaugcggcaggaaagcagccauagauagacaauauguaaaggaaugggcaugguccuuuuccagugaaacuuuguuuacuaaaacgcuaagcaggcuauaaguuugcugacuucuacuauaaaucaucauccccugaucuuguuggacuugaaagcccuuguuaugcaaucuugcaaauccccucuuaggguuuuuugaaaaaugauuuuauuuuuguaugguagauguuaaagaggugauuuuuaaaaagucugaucuuaaaguaauguaaaauacaaucuuaaauauauuaauuauauauuuuuaguuucuccaguuuacuaguaggcauaugcuuuuguuaacuuuacauuuguauuuaaguaaaacaugauucuugauauugauguuaaaauaaaaagauugguuugguuuugggauagauuaaaauguagauugaaauuuuacaaugcguuucauuuucaaaaaagacuauuuuugcaaccugaugcuugaaauaccauauaauauuauuuuguucuuaagugacagaugaagaaacauuccagguugcuguuugcagaacuucugugcaaguaaggaguuauuacaaugaaaagcaaauucacuauaagcaccaguguuuauuuuucuuacuuuuuucuuuuuuuuuuuuuuuuucagacaguguugcucugucacccaagcuggagugcagaggcaugaucucagcucacugcagccuucgccuccuggguucaagugauucuccugccucagucuccugagugggauuacaggcuugugccaccuggcccagcuagguuuuguauuuuuaguagagacgggguuucaccauguugaccaggcuguucucgaacuccugaccucaagugaucugcccaccucagccuccuaaauugcugggguuacaggggugagccacugcgcccggccuauuuuucuuuuuucuuuucuuuucuuuucuuuccuuuuccuuuuucuuuucuuuuuuuuuuuuuuuuuuuuuuugagauggaguuucgcuuuuguuguccagguuggagugcaguggagugaucucagccucccaaauugcugggguuacaggugugagccacugcgccuggcuguuuuucuuuuuuaacguuguuugaaagucuagaaucauuuuuaugugcuagaugagagauuugaucugauaaaucaaacucagaugucugcaucucaaguguauuuguagaauuauuuuucuguuuucuauuaauuuagauugaaugucagaguacccauuauagguauuaaaaugaauauuacauaagaaaaaauaacaacuuaaaaauguucagaauuguuuaaauaaaaacuuuagacagacauuuagcagaauuuaggugagcauuaaaggauucaggcagcauucaaaacuggaagaaguucagagagcucugcuuuagaagcaggcuuuuauaggcugaacgcuguagcaaaguaaaggaauuacuugauuggcuguagcuaggcacuugccuuauuuggauaugauccaguggaaagucccuaguuagagguuuguuuuugauugguuaagcuuaaguuucauuuuauguuuacauugggcuucaguuugcuuacuaggcacuggagccagcugucucagccuaauggcugcccaauuuaaaaaaaaaaaaacauuaaaauggcauguaguugucaucaucagaguaagaaaccaaagaagagaccgucaugaaugggaucauuagaucauggacugacacacauguucacuuaauacccacaagagugucuucacacuuuuuugucauggaugggacuuguuuucuguuuuuuguuuuguuuuguuuuugauacaguaaaauacuuaggaguucuugcaacuuucuauaaguuguuuacauuuuacuccaauugcuuuaucauuguguguauuuuggagguacaguuuuuuuccugaaccacucugaaaguggaaauaugcccuuuuaucccuaaauacuuaaaugcauauuuccugaaaucaaaggcauuuucuuacauaaccacacauaaccacaguacaauuaucaaaaucagaaaauguaauaaugauaccauacuauuaaccugauucacagacuauauucagguuuuauaaauuauuucaauaaugucuuuuauagcucuuauaccucaauccaauucagucugucaucacacacugaauuuaacuggcaugucucuuucuuccuugccuuuccccuuuccucuuuccuuuuuucuucuuucuuagagacagggucucauucuggugcccaggcuagggugcaguggugcaauaauggcucacugcagccuugaccuccuggacucaggcaaucccccaaccucagccuccugaauacuugggaauauaggcacaugccauuaugccuggcuaauuuuuuuuacuuuuuguagagauggagucucacuacguugcuccggcuggucucgaacuccuuaccuuaaguaagccaccuuccuuggccucccaaaguuuugggauuacaaaugugagccacugcggcucuuuaauuuuucuuauucuaaaacaguucuucagccugccugccuccucuucuccccuccugguacuuuucuuuucuugaccauuccaauuuugaauacagaccaguuguucuguacuuaguuuggguuucguugccguuaccuuaugauuacauuaauguuacgaauuucaggcuggaauacuauagaagggauguauucuccuuaaugccucauuuaaggaggcacauaaucagugugucucaauauuagugauugguuaaucauuguauuaaggucaugucugccagguuacuccacugcaaaaauuacuauccucuuugugauuaauaaguaauuuguuggguauauuuagagaugaugaaguuguccuguuuuucauuaguuuucuauucacuaguagucucagcaucuaguggugauuuucuuuuuucuaauuuuuaauuuuuuuuuguagagacaaggucucacuauguugcccaagcagauuuugaacuccuggccuaaagugauuguuccaccuugaccucccagagugcugacauuauaagcaugagcagcugcacccuacuagugguaauuuucuaauuccaucauuguuucugcauuuacauauuggcauucuaaugaaggaaugcuuuccuuucuuccuuguugauugguuaaaaaaauuaaauauggauuaugcucuaauccauuacuaucauuauuuauuuugaugcuuaaauuguugcacaauuccagugguagucccuucuaacuggcuuuaguguucuuuugacauaccccugucauuuuugagcagucucuuacuuucuugcccaagguguugcaugcuuaucuuuuuuuuuuuuuuuuuuuuuuuuuuuugagacagagccucacucuguugccccggcuggagugcaauggcauggucuuggcucacugcaaccuccgccuccuggguucaagggauucuucugccucagccucccaaguagcuuggauuacaggugccuaccaccacgccuggcuaauuuuuguauuuuuaguagagacggguuuucaccauguuggccaggcuggucucgaacugcugaccuugugauccgccugccuuggccucccaaagugcugggauuacaggcgugagccacugcgcccagcugugugcuuaucuuuuacuuucccugcccuaccagagaucagcuauuucuccaaggauccuugguuuuaguagaaaauguaguuuagaaaucaagaucuggguguucauuuauagaaggggucauugcuucuagaaccucucagcaaacagcuaggaaguguauguaugaaaguguguuugcguguguauuucuaugucuauauauuuuuugagagacagggucucacucugucacccagggugaagugcaguggugggaucauaguucacugcagccucaaacuccuggugucaagcaauacucccaccucagccucucagguagcuaggacugcgggcaugccccaacacgccuggcuaauuuuguaauuuuuuguagaaaugggaucuugguauguugcccaagcuggucucaaacuccuggccucaagugauccuuccaccuuggccucucaaaguguugggauuacaggcgugaaccacugugcccagccacauuuaggucuuuuauuucucucucuuuuuuuuuuuuucuguuuugagacaaaaaucuugcucugucgcccaagcuaaagugcaguggcgcgaucucggcucaccgcaaccuccgccuacuggguucaagugauucuucugccuaagccucccaaguagcugggauuucaggugccagccacuacgccuggcuaaauuuuuaguagagacgggguuucaccauguuggccaggcuggucuugaguucuugaccucgugauccacucgucucggccuuccaaagugcugggauuacaggugugagccacugcgccugggcgcgcucucucuuuuuuuuuuuuuuugagacucugucucacucucgcucaggcuggagugcaguggugcgaucauggcucacugcaaccuccgccucccaaauucaagcgauucuccugccucggccaccagaguagcugggauuacaggagugcgccaucuugcccagcuaauuuuugugguuuuaguagagaugaggcuucaccauguuggccaggcuggucucaaaacuccuggccucaagugagacaucuuccucaaucucccaaggcgcugggacuauaggugugagcugcugugccaggcccuuauuucucuuuuaauguauagguucugcuccuaacucccuccaucucccuuuuuuuccuuaagaaucuggauugcuuggacuauaaaguuuuccacauucucgacuuugcuaauugcaucaucaucuugccauuaacauguuccuguguccccucaauguuuuauaaauuugcucaaucguauuguuuuacuuuuuuuuuggguaaagcaugauucauuaggaggcauauuaauuuccaggugucucucguuuuauaauaguggcaauuggugaucauuagauucauuuuuucauuagggauuugcaaaaugaugauauuccagauauauuauuuugucauuuacuaguuggauuauuucaauagagaucaauuuuucgccaacuguuugggggggcggcgauucuugaaucuuuauuuuagauucggguacaugugcagcuuuguuacauggauguauugcauaguggugagguuugugcuccuaguuagccuaucaucgaaauaaugaacauugaacccaacacuuuucuccaacuauuuguuuaacuagauguacaguucauauaggaaagacagaugaaaugcuugauucaucagauuuuagaaugaguuugguucucuaguauucucugaaagauaaguaaucaauuaguuuuuuuaaauagguauuauuaugaacucaugauuuaaacauuuuauuguguuucaaucaauugcagcuucuuuuuuuccuuucuuuuuuuuuuuuuuuuuuuuucugagauggagugucacucugucacccaggcuggaguacaauggggcaaucuuggcuccaaccucugccuuccugguucaagcgauucuccugccucagacuccugaguagcuggaacuauaggcaugugccagcaugccuggcuaauuuuuguauuuuuaguagagagagaguuucacuaucuuggccaggcuggucuggaacuccugaccugaggcgaucugcccacuucagccucccaaggugcugggauuacaggugugauccaccacuccuggcccaauugugauuuuuguuguuguuguuguuguugagacagggucuuccucugucaccagccuggagugcaguggcaugaucuuggcucacuguaaccucugcauccuggguucaagccauucuccuggcucagccucccaaguagcuuggauuacaggcgcccaccaccacacccagcuaauuuuuguauuuuuuaguagaggcgggguuucaccguguuggcuaggauggucuugaucuccugaccuugugauccacccaccuuggccuccuaaagugcugggauuacaggcgugagccauugcgccuggccaauuguggucauuuuuuauugcuccucaaauuaccccaucuuuguuagugggagccucuucacauuaacucucucugaguccuugggacauaacuccagaagugauugauggccugauugcuuucuguuaugacaaguuuuguacauuuucugcccuauaccuggaguugacuauuuuccugaagagcucugcuuccuuuuauuggaaaaugcuauuuaggauccauaaucugagugcuagaagugaaagacccaccuuguuuuccuuuuuaaauaacaguauuuaucaccucacaugguuuguaugggucauaauucugaggugccuuaguucgaugguaguggcuuggugucugcugucaagauggcuuacuuacauuguaggcaauuugauaccggcuauuggcaagaugucucagucucuccccauguggaaggcucuuaggacugcuugagugucuucacaacaugguagcuggcuuccuugagaacaagugauccaagacagccagcagcaucuuuggauucauuuucuugucagcagugggguguagugcucuagcugugaauucagacaaccugaugcugacacuagcuauguggcauuaacuuguuugaacauuacuuuccuuagcuauaacuuugagacaauaauaccuaccuuauaggcccuuuaacauaggaccuuuguagcaaugcagggaacuagaauagucucugacacuuagugaguacacaugacaaacacugaaccugcugguguuacuauuauuaccaccaucacugguaugaaaugaagcccuaaaaccuaguaauuaaguugcccuugacagaaauagccuuccuuccuauuugucaaaaauugccaugacagaaauauuguuuacagauugcagauauaucccaaguaugguagaagguuaaggguuagagaauuauaaccacaccuguuugacuauauauauauauaugcaggggaucuuucaugccgaaucuguauucauguagauuuuaguauaggauaugugucauguaaugugacccaggaagaagccaagacccccgccuuccccuggccaucuuuuuuugcuuuugcuuuugcuuuuuuuuugagacggagucucgcucugucaccaggcuggagugcaguggcaugaucucagcucacugcaaccuccaccucccggguucaagcaauucuccugccucagccucccgaguagcugggauuacaggugcguaccaacacgcccagcuaauuuuuguguuuuuaguagagacaggguuucaccauguuggccaggauggucuugaucucuugagcuugugauccgcuugccucggccuccaaaagugcugggauuacuggugugagccacagugccuggccuuucuuuuucuuuucuuuuuuaaagauggggucucacuguguugcccaggcugaucucaaacgccugagcucaagcgaccugaccaccuuggccucccaaaauugcccaggcugaucucaaacgccugagcucaagcgaccugaccaccuuggccucccaaaguguugggauuacaggugugagucacugcaccuggcuaccaccacccacaaucuuuuaacuuuuuauuuuaaaauguagauucacaggaaguuauaaugaaaaauguacagggagguccguuggacccuucacucaauuugccccagugguaccauuuuguguaacuauaguaugguaucaguugucaaccuucgauuuuuauuuagcagaaauugacugagcagcuauuauaugcuagcucuuugagguauaaaggauuaaacucugaccuuauggguuucugucaucucucuggauuuucauuguuauuguucuuaaaauauuuuuuauuuuggcgacucauuguugacacuuauauuagcaguuauuuuaauguuaaauauuauguuauuucugacauuuauauuugcucuguuuuaaaacaauuuugcauuguguccccaucuuccauuuauaaucuuuacagcaucagaaccauguugccugcauugucuuauuuuaaucacgugccaguuuugcagugcuaccaagucuggaucugagaggcagcuugugugaaucauuuacauacauuucuguuuauauuccccaaauuaauuugcaacuuuauauuuuucauccaauuauauguucaaaacauauuuuuaauaauugauuuuaagaaggaauuuguuauauuaggauuuaaaaacuggcucaaaaaacagaagcuauuaaacaauagcagaaaccagacaguauauaggacuuuaaaugguaauugcuaaacauuugaauguucccaaaaaugugagucugugugucucugugugucucuacguguuauuccacuagggauuugcacagauagguuuugcacaauauccuugcuguuauugucagccauaaacaaauuacacguauuuaacaaguuaaugucagauuggccaggagccacugggagguguguacuuagugacaucagcuggcaaagagcccugguaacagggaggguuggaaggguaguggagagagaggaagcaggagggagggagaaaaagagagagacugacuguaucuggggauucuggcaaggugaagagcuggucuguuuggcaggaccuucccaucugggauccaucuguguuucccuggaaugggacaggcagcucuagucagugagaaaucgcagaugugagagagcugacacauguccagcuaaugaaaggaggaggaaggcuggucuccgauugagcuuugaagauuaggaggagaaaaagaggagcuuuggaauaucuauuucaaauaaauuugguguauuuaagaaucuggauuguuuauaauuugggcauuugggguaaguacauuuuaauauaguuuuggggguuaaagugcacaauucucugccuuucaaagcuuuuuacuucuuucaaauuacgaugauaugaauguuucuugguauuugauacaagaguucagccuuucuacucaguuuuauuuuaaugcuucauuuuauuuauguuucuauuuuucuguugccaaccuuauauuugaaugucaugcuuuuuugaaugcaagguuuacuuaauaauuagauguaguauaugaauucuacagcuagaaaaguagucccacaaauauuucuguaagguuuuccacguuggauuguucugugauguuuagagggaauuuuuuuccccuuuaguaugcauaauacaaauaggccauauuaaaaagauggcucauaaaacgcucuuuucuauugucagauuuuauuucaguauaugcaggcaaauuauaacuaaaagagguugaagcaaaacuaacagcaucucuucguuuuagauauaucuaacaguuuuucauuuacauuuugcuccuaugcuguuuucuucuguuuucuugcuacauauaaaauaaauaacaucaaugaaucugacuugaauugugaguuugggguaguuuugugaugcaauaaauucaugugcauauaacuacguacuguguucuguaguccugguuaguuugugaugccuauuuuagauuuuugcuauuucuuauauauaagaaauagagaugggucucacuguguugcccagacuagucucuuaaacuucuaggcucaagugauccuucugccucagcuucccaaaguguugggauugcaggcaugagccacugcaccuggccacuuuuuacuguuuccauacauuguauucauguuuuugaggccuucgaaucuaggcuuccuuuccauguucuauggaaagaacaugaguuugggaguuacacaaacuguguacccauuauuuacuaguucuguaaucucaagcaagccacuguucucuuugaaucucuauuuuguguaauuccugacugauguuguuauuggggaaauuugucuggcacauagaaagcauacaaguugguuucaagaguucuagauguucacuuuuuuugcugcgauagauuccuaaaccccuugcauuuuuaacuucagcuccugggcaagaaugggucuggccuguaguucuaguuuucagggcgcccuuccucuugcuguacucgucucagauugucugcaucuauucuaaauguucuaugcuauauuugccaaacuauaccagaacagaagaacuuugaaaaagucaacaagcaggagugagguacugaauuguacugcuuugugacgacacuguugaaauuguuccccccacuccgcgaccucccgcuggaaaauuguuuuucccccguguauuacaagucacgcaaaaauucuaccauuucucaaauagaaacuuuaaaaaauauuuuuauuccuuaaaguucuucagccuuuauuuauauuaauuggguaauuaaguggacaguauaguacucuucaauuucuuccuucaauuuuauagucagauuucuugagguggaggggacuuuuuucuuuuucuuucuuuuuuuuuuuuuuccgagauggagucucacucugucgcgcagguggagugcaguggcgcggucucggcucacugcaaccuccaccucccggguucaagcuauucugccucagccucccaaguagcugggaguauaggcgugccaccaugccuggcuaauuuuuguauuuuuaguagagacggguuuuaccauguuggucaggcuggucuugaacuccugaacuugugauccgccugccucagccucccaaagugcugggauuaaaggagugagccaccgcgccuggcccucuuuuuuucuuuucucuuuucuuuucuuucuuuuuuuugggacauggucucaaacucuguugaucaggcuagcaugcagaagcaugaucauggcucacuacagccuucacucuuccggacuucagugauccucccacccuggccuccugaguagcugggaccacaggcacgcaccaccacgcccagcuaauuuugguaguuuuuauacaggugggguuuugccauguugcccaggcuugucucaaacuccugaccucaagcaauagagccaccucgaccucccaaaguggugggauugcaggcaugagccaccacgcugacuugaaggagacuuuuaaaauggaacuuuucccaaguuuucuuuucuuuucuuuucuuuuugagacggagucucgcucugucacccaggcuggagugcagcggcgcgaucucgacugacugcaagcuccaccuccccgguucaugcuauucuccugccucagccuccagaguagcugggacuacaggcacccgccaccacacccggcuaauuuuuuguauuuuuaguagagacgguguuucaccguguuagccaggauggucucgaucuccugaccucaugaucugcccgccuuggccucccaaagugcugggauuguaggugugagccacugcgcccggcuccaaguuuucuuuuauaccaaauugacuaaaaugauuuuguaaaaauuugggggcaucucuuuugauaggugcauuguucaacaagcaucuuugggacuuuucugaauacuugagaggauauaguguuuauacugaauucacaugguacuccuucagugagaaaacacuuuccauuguagccuaggagacaugaguggggagaaaaggacuuaaugcuuuucuguaggauagggccuacuauagagggccugaaaaggggauuucauaugacuauguccaugcuaggaauacuuuggaugcuagaguuucaggaaacauaauaaauaagaaaaaauaugcauuuuaggaugugaagauucacucacuguaaauaaaguugggugauuaaaagucuugcuaggaccagacauuucaggagaguauugcuugcuacugagguuauaaccaagauacauuugaguugaauacuggagaaaaucaugauucuuucugaagauuauggaagcaucaugagaaucuuacuacuaggaggaaauucuccuaaauuggcuuccaguaaugacccaagcauauuuucauagcgaggguccuuguuggacuggaggcacauaaugcaauaaugccaauaaacuggagaugaggauaaugacauuuaaguggcuuugcgggaacaucaaaaaauacauuugagugaacgaauguauuuaauacacaacuggaaaaauucaguuggauccgaaagauugguugggucaguucauugaugguuauucuaaggcuacucagugcucauaaguucccagagaugaccuauggacaauauuaggguuggaaaggauccuuuggauaaucuagucaaacacauuauuuuauagauaaaauaggaaaguugagggaaagauaaugggauggcaaauagucuccccagcccagaguucaauauccuccugguugcuggcugagcuuagacuagaauuauguugaguuuccaggacacccauuuuacgaauguuauuuugaauugccuguuguaugugauaauaugguaagggauuuuuuuuaaaaggugaaaucucauagaggagauaaaguguacaaaaaguggcugggcgccaguagcucacaccuguaaucccagcacuuugggagaccgaagugagcggauuacuugaagucaggaguucgagacaagccuggccaacguggcgaaaccccaucucuacuaaaaauacaaaaauuagccgggcguggugacaugugccuguaaucccagcuacucaggaggcugaggcaggagaaucaauugaaccugggaggcggaaguugcagggagcugagaucaugccacuguacuccagcuugggcaacagagcaagacucagucucaaaaaaaaaaaaaguacaaaaguaguaaguccugaaaauuagcaccaacuguaggaaucagagaaccuuccuaaaggaggucgcguuugaucagaauuuagaaggacaggaaggauuuggacuucucauguuuggaaggagcauaguggcaggauggaaagguucccuuucuucuagagccuuaaauuaaacuuuauuaaaugcauaauuacauaguauucauuucuaccauguuuugaaguaugucuagcuguugcugucuuuccaaauccaagaucaguuguuuacuucugagauacuuaccuuuaugcaugcauagccgucuuuuauaugugugauuuauauaccaggaagcugugauuuaaaagauugcuaccaugauggacucuguggauuguuuaauuuucccuccaaguucaagucaguaaauaaaggaauuaguggugguuguaucuugcagaaaaacaacauauuauaacugguguuuguauuuucacuggcugauggacuuuccaaacagcauuugacuuuugagaacuauaugaugacacagauugauacuggggaauuuaaaaugcauauggauuuaauuuuccuaaagcaugccaaaaccugaaaaagcaacucuuuguguuuuguuuaaagcaacagcucguggaaauccuguuaucguucaauccucagcaguuuguuauagaugccuggcaaggugggaugcaguucuguauauguauacauauuaucugcaguugucucucguagcuggagcucugcaguaaauggaguguguacaguagucuccccuuagucgaaguuucgcuuuccaggguuucaguuaccugugguacaguacgcuaagacauucugagagagagaccacauucacauaacuuuuauuacaguauauuguuauaauuguuauaauguuuuauucuuguuaaucucuuacugugccuacuuuguaaauuaaacuuuuuuuuuuuuuuuuuaauuugagacggagcuucacucuuguugcccaggcuggagugcaguggcgugaucucggcucacugcaaccuccgccucucagguucaagcaauucuccugucucagccucccaaguagcugggauuacaggcaugugccaccacgcccaguuaauuuuuuguauuuuuaguagagaugggguuucaccauguuggccaggcagguuucgaacgccugaccucaggugaucuacccgcuucggccucccaaagugcugggauuacaggcaugagccaccacgcccagccuguaaauuaaacuuuaucguagguauguauguauaggagaaaacauaguauauauaggguuugguacugucugggguuucaggcauccgcugggggucuuggaacgcaucuccuucagacaaggcggggacuauuguauuuucauuugauugugguaguuuggacagauggagagaagacggugaaagauuguguguggguuuugacauuaggcuguguaaccauaagcugauuuaaccuucaccucuaagccucaguuuucucagcuguaaaaugggaauaaaaaugaguucuaaggauuuaauuagaaagaaauuagcaugauacuuccugcaucagcacucaauaagauuucucuuuccaugugauuuuucccagucccccaaaaacauugaagucacaauaacuaaaagauuuacuuaaaaugggagucuuggauauuuuuacugucucacuugagacugacagggaacccaguucccuaacuaauucuaagucaugggagaagggugcguguagagaaugcuguagagaaugcggcagucuuuaaaaacucaaaccuguugcuguguggcaagcuguuaacauuuagggaccuugcaccacuuacucugcuggaagagcugggggaugggcugcuuugagggugacagauguguccucugcugccggcgggcgcgugccugcucugucccucugcucccagcaccaggugcagccauuguucuggcuggucucucuucauccggccucgucuguuacucugcucuuucuagcucauuguuucuguaggaaauuagcauuaaaaacccaucugaaacccccaugucccucaacugcaggugacuguuauuggccccagcugccacccuugcgcuugauuacuuccauaugggucuaugcaaagaaguaguagccauuuauugauuuccaccacaaccccaaccucuauuacucaaacuauaauacccugaaaucuauuagacccccaguaggcuguauagcucaguuggcgcuacaacugugaugaacauuuuacaagcaaaacuaauuacacccuuuuccccacccccaucaccuccucccuaaauauuaaauguagaaacaccagagugucauaaguggaauaguaaaucuuuuaaaugucuggaaaugaaucuguuucugaguaguaaagcuuuuagacuuuggaugggauuuuauggaaaauuuuagucacugcuuuaauauuucaugccacacccauaauauucaagcaaaucguggcccagugccccuaggguggggguagggcacacaaaaauuuucaucacuugcuuuuugguuuguuaaauuuaauccagugggcaguauguuaggaaaggggccuaguuuaaaaggauaauauguuuugugggagaaaacaacaugcagucauuguuaaaugcuuuaauuuugcauuauuuuguuguuuguucucuguguuuacacaaauaauuguucuaguuuacucauuagaauaaauaccacaaugagaaggucgauguuuuagacuucuuucuuccuucaucaguaaacaaacuuaaguguuccacuuugguuauuguucuaaaucaagauuguaaucucaaacagguaauaaguucucagcuucaaacucuagauagaauuucaaggacaauccaaaguuguuauugacuccugaugaauuguauugugaccuugacaaagucacugcccugucagugaaggguauucugguagccuuuacaagucaauagcccaggaaaucaagggggaggucauugacuuuugccuguugagaguuuagcaguguaacccaguuuuaaaguaaaaucuugaguuuacagcauuuuaaauuaaauuauuuaauaauuuggaaaauuuaaaguaacaauuucaauguuuuaagcuuagcugcauagagcuuuuaucauaaggaacauagggccauuucuguuggaagaaaugucuuuuuggcuuucuuucuuuauauucuauuuauuuuggaguuuaaaaagguacuaaagccaggcccuauggugugugccucuugucucagguacucagaagccugaggcaagaggauuacuugagcccagucauucaagacaagccugggcaacauggccagaccuguaaucccagcaguuugggaggccaaggcgggcgaucaccugaagucaggaguuggagacuagccuauccaaaauggugaagccccaucuuuacuaaaaauacaaagaaacuagccaggugugguggcacaugccuguaaucccagcuacuggggaggcugaggcaggagaaucacuugaacccaggaggcagaguuugcagggagccgagaucaugccacugcacuccagccugggugacaagagcgagacuccaucucaaaaacaaacaaacaaaaaaagauacuagaauuugaaaagccccuggcagccaacauuuuacgugacagcuccuaugaaggcaagccucuagguagagcaaugugauuauauuuagaauagguuaggaguuguaguauuugaagaguuuuuuucagagcuuuuuaaucugcuccuucguuuuaagcaguggagaaauugaaagguagggaagucaguaaaggggaagaguugagauuugaaacagagccuucucugacuccaaauuaaguguacuuugauuugaaguuuggagcuaguacauguugggaauguugaucaguauugcuauagauauugucgucuugaggugaguacaugugcuguuaacccuucuuucugguacuuaggaagaauggggguuuccuucuguggccuuacugauucuuucauucugucauuguacauacugagaaacaaaguuaaauaguaaaaggaguuugcagucuaaugugagacucauuuucuuuucaucuguuuuaauuuuauuaaguuguccucucucauuccuagggcuaaugccacaaugaaacuggaaauaaguuuucuugcacugugaaugugaacugagguuuccacaagcaaacugugcuucugucuccccaaguagagaagcauggcaaauaaccacaagugcuuugucggggccccaggcuucucacuuaccuuuccccaguccuggcucuguucuucaugucuaaaguaagggaggacaacagacuuggugugugugugacugaccuucuagaaauguuaacuuccaucuuuaucuuggagaaugaauugaaguguuucccugccuuuccauccaagggaaccaucucuaacaacaaaucuuuuuaagugggucuggaggggggacagagaauuggugauuugucuugguaauuauguuguuuuuuggagucaguuucaaacacuucaguaaaaauguuuaaggcucuucaacuuuuuugguuuguuucauuuuaauguacuacuuuauucuauuuucucacauuuuguacgcacaaaucaauagauacucuuaauugaauaagugaaaauagugggugaguuuaaagauagauguuucguuuuccuuauuuugaugauuacuuuuaaaauuuuaauguguacuugacauaaaaucuaaugucaauucauauauccauuuuuuucuuuaaguacagaagucuuagaacacuucaaauucaguaacuuuuucaauauauuaccgcugucuaggauuuuguuuccauuuuguuuguuacacucccagccaaaauaauaguuaccauuauuuuuaaagcuauuaauuucgauuuaccaauauauuuauugaauuaucuggucacuuugcauauuuaucacaauuuuccuucuagguuaauaauucauuccugccaaguguaucuguuaauaauucuuggagaaucuguaaguaguacacucuuuuugcugaucugaagauaucuuuauuucaccuuuacuugaaugauaguuaaaugugguuagaguguaaagguugacaguuauuuuccauuagcacuugggaguggugauuucuuuucuuguguuuuguuuguuuguuugguuuguuugguuuuugagauggagucucgcucugucgcccaggcuggagugcaguggcacaaucccggcucaccauaaccuccgccucccagguucaaacgauucugcugccucagccuccagaguagcugggacuacaggcgccugccaccacgggccuggcuaauuuuugcauuguuacuagagacgggguuuugccauguuggccaggcuggucuugaacuccugacuucaggugaucugccaaccuuguuuauaugaggaagucccucauaaauuuuagaauaauaucuguaaagauggugguaggguauuaauguuaauaauuuugguaauuauacugggcuuauaaguaaacauccuaacucuuagcauuuacacacugaaauauuuaagcauaagggaguguaauguuuccagcuugcucucaagugguuuagauaaaaauauagguagauagagaaaaagaaagugauuuuuauaaauggaugaauuaauuggugaauuuagcuaaaugauauuaacagaauuauuugaauagucuugcaaauaaaaauguuucuaaauuugaauaaaagaaaguacugagcccauuaacaaaaaaauauguauaugaaauuaaguguuaauuuaggacucucugaagaaguaaauugagcugugugcugaauaacaauaaugaaauagucgguggaugucagugauaagaauauuccagugcaaaggcucaaugaugggaaugaacucaguauguucaaagaauagaaaaauggccgauguagauauaauguaguggacgaagagaagaggguagagagacaggagacagaaguucauguagagcuuuuaaagccagcauaaagcuuuguaauccaaugaauuuggauuucauucugagugauggguaaccauugaauaguuggggcaguaaugugaucugauuuauauuguauaaagaucauucuuccugucauauagagaaagaauuuuauagggcauggcuggaagcagcaagaccagaagugaaaagugacaaguuuggcccagcuuuauggcagugaauauaguagaggacagaugauuuguuauauuuuagaggaaguuaaguuuucugaacuuguugauagauugaauguugagagggagagggguguuuucaaauaauugucaaaucugucuuccuuauuauucauccauucauuugaauauuuaggugccuacugugugcuaggcauuauucuagguauuggaguuacaucaaugaguaaagcaaagccccugcccucauggagauuaaauucuaguagaagagacaggcaguaaagaugauuaauaaguaauauauauguagccuaaaauguauguuuauguauauuuaggauguuuuuuaauguuacaaaaaaugaaagcgcuaaggagaaagggaaaggguuuaaggagauccagguuaguuugaggaggguagucaaggaggauccucacugaaaggugauuauuuuaagaaugcaaagagaugauggauguaaguguucaguacuguaugugacacauuguuucucaguuuuugaguacuacuucuucuucuucuucuuuuuuuuuuucuuuugagauggagucucgcucuaucgcccaggcugaagugcaguggcgugaucuuagcucacugcaaccucugccuccuggguucaagcaauucuacugccucagccucccaaguggcugggacuacaggcgugcacuaccaugccuggcuaauuuuuauauuuuuaauagagauaggguuuuaccauauuugccaggcuggccucgaacuccugaccucgugauccgcccaccucagccucccaaagugcuaggauuacaggcuugagccaccacacccggcccuauuauuauuauuauuuugacacagggucuuaacucuucacccaggcuggagugcaguggugccaucauggcucacugcagccuugacuucaugggcucagguaguugucccaccucagccucccgaauagcuaggacuagaggcauuugccaccauaccuggcuaauuuuucuuauuuuuuuuuuuuuguagaggugggguuuugccauguugcccaggugggucucaaacuccugggcuaaagcgaucuucccauguuggcugcccaaagugcugggauuacaggcaagagccaccauaccaguuccugucuagauauuaugaugaagauugaggaugguaguuuuuguggagcacaauccugacuguaccugugauguugcauucaucuuuuggaacauaagcagaucaccaggugaauggcuaaagaaucuggaauaagcuugaaagaaauacagguccuggcaaggcaauggaaagguaugugugaaacauucauuucuaauagaggacuaauuuaauaacagaaauauacucuucccuagaaacaauuugcuuuaaaggccaggcaugguggcucacgccuguaaucccagcacuuugggaggccaaggcggguggaucaccugagguugggaguuccagaccagccugaccaacauggagaaaccccgucucuacuaaaaauacagaauuagccaggcgugguggcacaugccuguaaucccagcuacucggguggcugaggcaggagaauggcuugaacccgggaggcagagguugcagugagccgagauugugccauugcacuccagccugggaaacgagugaaacuccaucucaaaaaaacaaacaaacaaaaacucuuauaaaaaguuguuuucuuuuuaagcagggaagccugacuucauuggcauuuugagauggaggcuucugggcaaaagaagaauuucauggggguauuuugagaugaguaugaucaaucuagucaagagauggggaaggucuaagcuuugucucuuguagguggaauggagaagggcaaaggguuugaauuuugguuguguggugugaagaaugauuggucuuaaaacagauuuaaaaugaaaagauuaaacugaucaauguuuuuuaugcuuuuaaaaaauguggcugauaaagcguuuuugugcuuuuaaagggagccuggaugaauaggcuuugguacuguauguauuguauuaaacauuuggaguggcaaaauaauuucuaaaauauuucuagcaacuucauuuucauuuuaucugcaggaugaaaaaguaaauuuggggauuguugauuaaauuagcaaaccauaugguuguuugcgcagacugacugcuaugcgagguagcuguguuauuuuucuuucaggauaugcuguuguaucugaugccaguguucugaaacacuuauuuucuagucaacaguaggugaagcaauuauuucuagucauuaugguuuuucuugaugccuuaauuaaugucacaauuugugaaugcuuuacccugcuguuuaaaauuaguuuaauauuuuaaaagauuaaaucuucacauuuauguaaugcuucccaaccucuuuucacaucauagcauacauagaaaguauuaaguucugauuggcugucccaggcugaggaaaucauuaucucaguaaacugauaaucauucuucauaacucucuggcguuggucccuggcacacagcuugggaaguucugucuuaauagaaaagauauagaaaccuuucuguacuguauugcaguuaguuaagaggaauuaggaaagaguuauagagucuuucuuaauaggguuuuuuuuuuccuuuuucgcuagaagccuaaaucucaccaaauuaucggguguuauacuaggaacuaugguuauaagagugaagagcucaaggaacucacagacagacaggcacagaaacaaaucaccuguggcacaauaugacaaaugacaucacagagguguuuauuuuuauuuuuauuuuuugagacagagucucagucugucgcccaggcuggagugcaguggcgcgaucucagcucacugcaagcuccaccucccggguucacaccacucuccugccucagccucccgaguagcugggacuacaggcgccagccaccacgccuggcuaauuuuuuuuuuuuuaauguauuuuuaguagagacgggguuucaccauguuagccaggauggccucgaucuccugaucucgugauccgcccaccuuggccucccaaaguguugggauuacaggcgugagccaccgcgccuggccuaagagguguuuauaagaagcuguaagaguccaaaugugggagguuuuauuucugucaaggugcacuugagucuaccagggaggacuuggaguuagaccuuaaaguaggaguuucuaaagugccagagacagggaaagcagggcauugcagguggagagcacaaccuguuuuauaggcuuucugccuccuuaauaucuagcagaggucucaucuuaauauaaaaguagauacuggaacuuaggaguuugcucugauggcagacauggauacuugcccugccagagugcccaucuaccuuccauuuauguuguuuggauucagucuccacuauacuauagccuuauauuugcauggugcuuuuaauuuucaaagcuuuuuauccaaauaacagccccucagggauaggaaauaaaagccagcugguaguguuuuuauuuuuauagaggagaaaacugagacaucaccaucauaucagcauuucauuucccagauaagaaggucuuuuuuucaucucuugauugcaaagggugcugcccaacaggaauaaccucucccaauuuucugggcacagcccagagugcugacugaggcagccaccaggagggcgccagcaaggcagacagcauggcugcugaucacagagcuaacagcucgacaucugcaggcugcagcuguacauuuuugcuacagcacauccguauuucugcucacacuugugaagaaucacagaguuuggaagaauaugaguuaaaccguuccaaguguauaagugugcuccaucucugggaguuuuauucuguacuggguggaguggucuaugagaucuuauagcugcuacuuuucucuguuuauuuauugccauauuuaguccaucuucccuguccuaauuuuaguucaaugccaaaaaaagauggagcacuccauaauagaugaauugagagggugcugauugugucacugaaauguuugccaaagaaauuguuuuucuagcugauuuuguucugccuccaucuuucagucuauuuggaaaacacaguagaguaccugguuaucuuucagagugucauuguuaaauaaucauuucaguaagcagugauggcuguugaucauuuuagacuugugccuauacuaaguauuuauccauuuuucuaauauaccuggauuuuuaaaaauauugauggauaaaaacuuucuggauuguugauuuugaggagguauaccaagaagagaagggugaucuugguguggagccaacaucuuugaaaucuuggcuuauuuguucuuacuccuuaaggcaccccauugccacuccuuaagcccauguauuugacaguggggcuuuuugucagaagccucucugauugucauuuggggacuuaaaugggcuccuacauaacagcuucuaugcuucaauuuucuaacuuguccagggugugcuucagcuguagacuguguauuuacguucauauauuugugaagaaagacaggaacuauauaguagaaugugaagucucucugaacuguaaucaauguguuuuauuaaauucuuggucacaaugugcaaacuucauugaguccuacaauaauuaauucuuuuugcauuauuuauuuugcuauaguauggucucuggagcucagcagagcugccauuucuuagccauaugacuugggacauaauuuuugacuucucugagccuuagcuucugguuaaauaaagugguauuggagaugguaccuucuacugucuuagugucauuuaaauaagaaaauauuuuagcaccauucuuugcguguaauaaauauuuuguuauuucuaaaugaauauaugaagauggagaguaaugguagcuauuacuauuauaguuauuuccugacuuguauuuauccuucccagcaagaaagucuuguccuacucaaaucuuggguaaauaugaaacuugcuucauuaucaguguggauugagaagguguguacgguguuccugggcaucugaagaaaggcuuuuaaaucagcuuuccuuuguggucaguuggucacaaauaacaucaaaauaucaauuguuaauauucauauuuauuuuuuccuuuacagcugacuacuuuaguauugguacaccuaauuaaaauuuuuccaccucuaaaauuuuuucuagggcaauuuauauaugauugaauuaauuuacauugaguauuaguuuccuugguuuuuaaaaauagauccccccaaaaugguaaggaguugagaaguuaaggcugugagcaaauagagaauuugggccuaaaguuuaauguggaaaugagaagaugauuucaauugauuuguagaaagaaccauaaugaagggaauuuucuuaaguaaacuuauguuuguacccauuugcuacuauuuuucucuuagagcuuuuagcacuuucucccugucauaagguuguagaguugccauacucugaggugucccacaaggcuagcacaacagcccucugcuuguggugcauacagcuaucauccaaaggggccaaccacaugacauggcaguguauuuccagaugucauucucucuguuuggaugacuugggagcuuaagaaggguauuuucucuugaauaggagaaaaauuguuacuuuggcauaaggcccacucuggcaccauucccacaucuguuauugauuagaagugaaugcuggucagucaggaugcaagagugcugguccgauuaucaagcucagccuucaggaugaaauacugcaggaaaucugaaggauggcauaaacuggcucuacacagucuuuaaaaagacccuuucauaagcuauuguacaaagaccugguguaaagaaauagccugagugaugucuacauguuaagaagaugccguaacauguacauguaggaucuauucuuagaggggagcaguggaaugggugguggaauccuuaugcaaugauuuuuaaaauauauaauaaacaugcacagauacuaaguguucaacccaaugagugccuuuuugguuuuuuuggggguuuuuuuuuguuuuuuuuuuuuuuuaaggaaagcgucuccuucugucgcccaggcuggagugcugugauuacagacauaaaccaccaugccuggucuauucauguuuuuaauuuuuaaauuuuuauucaauuuuuuuuaaaauuuagcgauggggucucacuguauugcccaggcuggucucaaacuucugggcucaagcaguccuccagucucagccucccaaagcauugggaauacauacguaagccacugcacccagccuguucauuuucuuaauggugucuuuugaugggcagaaaacuuuaauuuucgugaagucuaacuuagcagucuuaaaaauuuuaugguuugugcuuuuuugcuuaccaccaggucauaaggauauucuccuauucuuuuuguagaaauuuuaugguccgggguauuauuuuacaacccaucacgaaucuuuuuuuuuuuuuuuuuguauggagugagagaggauugagguuaauuuguaucuauuuggacaucgaguuccagcaauauuugcuaaauagacuuuucuuuccccauugaguugaguugacaccuuuauugaaacucacuuuguguuuggugguucguccuccaacccuguccuucuuuuuugagauugcuuuagcucuuugguguccugaacauauuauacagacaucuugguacaucuuggugucucucucucucucucucuuuuuuuuuuuuuugagacggaguuucucucuuguugcccaggcuggagugcaauggcacggucucggcucaccgcaaccucugccucccauguucaagcaauucuccugccucagcuuccugcauagcugggauuagaggcaugcaccaccaugucugacuaauuuuguauuuuuuuuaguagagacgggguuucuccauguuggucaggcuggucucgaacuccugaccuuaggugauccauccgccucggccucccaaagugcuaggauuaugggugugagccacugcgccuggccucuuuuuucuuuuuuuaaucuaaugcagagauauucuugaauuuuaaaaacuuuuacaaaauugggaauauacauuuuaggcguguaaauuuuuaaauuuuaaguccuaacuguauuuuaacguugguagccuauuauuaucaaaacauagucauucuguguaacgcaguaagaaauaucuaauaguugguuuuacuuaauaaacuuuacuaaauaaagccaguauguacuauguacuauguucuggccacuggacuuggcacuuggaauaugguggugaucaagaugaacguggccccaacucuccagaggcuuacaaccuaagaggccgaaauuggccucuucugaaacaaaaauagacaaaugaugcauuucaggccuugugaugugaacagaaauuuuuuuauauucuucauuacgcagcagcugauagcagcaucacaauuugauaggggccaggcacggugguucaugccuauaauucagcacuuugggaggcccaggugggcagaucacuuggguccagcaauucgagaccagccugugcaguguggcaauacccugucucuacaaaauacacaaaaaauuagccaggcguggugguaugugccuguagucccaggcuaccuaggaggccaaggugggagaaucacccugagcccaagagguugagacugcagugagcagagaucacaccacuguauuccagccuggguaauggaaugagccccugucuuuuauuuauuuauuuauuuuuaaaaaggcagacuccauuuggguaggauguaugugcaguauacagauaacauugcuguuuguuuuugaaugaaaauguuuccugaagccauagcaugaguauuggaaugaguauauaugucugcccucccuuccccucccuugcccuccccuccccguccuguccauccaucccgucccuccuucuuuccuucuuucuuuccugucuugagacagaguuucacucugucacccaggcuggagugcaguggcgugaucucggugcacugaaaccuccaccucccauguucaagugauucuccugccucagccuccugcugggauuacaggcacacgccaccacaccuggcuaauuuuuguauuuuuaguagagaugggguuucaccauguugaucaggugggucucaaacucaugaucuugugauccaccugccuuggccucccaaagugcuggaaugacaggcaugagccaccaggcccagccaugucugucauuuucuuuguuaaccuaauuucuaaagauuacucaucuuuuaaacuucuuugaaacaaguuguuucauaccugugauuuguacuguaacucaagguuuuuuguuuuuuguucuuugugugugugugugugugugucuguguguuugucgucuuuguuguuguuuuguuuuguuugaauccuggggaaccagagguguuagccuauguuuuaaaacucacauuuggcaaugguaucaacagcugucacacugaauaauugucaugucauuauaaggguuucuguugcucacuaaucuguagguauaaaucuggauuuuaaccacaugugauugguaaaaauuaguucuugugagagauucuaugcuguguaggccaucuguucccuauucucaaacccagaaugaaaaguuagccuuagaauuugcaaaucagugaacuaagagguauguuauaauaggaagaugggcugacugaagucucuggagcuaagcugggaccuguaugugggcacugcuggcagaaacauaaguguguguggauaaacucuucauuaguggaaaggaaucuuaguuuucggcugauuuucaguggugggcaugaccccaaacagaaucugagaugauguaauaaucaucugugauuugauuguacuuauaagauucagcuaaaucuucccuuuuuugucccagucuacuugagauguaccuuccuugaacccuuauugcccagcuacaucaugaacuccuugaagguuggaauaucagcuucaaguuugugucccaaacacuuaguacagugcuugggucauguuagccuuuugaugauguugaucaaaugaaucagcagccgggcgcgguggcucacgccuguaaucucagcacuuugggaggcugagguggguggaucgucugaggucaggcgagaccagccuggccaacauggugagaccccaucucuacuaaaaauacaaaauuagcugggugugguggcacauuccuguaaucccagcuacuugggaggcugaggcaggauaaucacuugaaccugggaggcagagguugcagugagccgagaccacgccauugcacuccagccugggcaacaagagcgaaacucuaucucaaaaaaaaugaaucagcaagguaacuucuugcauuaggaaugacagcacaggccgggcgcgguggcguacaccuguaaucccagcacuuugggaggcugaggcaggaagaucacuugaggccaggaguucaagaccagcuuggccagcauggcaaaaccccaucucuacuaugccgggugcggugacucacaccuguaaucccagcauuuugggaagccaaggcaggcggaucacuugaggucaggaauucgagacuagccuggccaacauggcaaaaccccaucucuacuaaaaauacaaacauuagccaggugugguagcacgugccuguaaucccagcuacucaggagccugaggcaggagaaucacuugaacccaggagguggauguugcagugaacgaagaucgcaccacugcacuccagccuggaugacagagcaagacagucuaaaaaaaaaaaaagaggaaagacagcacuaccuuuuauuaaacaacuucuuucuuuccccauauucccuucuaguuuuuucuuauacaugugcauacucuuuccauuuuauuuucgugaguauacauuauauccagcucuuuccuuuuacauuauaucaagaccuuuucuguguugcuauauauuuaucugucauuauuucaguggagaaguagacccagaaugugcauuguuuuuauuaauaucacaugccauuguuuccauuagauuguguuaccaucuaacuauccuuuguacaagaacacuauuguaucgauuugaaaaaucaacugaaaaaucaguuguuuuaguagucauuacuacaaaguuguagguacaugauaauugaccuuuucccagggccaaaggccaagucccaagccauaaccuugccuggauuucauuuucuuuaucuggguagacugaguauaugacuuuauaguuuaaaguucuuugacuaaucguuaaccuuauuuggggagaugaaaugauuuuuaugaaccaguaauuugaauauaauguaugaugaaguuuuggggcuuuuuuucccuuuaaauuaaauaauuuaguaaaauuuuaaaaaauuaucuuguuuccaaaaacggauaauuacauauaauugaaaaugaauuauuuguugaauuggauauauuuaaguucuuaagucaacuuguuuggauuuagauggugacccaagucuaccagcacugcauuuaguaaccauuucauuagacagaugcugucuacagggugugcuguuauauuaugcauucauccucaguacuugacuguccucugggaggccaagugucucaaaauccuguaagcacuuuccuguaccccuucucauaccaaccaugccacacugugaacuugcuguguauuuuuccuucuugauugcauaccuucaccauugucauuugguuuaagugauuuuauuuauuuauuuauuuauuuguuuguuuguuuguuuguuuauuuauuuauuugagacagaaucuugcuuuguucccuaggcuggagugcggugguaugaucuuggcucacugagaccucugccucccagguucaagugauucuccuuccucagccuccugaguagcugggacuacaggugccugccacuacacucagcuaacuuuuuguauuuuuaguagagaugagguuuugccauguuguccaggcuggucuugaacuccugaccucaggugauccacuugccucagccucccaaagugcugggauuacaggcgugagccaccaugcuggccagauuaagugacuuuuuuuuuucuuuuuuuuuuuuugagacagagucucacucugucgcccaggcuggaauacagugaugcgaucuuggcucacugcaagcuccaccucccagguucacaccauucuccuaccucagccucccaaguaggugggacuacaggcgccuggcuaauuuuuuugguauuuuuaguagagacgggguuucaccauguguuugccaggauggucucaaucuccugaccuccugaacugcccgucucggccucccaaagugcugagauuacaggcgugagccaccgcgcccggccuuaagugacauuuuuaagaguuuaagauuuuucccucagcccaucagguaagcucuagucagcuucuuuagcuggcuucuuaguagaaguaauagcaauaauaauauagaugaugguggucaugauggcaauuauaaccauaauauauuuuguaaaauggugugcaguuuagaacaggauuacuagcaucauuuccugauuacagaacagguuggagacagaggcagacuuaauugcuuauuuuauagagcuugagccacuguuuugguguguuuaagcauuuacuauauaccaaaacaugauauccuuuaaacuaccagugggauuuugacaggguaacuuagaugccuuuuaucauauuaccaaguugcugagauuguaacccagggcauuuggucuaauuugggagcauguuuccauucaucucugcagcucagauggagaagggcugggguuuagggcuucugaccucaaaccuuguuuuuuuucugucaugcuugcaggguauuuuaaauacccuguccuguuguucccucaacccaaacuaccuguuaaaauuuugguuuugaaaaugaggucccuauagcuagaucaugcugccugugugugaagaaagacuaacauguuaggaaugcguggcauucaaguaggugucuaauaauucuucuggagaaaagcaaauuuagucaaaaagcaaaugaaaauauuuuauaagcaauguuucaaaaugauucaaggaaauugguauuuaccucuuauccccaucgugucaucaguuccauugucauguucuuugaauaccgugagcaugugucuauuuuuuaauaaauaauuguaaucauacuacauauauauaggaagguccccccauacagcguuguauuauaugcauuucgccaaguguugaaugaaugauccuucauaauuacaauuuuuaaugccuuuacaguucacauugacaugcuguuccaccguuuaauuaaccauucucuugugguauaaauugcuuuuucccuugagcuguuuucuuaaggacagauuuccaggagugaggucacacagucaaacauuaugaacauuuuucuagcagagaaauuauuuuuuaaccucacuaauugaauguugguaccuugaaauacauuuauuucugugcuuuuuguaccuaguacauuaguaauuggauacuggaacuaauggaagcgaacaagcauguagauaaucuagaaagcauuauagucuuaacuggaaauacauaauuauuuucucucaaaauucaccaucccauuuuguuaugcuuuggcagagcaaucuagaacuauggcagagugaugguugaggaaauguggggaaauuuauauuaaaaccuuagccgugguaaauugaaaguuaacuuuugaagcaaagcuuaacuguagaagaaaaauagugauuauuucucauguuuguugcugaauucuagguuuuauucuucuaccuucuuugcauauaucugucucuaaaaagguagcuaauuaauguguuaugguaauuuacaguaugcaaaaggacugccagugcagaugugaucugaucaauauugugauuauuaucauuauuaucacuggguuuucuuguuuguuuuuuuguuuguuuuguuuuuugagacggagucuuccucugucacccaggcuggagugcaguggcacaauaucagcucauugcaaccucugccucccagguucaagugauucuugugccucagccuccugaguagcugggacuacagggacgggguuucacuguguuguucaggcuggucuuaacuccugaccucaugauccgcucgccucagccucccaaagugcugggauuacaggggugagccaccgcgcccagccuauuaucauuguuaucucgguuauagacauaggaaaacugagguuccuguugauauuauugccaaaacaaugcucuugaucucauucuaucuuucucugagguuuuaagcagaaccugguuguaugugagccauuuauauucuauagcagauuuuugcauuggcugugaguucaaaauagauaaaaauuuuaagauugcuucaaagucaagagauucuauauaaucaaaaauacuucuugguuaaagcauaaagggccaaggugacguguuuggaaaguauagauagaaggcucugaauuagggaaaaguccuguaauuccacagagguauguauuuugacccuuaauuucucuuuuccuugaagguucauaauuaaagcacagaaauucagaauugucauaguuuggaagcuaugaacuugagugauagcuuucucaaaauauauuggagaguuucauagaauugucucuaccuaacucugaacuucacuauuuauuuuauuuuaucuuauuuaauuuuauuuuugaguuagggucuuacucugucacccaggcuggagugcaauagugugaucacggcucacugcagccacaaccacccaggcuccagugauucugcaaccuaaacuucccgaguagcugggacuacaggcaccccccaccaugccuggcgaauucgauggcaucuuuuuuagagacgaggucucccuauguuguccaggcuguucucaaacuccugagcucaggcaauccuccugccuuggccucccaaagugcugggauuacaggcgugagccacggcacccagguuuguuuuuuauuuuuuuguuuuguuuuguuuuguuuuguuuugagauggaguccugcucugucgccaggcuggagugcaguggcacgaucucggcucacugcaaccugugccuccuggguucaagugauucuccugccucagccucccgaguagcugggacuacaggcgccugccacaacgcccggcuaauuuuucauguuuuugguagagacaggcuuucaccguguuagccaggauggucuugaucuucugaccucgugauccgccccccuuggccucccaaagggcugggauuacaggcgugagccaccgcgucuggccaauuuuuguacuuuuaguagagacaggguuucaccauguuggccaggauggucucaaucuccugaccucaugauccgccugccucagccucccaaagugcugggauuacaggcaugagccacugcguccagccccguacccaguuuuaauuauauuuucuuaacuggaccuauguggaaaagagguuguaugcuuccaagacaaaaauugaauuauuucacauguauuuccuuuuaacuuguuaugucugggcuguuuuggcauuuaaagccauuaaucucaacucaugauuucugucccaaggaaaaugagagucagauguucacaucuggaccauuuguuucauucaaguaguugaaauugcauuagaaaauuuugauagugauaaagucaagaauuuagaaugaaucauugaauccucccauugaaagggaagaucaaaaccuccaacuuuauguagaacuauagacugagagaacuauuacuuuuuguugauuuuucuuaaauaacauuacugagguaugauugacauguuaaaaagcuguacauauuuaacauauacaccuccaugcauuugggaauaaguacaccccugugaagccaucaacacaaaaguuuccucuugaccccuuuauuauuauuuuuuguguaugguauguagcuauuuuaaaguauuguuagucuuuguuuuaacuuuguugaaguguuaauuaaaaugaugaacuugcagaagaaaaagugaacauuuuaaacuauuuuuuauaaauagaauagaaacaggugcaaaugaagaaauauauauauauaaauauauauagaucaacaaaugaauaaugaacaaauauauauguuaauguagcauauauuaauauaauauauauguuaaccacaaaaguaccauggccauucagcucgugauauguauuucuuucuuuuaccuuuauuuuuggccuguuugaaagauuuaugcuacauuauauuuuccuuuauuccuuagauuacuuuaaagaacaacacuauaauuaagagcaguacacccuaaccaaguaagguugaucacacaauggcaaggauaguucaacauuaagaagcugaaaagggcugggcaugguggcucacgccuguaaucccagcacuuugggaagcugagccagguguaucacuugaggucaagaguucgagaccagcuugaccaacaugaugaaaccccgucucuaguaaaaaugcaaaaauuagccaggcaugguggcaagugccuguaaugccaguuacucucugaggcaggagaaucacuugaauccaggaggcagagguugcagugagccaugaucgcgccacugcacuccagccuggaggacagagugagacuuccccucaaaaauaaaaauaaaaauaaaaacaagaagcugaaaggaggaaaaaaaacccauuuccauaaauacaucccuuccccuaaaaaaaugcauuugauuaagcugaagaccuauuucuaauaaaaacaaguaaaaagcaaguuugugguaaguagaaacuucaagguuauacaugcaaaauguggcuuaaacuagagcugcaacauaaaaguggugaagaacagcagaggacaguuggagcugugggagaugcacaaaugaaugccucuggcauggagcuucaggguugaaaaucaaacacuagaaguccagccaggcacagagagcagccaguugcagaggggacaucucccuuugucuuuaucuguuguggagauguuugguagucccuuacccccaaugcauuguaauaaagcacuccauuuguauaugcaucuuaauaguccucaaugauuuaggcccacaaaaugaucaguuaagagaguuaccuuuauuuuguuuacuuucaaaaaaauaagaauaaacccaaacucaauucuuaauuucucagccugaacagugugaggucauaguuguccagauuucucuggaaacgaguaaagaugaauucguuucuuugucaugggucuguacuauagguuguucucuuuuuauuucauuugauuguaaacagcaacucuggcagcugggcaauauugaaugauugcuguaaacaaggaaacagacuuugaggaggaaauauccccacuaucagagagcuaacagagccucaauuucaauccugaucugucugaauccagccacugccucauacccacaccagagcuguucaauugaaauauaauguaagcaacaaauagaggccacauauguaauuuuaaauauucuuguaaccuuauuuuuuaaaaaagaaacaggugacauuccuuuugauaauauguuuaauauacuaagaaauuucaauauauaaucauuauaaaauuauuaaugagcuuguuuacauuccuuuccuuaguacuguuugaaccuuggggucuggcaugguggcucacgccuguaaucucagugcuuugugaggccaagguggcaggaucacuugaggccaggaguuugagaccagcuagugagacccugucucuaaaaaaaaaaauagaaaaauuagcuggacauguuggcaugcaccuauaguuccagcuacuugggaggcugaggugggaggaucucuugaacccaggagguucaggcugcagugagccuagguuaugugacugcucuuccagcuuggacgaugcugucucaucuuuuuuuacaaaaaaaaaaaaaaaaucugcaauccuuuuuuccugugcacaaacagcuuccagaaaauaguuaaaagaaaccaucaaacccuaagguaauuuuuuuuaaguaccuguuggcccaaacagagggcuuaauuagcggcaacucuuagaaaccagauugcguuaaacacaucuagcuuuguuuuuuuuucuuggcccccacaaaggcuaugcgcaugccccaggaauauacuucuucuuugauugggcacaauaagauuguuuucuucaaauauuugagagugguaggaccccagaagaacucuuaccaacugauggugagugccaagaucuucucauuuaucuggcaguggcauauuccaucucugcagcaagguaaagcccugggugcuagaaguuccuucacagaaccuaggugucagccagucauggauauuguccuguggcuucccauaaagaaagcuaaaucuuugcuucgugcuacuccugagcaugcaguuuugauuuuugugguucuccaucucaaaacaaaagcugaugggcugacugggccuuucuuugcgcugggggaauauuaaaaacucgguuuuucaaauauuaagguacauggagccagguggaacccaggcucuuuuaaagauugaugagggcaggugcaguggcucucgcuuguaauccgagcacuuugggaggccgaggcaggcagaucacuugagaccagaaguuugagaccagccuggccaacauggugaaaccccaucucuacuaaaaagaaaauaaaaauuugccgggugugguggcaggcaucuguuaauuccagcuacuugggaggcugaggcaggagaaucacuugaacccgggaggcagaaguugcagugagccgagaucacaccauugcacuccagccugggcaacaagagugaaacucccucucaaaaaaaaaaguacugaugaauagcugggcaugguggcucacaccuauaauuccagugcuuugggagcccaagacagguggaucacuugaggccggaaguucgagaccagccuggccaacauggugaaaacccauuucuacuuaaaauagaaaaaaguaguagucccugcuguagucccagcuacuggggaggcugagacacaagaauugcuugaacccgggaggccgagguugaagugagccgagaucccacuacugcacuccagccugagcaacagaguaaaucucaaaaaaaaaaaaaaaaaagaaaaaaaugaugaauaaauauguacaaaaagaaaagaaaaauauuugucacauccaaguuaacugaggauggcaauguaauuaaaaagaaugguuugaacucacaauuggcuuugugguuaccuuacuacuugaaagacgggacugggcacauauaccauuucauuggacaaacuuauuuuuacuuaauagaauauaauuaaaaugcaaaaguuaauagcacauuaaaguuuaauaguuuucuuugagacagagacauucucugcucucuuuugcuccucagacuggucuucguagucuucagguugcuaaaaucugauacuuucccaaguccauucucaugaacaauucuacaucccaauuguggcggggugggaggggggggccuccuguaagucauggucauucuguguucaugcugucuccauuuccaaaaacgcuccagaaucucuagauauauuuaaaucuuccccaacacacuugguccaacauguugcuucuguuuucauugucugucaccaugccuagggcacagcaaacaagaguaguggauugauaacaaguguuaguugaugaacaugaaaaaaacgacauaggccgggcccaguggcucaugccuguuaucucagcacuuugggaggcugaggugggcggaucacgugauaucaggaguuugagaccagccugaccaacauggggaaaccccaucucuacugaaaauacaaaaauuagccaggcaucguggcacgcgucuguaaucccagcuacuguggaggcugaggcaggagaauugcuggaaccugggaggcggagguugcagugagccaagaucaugucacugcacuccagccugggugacaagaacaaaacucugucucaaaaaaaauuuuauauauauauauauauaauuauguaaaaauuauauauauaauuauguaaaaauuauauauaauuauguaaauauauauauaaaauuaugcuauguaguucuguuaaugcaugauauuauaaaagcacaguuguaaaaagguuacauuuacucuaauucuaggccacagacuauucaguuaguccuaaaaauucaugcaacaucgccaggcauuguagcacaucccuguagucccaguuacuugggaggcugaggaucacuugagcccaagaguuugaggucagccuugguaacaaagccagaccuagugucuucgagaaaaaaaauacaaaauucaugcaacauuacuugacacuagggagacuaaguaaguaugaagauggaguuauaugaaugggucacugccacuuaaaaaaaccccucaaaaauacaugaacuauuaaugaguuguagugcauauaaggaagacagaauaaugucuuauauaucaugacuccauuaaccucuauaaagaagcugaauaucuacaucuuaaaauuguagacuaauggagacauuauuuuguuuauauuaacucucuaccuaggcuuuuccauuguaaagaagcuauauuuaucuagauccauccucccccauacacacagagcuguuuuucuuucacauugaaaaauuaugaccaggcacccuggcucaugccuguaauccuaauaguugugggaggccaaggcaggcagaucacuugaggccaggaguuggagaccagccuggccaacaaggugaaaccccaucacuacuaaaaaugcaaaaauuagcugagcuugguggcaugugccuguaaucccagcuacucaggaggcugaggcaggagaauugcuugaacccaggaggcaaagguugcagugagccgagauugugccacugcaccccaaccugggcgacagugagauuccgucucaaaaacaaaaaacaaaaaaaaccuauuacauaauaaacugauuugcaaaucucuugacuggauuuuuuuuuuuuuuuuuuuuuugagacagagucucacuguguuucccaggcugugcagugacauggucucagcucacugcaaccuucgccuccuggguucaagugauucuccagugucagccucccgaguagcugggauuacaggcaccugccaccacgccuggcuaauuuuuguauuuucacuagagacgggguuuugccauguuggccaggcuggucucgagcuccugacaucaggugaucugccugccuccgccucccaaagugcugguauuacaggcaugagccaacacgcccaaccuucugacugguuuuuaauacaagauagcuagauuuuuauaucugcuucugcauuaaucauguaaucucuguaaaaagcuaccauucacucaugaaagaguaaaaaggauaaaugaccucuucuugcuacgauuaugaaaauuguuuugaccuuuccccuucuguccacacauaucccaaagggucuccagggcccccaacggucccaggaccauauuuugagaacugcugaguagaucauggcauucaagccaagguaaguuuauguuuuauuguaagagcaauaggaagccauuagaagaguucaggucugugggaagaucuguuuuagguuuuaaaucagcacuuuggauacuacgugaugaauggacugaagggguuaaaagcagaagcagaaagaauaguuaggaggcagaugaagcaguccaggugagagaugacaguggcuaaauucuagcaauagagaugggagacaugacauacugugacauauuuaagagcuggacugucagaauuuacugcuauauuucuuucuuuucuuuuuuuuugagacggagucucacucuguugcccaggcuggagugcaguggcgcaaccucggcucacugcaaccucugccuccuggguuggagcaauucucuugccucagccucccgaguagcugggacuacaggcgucugccaccacaccugucuaauuuuuauguuuuuaguagagacaggguuucacuguguuagccggaauggucucgaucucuugaccucgugauccuccugccucggccucccaaagugcugggauuacaggugugagccaccgagcccggccuacugcuagauuuccucuagaagguucuguguuccgcagacauuuagcacagauguaucaaaugcuggaacccaagagaccuggcuuuuugaaucguaggaaagccauuaacuagcugugugagaaauugauagcguuuuucccugucucccgaaaaaaaagugagguuuauuuuuggccaagaagacuaaaguuagcugauucuccaucagucucagauucucugaguucucugacuuuggcugcguauguguggcccaggcaguaaugugacacaccuuuaagugguugggauucagucgauuuugauugugguagggguggcuuccauacaaaggcaagaugcuaaucaaauuuaauuuaagucuuuucuguucaugugagaaauacuaagcugguggagaccugaaacagauggugugcaguuggaguagauaacuauauuauucuaaauaaauauuugcuggagcugggaagcaacaauccauauuucauuuuuucccuauuuacauuuucaggucagcuguguugcuacuguuuuuaacuugcauuaagguuaucaacagacuuggcaauuacaauauaucuuuaaauguugaaauaauuagcauuggaagagacccucagcacguagugcuguaaugauucuuaaugcauuucugguggauagcugucuaauaauaucuuacacuugaaaaaauuuuuuuuuugagucggagucucacuuuguugcccaggcuggagugcaguggcccaaucccggcucacugcaaccucugccuccuggguucaugugauucuccagucucagccuccugaguagcugggacuacaggcgcacaccaccaugcccagcugauuuuucuauuuuuaguagagacgggguuucaccacguuggccaggauggucucgaucucuugaccuugugauccgcccaccucggccucccaaagugcugggauuacaggcaugagccacugugccuagcuuaaaaaucuuauacgguacuuguuuuuuaauuuucauuuuuuuuuuaauuuauuuuuuuugagagcgggccuugcucugucacccaggcugaagugcaguggcacaaucucggcucacuacaaccucugccucccaggcucaggcaauccucccaaggagcugggacuauagguguacgccaccacucccagcuaaauuuuuguauguuuuguagagaucagguuuugccauguuggccaggcuggucuuguacuucugagcugacucgauccaccugccucagccucccaaagugcugggauuacagacgugaaccaccaugccuggccuacagcacuuuuuaaucuguuacuuuauuugccuuuuaacaccucccuuccucuguuuuacaaaugaagaaaccaaggcucuggcaugacuuguccaggguuccacaguagcugauaaauuggcagaaaaaucaggauucacagucacaguuucaugcccaguuuucuuucuuccacaauagccuaccuuugacuauucaagaauauaaaucucuagcuggucuggaauuuggcuguuuugccaaacugaccuuuucaucucaucuuuugcugcauacagcuuuuuauauuuacuguauauucuguuucagcuaagagauggucuuaaauugagggaguaaugaaaauuuuauauuaacucuuuccuggcuuaaggugcuguagccacuguaucugucucaguuaaguucuggggcgagaucugugugcagucucuuaaauguuaauauauucuuuguuacacauaauauacuuguucucaccuucauuguaccuguauucuuaaugauacuuugaugaaagcagguuuucaaauaaguagguuuaaaaaggcauuuuauuaaucacuggucuaaucauuauaauaaccuaaacagcuagcauguauuccuaugcucuuuguauauuuauucuugaaauucacagugcuuacagcccgguagauuauacucuuuacuuggcuucugguuuuuccccuuauuuccuuggcuuuucuuuuucagucucuuuuuuuaguuucuugucuuucaugaucucuaagaguggaaauaccugcagaucuguacccacuuccaguaagauaccuguucucaggcuuuccguagaaucuauaugccauuauuugaaaauauuucaucacaacuucagacuuucccaccccaggccucagcuccacacuuuuauauccagcugcuuauccagcauuucuguuagaauaucuacugagcauuuuaaagguaauccugaucuucaguugcucuuuccccauuuuccuuuaccaguuccuccuucuuaguaaaugguaacuucauccuuccaguugcuuaggcuaaaaaccucaaaauuguuucuugaccucuguuuuuuuuuuuuuuuuuucuuucuuuuuuucagucucaucugucaaccaggcuagaguacaguggcacaaucacagcucacugcagccugaaacuccagggcugaaggaauccuccugucugagccuccaaagcagcuggaauuauaggcaagcacucucacaccuggcuaauuuuuuuuugguuuuaauuuuguggagccggggucuugccaucuuguccaggcuggucucaaacucuggacucaagccauccucccacccucagccucacaaagugcugggauuagagauaugagccacuguacccggccuuuugaccucuauuuuguauuuauuuuuuauuuauuuacugcugucaccucaguaguagaagacuuaguaguuacucgaauaauuuugaauaaauagaugagaaaauucuaagauucaauuuaggaaaaguuacucaaauuccuuauuuaacugcauuccacuaccuggggguuauguuaagacaggggucuccaauccucaggcugcauaccgguauggaucugugaccuguuaggaaccguguggcacagcaaguggugagccagugcauuaccgccugaccucugccuccugccagaucagccauggcauuagauucucauuaggagggcaaucccuguuguuaacuggacaugugagggaucuagguugugcacuccuuaugagaaucuaaugccugaugaucugagguggaacaguuucauccugaaaccacucccuaccccacccccaguuaguggagugcaauggcacgaucucagcucacugcaaccuccuuuuguaguucuucgguagguacauggccucccaaguagcugggaccacaggugcaugccacugugcccagcuaauucuuuuauuuuuugaaaagacagggucucauaucggggaaucugccccaauauucacguagguucuuuucuauuuuccuuuagcaucggccagcuugagaaauaaagggacagaguacaaaagagagaaauuuuaaagcugggcguccaggggagacaucauaugucgguagguuccaugaugccccacaagccgcaaaaaccagcaaguuuuuauuagggaguuucaaaaggggagggagugugcgaauacgugugggucacagacaucaaguacuuuacaagguaauagaauaucacaaggcaaguggaggcagggcaagaucacaggaccacaggaccaggcaaaauuaaaauugcugaugaaguuagcaccauugucauugauaacaucuuaucagaagacaggguuuugagauaaaccggucugaccaaaauuuauuaggcgggaauuuccucuuccuaauaagccugggagcacuaugggagacuggggucuauuucaccccugcagucucgaccauaagagacaggcgcaccuaggggggccguuuauaagccuauacauccaggcgcguauucucuuucccagggauguuccaugcugagaaaaagaauucagugauauuucucccauuugcuuuugaaaggagagaaauauggcucuguucugccuggcucaucagcggucagaguuuaagguuaucucucuuauucccugaacaauugcuguuauccuguucuuuuuucaaggugcccacauuucguauugcucaaacacaccugcuguacaauuugugcaguuaaugcaauuauuacagaguccugaggcgauauacauccuccucagcugacaggauuaagagauuaaaguaaagacaggcauaggaaaucacaagaguauugauuggggaagugauaaguguccauaaaaucuuuacaauuuauguuuagagauugcaguaaagacaggcauaagaaauaaaaguauuaauuuggggaacuaauaaauguccaugaaaucuucacaauccaccuucuucugccauggcuucagccggucccuccguuuggggucccugacuucccgcagcagucucacuucauugcccaggcugguuuuccagcuuuuuaaucaguuauagcagaagucaguaaacuguggcccacugucggccaggcaugguggcuuacgccuguaaucccagcacuuugggaggccgaggcagguggauugccugagcucaggaguucgagaccagccugggcagcagggugaaacuccaucucuacuaaaauacaaaaaaauuagcugggcucaguggcaugugccuguagucccagcuacuugggaagcugaggcaggagaauugcuugaacccaggaggcggagguugcagugaacagagauggcgccacugcaauacagccugggcgacagugagacucugucucaagagaaaaaaaaaaccuguggcccacuguccauuuuugugaauaaagauugauuacaacacagccaagcccauuuauuuguauauugucuauagugugcuacaauagagcaaaaaaauauuuacugucuugccuuuggcaggaaaaguuuccugauuccugagcuauaauaaugauaaauuaauuuuccaguauauguauaaacauggaauguaaaaaauuuauuuuuucuaucaguguugguacauguuaaaguauugauuuuguuuuaauugugcuccaucuucuaucuucaaagguccuuguaaaauacuuucugguaauuucccuuuuuuuuuuuuuugagacggagccuuacucuguugcccaggcuguagugcaaugaauggcaugaucuuggcucaccgcaaccuccaccucccagguucaagugauucuucugccagccauagccuccugaguagcuggguuuacaggugcccaccaccaugccuggcuaauuuuuuguauuuuuaguagaaacgggguuucaccauguuggccaggcuggucuugaacuccugaccucaggugauccacccaccucaaccucccaaagugcugggauuacaggcgugagccacugugcccagccucugguaauuucuuugaguccuuaugucuccauuuuuguugaaugauaaauuguuugucauuauaaacaguuguuucuggccaucucggcauaugaagccugcguguuauuaggaaguuggauguguugucagauuuguggcagaguuacaaagaugguaaaugcucauccuuaagcauguacuauguccauaaucaguuuagccaacuuuauaaggcuauaaauguaacaguaauuuugauguuucuuccuccaucuuuagcaaguuagaauuaucacuuuuggaaaguuuuuuuuuuuuuuuuuuuuuuuuuuuuugugauggagucuugcuguuuuccaggcuggagugcaguggcaccaucucaacuaacugcaaccuccaccuccuggguucaagcaguucuucugccucagccuccugagcagcugggauuacagacgccugccaccaugcccagcuaauuuuuguuuaguagagaugggguuucaccauguuggccaggcucgucuugaacuccugaccucaggugaucugccugcauuggccucccaacgugcugggauuacagguaugagccacugcacccggccuggaaauucuuaccauaugacaauuacacauucagaacauuuaccuaugcuuggcagugauugaagagaggcuaugguccaggaaaucuuuucccugauuuuuccuucagcugugauaccaccucuugggggcacuauucaaacuauaucccaugugcuaccuggagagcccauguagccuuuccagcaaacaccuuaacauuguguuaagacuugccuggccgucguacaugguaauguuucuauuucuuuauuuucccaguacuguaugucugucuuucccauaagugaggucccucccuaccuucaucucugaacuucccuaaggccuggcaaauccaggacagucaaguagauugggaucuggauccucaaaauccaggaccaaauuauuggaaauaauccaauuguucauugacaagggauuguuuaaaugaacuaugguaccuccucaaaguguauuaucauauuguuuuuuaaaauuguggaauuaagaauuccaggacauauugugauauuauaaaacacaauaauagaaccaaaaaaaaaaaggaacauuauaauuuguaugugguguagauuaguugucuauuccugcauaacaaaccaugucagaacuucauggccuaaaaugauaagccuccccgcucccuucuguuagucuaauccgcccaccucagucucccaaagucuugggauuacaggcaggagccacccacgcccagccugagagucugauuuuuguuuuuuuuguggguuuuuuauuguuguuguuguuuuuuguuuguuuguuuuuagacagagucucgcucugucgcccagacuggagugcaguggugcggucuuggcuuauugcagccucugccucucguguucaagcgguucuccugccucagccuccugaguagcugggauuacaggugugugccaccacgcccaacucauuuuuguauuuuuaguagagacaggguuucacccuguuggccaggcugaucuugaacuccuggccucaggugauccgcccgccucagcuucccaaagcgcugggauuacaggcaugagccaccgugcucagccuggagucugauuuuuuuauaaagcaauggauuuaauggcuuccuuggccagcuucuuuggaaugaucaguguuccugucauuauaggaaagaucucuauauggaucuuuauagauagaucuaauauagaaagaucuauauucugcauauuuucucagucaugauaaacaggaacacuugaccagaucuucuaccccacacagcauagauaacaucucaaacucgguaaacuguuauucuaauagauuuuuuuuuuuuugagacagggucucacccugucacucaggcuggagcacaguggugugaucacagcucacugcagccucgaccuccuggacucaggugauccucccaccccagccuaaugaguagccgggaccacaggcaugcgccaccacauccagcuaauuuuuuuuguuguuuuuggagagaugaggucucccuguguugcccagccuguucucaaacucugggcuuauccucgugucuagcaauucucccgucucaaggugguuuggauuacaggcaugugccaucaugcccaaccauaauucuaauauauuuuaaaauaugauucaaguaaaccaugugagaguaucugcuguauacccaccauuguuauguccauuaugguacccuucauauaacccuguguugaaauauccccagggacagauaaagaaaaccacugucacacaacuagggagugauggagcauucuucacaucaggcucaccuuuugccucaacaugcuuucuccuugagaccuaaauuuuucuucuuuccaauugcuugggaguagccuuucccuuuagauaaccucauuauuuucuuaucucguauuuacaccucugcucucugccagucucugauuaaaaaaaaaaaaaaaacucaaaagcaauuuauaaugauuuguaaaugcccuugauugugggcaguuuaucauggaagauucuucucaaguagcacauuucugggaugucagucaguaauacagugguucccccuuacccacguggaauauguuccaagaccuccgguggaugccugaaaccaugggaaguauugaacccuacauacauuccuuuuggacuguaacugagccuaugagaugcaacagcaaaaugagcacaaacgucuuuuuccuucuuacaguagaugucagcaaccucagcauaggaauuuuuucuuuccuuacgaagucaagaacuucugccuuuucacuuaguacuuuacagcuucacuuugguguguccgaauugccagcaucacuccucuuuuacuuuggggccauuauuaacuaauaaucaggguuacuugaccacaagcacugcaaaaccaugacaguucaucugaugguaaccgagauggcuacuaagugacuuauggucggguaguguauacucuggacaaagggaugauucacaucccaggugggauggugugagauuucaucacacuauucaguacggugcucaauuuaaaacuuaugaauuguuuauuucugaaauuuuccauuugauauuuuuggacuuugggugacuguagguaacugaaaccguggaaacugaaacugcagauaagaggaagacugcuggguguucaguguuacuuuccuguggagcuacaggauaguucuacucuuuaguuucaucuuugauucuuuaaauuccuauguaggaaaaaauaucacugcuaucacacagagaacuguuuauuacuuuauucuuucaucuguuuucuguuuucaggauauccuuagcaaauugcacacagugaagaaauuauucagacauacuuuuccauuuugacucaucaaguucuuuggcuucccaugguuuagguguugaaccauaagucauuuuggaaaugcaugcugucauaucuggguuuuauuuuuuaauauauacauacauauauaugcacacaugcauuuauuuuuaauacacguauacaaauauauucagaauaaucaaaacacaaacucauagggugacuaaauugucaguuacuuugaauuugaaauugaguuggacccuuaugacaaaaccaaggguuauuuugacuuccugggacuaaaucuuuauggcuguuugauaugcuaagcaaugguguuuauggacuuaagccacaauugagggaaaagaauuucuucuucaacucuauuuaagguucuccaagauagaagagaguucaauauaugguugauucuuuaaugggauccagcuagaauauagcacauaacuaucauuuucauaaaaauucaaaaaggaagucaccauaacuaggaugacauaaaggcaugucauagccuucuuccuacagggacuuacuauaauccugugaccccaggcagaggguuaaaaugccuacuuuggaacauacccuuucccaucaucugagcaacugcugaauuugucaccuuguaaaccacuuggauagaucucacuccaugaagggcauucaugccacccagcuuccaucaaaaaugccacuuuacauugugcuuggugauuuugcagcuauuaauucuuggaucauuccauacauuaucucugaguuuccauggauaaauuguugauaguauaccuauuuuccacagaaaacagauguuaauauuaacuuggucaaggucacauaccuaguuaauaguauguccagaauuugacaccaggauuucuaucuucuaaucaucauuccuguuaauuaagcaccuucuguauaccuugcagugauuuaggcaucaucuuuaaucauuacauguuuccugacagguaggucuuacugucacucauuuuacauauguugaaaaugaggccuagaaaggugaaaugaauuggugaaauucacuugcauuguaacagaaugagaauucacacggaaucucucagucuucauaccugugcuuuuucugcuucauucacuugaaacaugaagaaacacuaguguuguagguuuuggguggugaaaugaaaaguaucaaucuguaaacaguucucuaguggcuggguuuggcccacuaucaaagcuuuugguugguaagagcacagaguucagcguucugcauuugggcugcucuaacuuuuuuauucugccaagugcugacuguuaaaacucaucucacugcuaagccuuccucaagucuuuggcacccuugcuauagagccagguggucugaagaaaagcucccucuagguuguugcacacuguacacaacacauuacagugcgagacaacugucaguuccuuccuuuccuucuccccuacccuuccagaaagcugggccccagauggaagagcuggaaaugugucaacuguucucugaagggcauugagaaaauacugucaggaagaaaaggcaagcgcaacagcucauuaguccacuaaucagacaggacgaccaucaauuucacaaagaaaauguccugaacagagaaaugggaagggcuggcagaguguugcccacaugguucugagaacugcacauuuuugucaggggauuuguaacuugggggcauugcuuucuugauugacuuuauuauaucccuuucccaaguguggccacugcaaacugaagcauaaaaaugguauuuggagauacuuuucuacaaauaccauugugucccaucaaugcacaaaaauguuccuuguugccaggaucgugaacacucuuguauguauugucuuuauagcugugcucucacagaaggaaaacuuggacuuuaccuucuuauuugagccuuugcuccccauuuuuuacacuuuaauuugaauucagcaguuauuggagaaugaauggcugguacuuaagugaaaagcuuagaauuacugugaggaacauagcucaauuuaaaggugauuaugguaacccuggucguauuauuaacuaaguauguaacaaguucucuuugauagggaaaaauaacuuguuagauauauuagaauauuacucauugguaucaagucugauuccuguuagcucagaccuaccuaauugcagcaucaugaaguuuaucuaauuuaucuuucuggaauuuuguugccauuuaguauuaucaaacaacugccuauuauuaauuguucccauagaugaaguagccucugcuucauguagacucagcucuacuuuucaucuuuuugaacaauguauagcaugaaugacauuuacauguuugaggucagagagguugacucccucuuuuuuccuacuugauguaguugauauguauauauauaauuuaguacaucauuauuaauggugauuuuuuuuuuuuuaagacagagucgcucugucacccaggcuagagugcaguggcaugaucuuggcucacugcaaccuccgccucccagguucaagcgauucucuugccucagccuccugaguaacugggacuacaggugcccaccaccacacccagcuaauuuuuauauuuuuaguagagacaggguuucaccauguuggccaggcugaucucaaacuccugaccuuaggugauccacccgccucagccucccaaagugcuagguuuacaggcaugagccaccgugcccagccuauuaauauugauuuauauauaacugauugauuuucuuuucaugucuugcaguugaggccuaagucuagauaguucccauguuagcuuuuucaccccuaauaauuugauucauuuauaaggagaaguuaaagaaaaugcauuugagguaagcuauauuuguaaccugguuucuuccuuucucagccacuaucuaaagacugcuaacuuucaguucacaucaccucuugaccuuguuuccucauuuuaguuccuaggguugaaguaacaaaguaccacuaacugaguggcuuaagacaauagaaauucauucucucacaguucagaaagccagaggcccaaaauugagguaucagcaagguugauuccuucccgggguuucagaggacaaauguguccccuucucccuccuggcuugcugguugcuggcacuccuuggcauuccucgguguauagaugugucacucuagucccugccucugucgccacuuggugugacuguccucucuuuggcuucccucuguguaugucucugugucugugucucaucccuucuuuaaggacaccauucagauuggauuuagagcccacccagacaaucuaggaugaucucauccucucaagauuuuuaacuuaaugauaucuucaaagacccuuuugccaaaucagguaacauucacaguuccagauguugggauguggacauaucuuuuagggggucacuauucagccuauuauaccaagcaguccucuagggaaguauguugguauuucaaauuguugucuguuuuugcaaacuuuuagaaaacccuaaccuccauuucucugauucucugcaguugguccugagaaaagggugccagcgaugccuggaucgccuguggaagugaagauacaguccagauccucaccucccaccaugccaccccucccaccaauaaauccuggaggaccgaggccaguguccuucacuccuacugcaugugagaccucuuaguuacuuauguuuguaguucagagugacauuuggaucuaagugacugacuuguaugaagcguuccacauauauuauucaguguuuucaaaguacuauugaaaauauagacacagauauauauuucugguuguuucuuuuauaaauuacuuuuacccucugagaauaauacuuagcuuauuuggauauuuaguuguuuaaauauuuuguuuucauauucuuuggcugguaacuauuuuuauuucuuugacucuaacaauaaugaauuuaaauuauuauauugccuuaugggauuccaaguaaguuuucuaaaauuauagaauucuaaaaauguuccagugcugucaugguaagacuuuuuacaaaagagaauauuguuguauuuguuuacuagggcugccauaaugaaauaccacagacuggaugguuuaaacaauuuauuuuuauucacuuuuucacaguucuggaggcaagaauguaaagaucaagguauuggcagguuugguuuuaccugggccuuguagaugguugccuucuugccauauccucacauggucuuuccuccauuuugcgucccuggugucucuuccccugccuuuaaggauaauaaucauauuggauuagggacuacucauaauaccucuuuuaaccuuaaugaacucuucaaaguaucuccaaauauaguccuauucugagguacaagggguaagacuucaauguaugaauuuggccaaggcucgggcagaauucaguccauaaccauuauguuagcuaauaauauauguaacaauauauucaacuucacuaaccaucaaggaaaugcaaacuaacacccaauacaguaccauuauacacccaccaggauguucaaaaugauaccaaguuuuggugaggauguauggagcaacuugaacacucauacaaugcugguuggaguguaauuuaguacaucuuuuggaaauuggcaguuugcacuaaugcugaauuuccacgugcccuguaacucaacaauuucaguccuauauaucuauaaucaccaaaagaaccccagauaaacuaguauacauacaugcacacaagugucuugaucuucauuugaguucuaccuuuccaugcacaugcugccguccccaguucacuuugacacucugcagaucuuuugccuguaaaccaaaauguacugcuauuuuuggaaugcccaaaaagugucagagcacugagcuagaugcuguauguauuguuucauuuaaaugccauuacacaagcuugcacacuguccuugcucaaaauuuuuuguuuuuuguguuuauuauuuuaaaaggcaagagaagagaauguaagauguacagcuuuaauuggaaguuuauuauuuuccaaaacauuugaaauggaguagcugguaacuguagcauucaguuugagccagagugaaugaaaagaagugugauaucccuuuucuuaaauucuaauuucuaucucaaaguugaacagcccuagacauauauacuaucuugaaaagaaacagauuuaaaccucagccaucaaucagauuucaagauacaccaauagguauauguauauacaaauucagcccuuuuuacuuccauauuuggcugcuuggcggugguuguguuucauuucagaaaaugugaucauacauuuuuuucuaaagagacuacgaaaaagccuuucuauacaucagagaagcuaaaagcaugguaauguguuauuuuuauugguuccuucaaaauggagcaacuuuccaauggcaauugaccuuucugugaaaacaaagaaauggcagacuauugcaacuaauuuucuggauugcugagguugaguguucaacuuuccuuucauuagcuuuacuaauuuucuuuaguggaagacacaagaaaacucaccccuuuucucagcccguuagucuguuaugcagugaaucauucagcagcauuuuccuaaacacccuuugcugaacaaagcaaaaauauacacuguauacacaacuuauaaaacuuaauuaaaguaugcacauauguauuguguauuguauuauuaauaagugaacaucuauuaaggcaacacaaauauagaaauaaacaagcauaggccaggcgcaguggcucacaccuauaauccuaacacuuugggaggccgaggaggacagaucacuugaggucaggaguucgagaccagccuggccaacauggugaaacccugucucuacuaaaaauacaaaaaauuagcuggaugugguggugcgugccuguaaucccagcuacucgggaggcugaggaaggagaauuccuugaacucaggagacggagguugcaguaagcugagauuaaaccacugcacuccagccugggaaacagagcaagacucggucucuaaaaaaaaaagugaaauaguggaagcaugcacauaggcagcacagagauguagugaauccacuaagguuaccuucaagcggagcaacagcaguaugugucaaagaaugcuccuuaacagagaugauaccugaaccguaugggaugaagaagagcuugccaggucaaauuugaguaagguucaguguaagaagagggaacagagaugguuaacugacugugacuggcuuagaggaaguagaagggaaguggaagauuuuuuaugauuaauaaguugguuuuuggcaaaauaugacuaaaugucuuuuuucuaagcuagguaaagauuaaaugauuggcucuuuaaacauugcuuaugucuuaaauuguuucuuauguuuuuagauaaaguuucacuuuuuuaguuuuuuaaggcuggauaugauuaagugaaaacagaaugauacuuagguacuagauaauuuagauuuuuacuugaugccaacaagaacguagcucagugccaggcacgguggcucaugccuguaaucccagccuuugggaggccaaggcaggaggaucacuugagcccaggaguuugagaccagccugggcaauauagugagacucccugaucuacaaaaaauuuuaaaaaaagaaauuagcugugcaugguggcaugugccuguagucccagcuacucaggaggcugaggugggaggacaccugaguccaggaggucgaggcugcaccaggaggucaaggcugcaaugggccaagauggugcugcugcacuccagcuuggaugacagaaugagacccugccucaaaaaaacaaacaagcaaaaccauagcucuaggguuguuuucgaaauuaaaauuuucaagaaaugacuauuaagaacuaaauaggaaaacuguaauuaaucacauguauuauaauuugagcaaaaauguaggaugggaguguccugcauggaaucaggaagaugcuuuauugaaugaccaaggguuuggcaguauuaaucuagcacuguuaaggcagagaguaacuggcucuaauggacaugaguauucuggauggccaaagagauagguaccuuauuguaggaauaagucauuaaaucaguaggccuaaaaaauaucccucauauuaucauaacucuuuuuucuggugucuugcucacaugcuaccuucugauugacugccuaguguuuuggggaccuugaaauugggaaggagaugcaauguaaaagaugggcaugaguaucccaucacuggaaagaucuauuggcccagacccaucucaagcacuaccuguugcaggaagucuuucuuaaaacuacccaccccugcccauggcaccuguagaguuagauuucccuucuuauugcucugggagcacucugcuuucuuuuuaacgcuccaguguuacucuguuaccauuuuuaucugacagcagucucacugaggacagaaccaguuuugcauaccuuuauaacaugugcuuuacaaaauucaaaugaacaaacgaaaauacaaacaagaaaaaaugaacaaagguucccuuguuuuacacguaaccugagucuuucauuuuggcuuucuuuuaguaagcaauggcaucaaccauucuccuccuacccugaauggugccccaucaccgccacagagauucagcaaugguccugccuccuccacaucaucugcacucacaaaucagcaauugccagccacuuguggugcucgacaacucagcaaguugaaacgcuuucuuaccacucugcaacaguuuggcaaugacaucuccccugagauuggggagaaggugcggacucuuguucuugcacuggugguaaguacagccucacuguuguucucagcugccugaguauguggcucagguccaaagcgagcaaaguucuagauauuucugcucauuuucaaacccauggucauauggcaaaugcuacagacuagacuaguuauugaauaacuuguguaaaacuguuuaaauguagguuucuuuucuuuucuuuucuucuuucuuuuuuuuugagggucuuacugugucacccagccuggaguaugauggugcgaacacagcucacuucagccuugaccuuccagguuuaagcaguucucuugcugcauccuccugaguaguugggacuacaugugcaugccgccaugcccagcuaauuuuuuuauuuugguagagaugggaucucucuaucuuguucaggcugcuuucaaacuccuagccucaagcagucugccugucucggcuucccaaagugcugggauuauaagcaugauguuuaauuguagauuuuaugucagugcuuaucaaagaaacaaucgauaauguuuacuuguuauuuaagguggugauuuaauuccaauaagcaacuuuggauuuuuuuuaaaacugcucucaacaggcccacugguguccaaccaaguuaaugcaagguuuuguaauuuaauauauucagugcuuagugcauuguuuccaaaccaaggagaguagagagguagcaaguuuaauuuucaaaacaaugauuucuaaaauuacaaguuacguggccuaaauaaauacuaucaaaauaaacaguaucaaagggauugcauuguucagcuccucgugcauauaaacuugcuuaagaauuugcaagguacacauaauuuuucuuucuuucuauacugcacguggugaaccuguggcauaaaggagugauuuucugacuucgacaccugggugggguuuuauucucaguguuuauaagggaaguacugccaguucccaauguuucuaauugaauuuaccuccaauaaaagcauucugugcuccuuuguguauguuaaccccuuuauaugggauaaaaagaugaaucacagcacuaauccuugaagcugcagcucuccgaguguaaaucuagggacccugaagauucuccaggauccuuucuggagauccagaaggugaaaacuauuuucauaauauaacaguagacuaaaugcaaaaguagagagaauacaacuggcuucuaguaugcuagauauuaaagagacuuucuauuaugcuagauauuaaagagacuugcaaaaugauaaaacagugcugcucuucuuacugcauuuauuuuggaaaauacagauuuuaaaaaucacaccucagucugaaccaauauaguuauuuuuuauuuuaauuaaauucucagcuuuaauuucugauauaguaaugucaauaaauguaauccauauaaauuagaggaauucugagaccaaacaguuuaagaauuauugccuuaaaaaauuucucagucuaaggccagaugugguggcucacgccuguaauuugggaagccaaggugggaggauugcuuggaugcaggaguucaagaccagccuggguacauagugagacugccucuacaaaaugauuuuuuaaaaguuagcugagugugguggcauaugccugugguccuagauacucaguagguugaggugggaggauuccuugggcccaggaaagcuauguuugcaccacugcacuuccagccuaggugacagagugagacccuaucucaaaacauaaauuuaaaaaauuucucagucuauuaugaaaggaacaacuuucauacaaggcaaaaugcaauauaugacuuuuucaucauuugugagguuuaguccuuguuacguaugacuguagguuauuuucauugcuauauagugucauauuguaggaauauaccacaauuuauaccuuuggguuaucugacauuuaagucauuuguaauuuggggcaguuuuggggucuccagcaucucccccauguuuggagauuugccagaaggagucacaggacuugacauacaguugugcucacagcuaagaucuauuacagaggcauaguaaggagacauagugagagagacacagucuggaggaacccaucugcagguuuccuuaugcucucugccucuccugaaugguaacacagagcucccuuuccuuagcaacaaaaauaacagcaacauauaugcaguguuucugucaagggaagccuauuacagacucaaugccaagguuuuuguuggggccuggucacauagucagucuuugccuagcaccugccaaauuuuacccucuuagaaggaaaacccguguuuagcaugaaccauacuguucgcagaaccacucuacacacggccacccuuaucgguuagggagaaguuuaguucuuuuuuauuuuaaaccuguuuauuccucaaauuuuagacuacuacagaaaaaucuuacuggauccagaguaagguuauuggaguuaaaugucaaaaugagcuugaacauaauuggaaacaaagcagacaucaaaauguuauguugauuccagcagcaaauuaaguauuaucuauucuuaaaaauaauuucaagacuaaaaguaaaaaugucaaaaauucauuugcggcgggcggaucaugaggucaggagaucgagaucauccuggcucacacagugaaaccccaucucuacuaaaaauacaaaaaauuagccgggcguggagcuugcagugagccaagaucgugccacugcacuccagccugggcaacagagcaagacuccgucucaaaaaaaaaaaaaaaauucauuuguaaaaaauuugaaucuuuuuuuaguuaugaaaaguauauguagguguguccaauuauuucuuuuaaauggccacauuuggguuaccuuuuuuuuccauaguaaaauauacauuauagaauauaccauuuuaaccucuuuuaaguagacaguucaguggucuuaaguacauucauauuguuugugcuguucaccaugugucccuguuugccauuguguauuuagagccuaugagcaccacaggguuaaggaauuuauacaauugcuuuuuuugaauugugaugaaauuuacuauauuaacuauuuuuagguuuacaguuuagugacaauaaguauauucauauuaucauacaaccaucaucaccauccaucuccaaaacucuuuucaucuugcaaaacugcaccaauuaaacaauaauaccccauuccccccucucccuagacccuggcaauuaccauucuacuuucugucccuauggauuuaacuacucuagguaccucauacaaguagaaucauacaguauuugucuuuuugugacuagccuauuucacuuagcuuaauguccuuaggguuuaugcauguuauagcauaugucagacuuuccuacuuuuuaaggcuaauauuucauuuuaugucuauaucacauuuuauugaucuguuaauuccccaauggacacauggguugcugccaccucuucaguuaagaaaaguuuuauaucaauguaggaaacuguuugccauccaggguccuagaugccagccaguggcccaaccuuacaagcaggccuuucuaaggcuagcaguuuuaggccuacuauguuaacucuuuuuuguacagaaccauuacaaauaauguuccuaugaacauucuuuuacacguguggaaacacugcacgcaacaguggaauugugguuucauaugugugguguguaccuguagucacagcuacucaggagacugaggcaggaggaucacuuugguccaggaguuugaggccagccuggguaacauagacagacccccaucucuaaaaauaaaggccacauaauuuaguagcuggaguuauccaucugcauucuguguccaugguguauaagaaguaagguacugagagucccuaacuauaccagaaagcaagcaugggcauuuugcacuucaagguaaugguaaauguuuugugcuucacuuacuuauuauuauuuggagaauguacuuucuggaggauaguuuggcaauguuucugguaccauucauccuaagaaaauaauaaacauaaacaauauacaccaagauaaucaguucaacauuaaguacccccucccccauugaagcuaacugaaaggucuguaaaacccugaggaaaguacaauuuaucuguugucguuaaaaaucaagucucauucugguucagaggcaagguagaaagacagacuucucccuauuccccccaauaaguagcaaaaagccguggacuuuaccuauaaaacaaaaauaauuagagucuucaccaggugugguggagugugucuguagucccaccuauguagucccagcugaggcagguggauugugagccugggggacagagcaagaccccaucacuuuaaaaaaaaaagagagagagacucuuaaagguagagagaagacagcagauucacucaugggacccaagggacuacauaagcagugaguucccuagguuuuguguuuuucugauauaucccacaccagguuaugcagaaaauguugaguuuaagaguaaaaauauagguaaguaaauaaacuuuccuuagcuggcauaguggaguaugccuauagucccagauacucaggaaguugaggcaggaggaucacuuaagcccaggaguucgaggcugccaugagccaugaucacaccacugcacuccugccugggugacaaagcaauacucuguagauagagauagauagauagauagauagauagauagauagauagauagauagauagauagaugacagagcaauacucuguagauagauauagauauagauacauacauacauauacauacauauauauauacauagguaacuagcuaacuaacuuucccucuccugaguuuucuaaauuauguuucuuguuggcagcaaaaauuacuuugccugauaugguugucacuauauguagaggaaauaauugccaauuuuuauuauaaaccaggaggauaaagauagacaagguuucuguauuucuguauuuuggucaguggugguuacaugaaaauacacauauggcaaaaugguauagaacuauaaguauguuguaccaauguuaguuuccuaguuuugagauuguaacccuuugggaagccaaguuggaaggaucacuugaggucaagaguuggagaucagccuggucaacauggcaaaaucccaucuguacuaaaaauacaaaaauuagccaggagugccagugcacaccuguaaucccagcuacuuggaaggcugaggcacaagaaucacuugaaccugggaggcugagguugcagugagcugagaucacaccacugcacuccagcaugggugacaaaacaagacugugucucaaaaaaaaaaaaaagauguaagcauuggagaaagcugaauagaggauacauuggaguauaaguguugcccuugaaauccagagaccagauucccucagcaucuuaccucucaacguucuucucucugcucugacacaucuuucccaaagcugcauuucaguuuccucaaggacaacacugauguacagaaauccuugucccccuaaguuugauucaaauauaucuucucuggccagguaacacccauaaucccagaauuuggaaggcccaggccgacuugaggccaggagcuuaagaccagccuggggaauguagcaugacuccuuccucuacaaaaaaaaaaauuuaaauuagcugggcauggccaggcacgguggcucacgccuguaaucccaccacuuugggaggccaaggugggcggaucacgaggucaggaguucaagguugcagugagcuauaaucaugcuacugcacuccagccuaagugacagagcuagacccuaucucugaaaaaaaaaaauuuuuaagcaaauacgucuucucugugagucaguaguguccuguacauguguaccuccaucauacuguaaugaauagcuuaguugccucuuuucccacuagacuaugagaucuuugaggggaagaaacaaacaauuaugcucuuaauauaaaauaagguuuuauaaacuagcugaaggaggaagguguuuaucccucucauacaggacugcccuauauccacuauguauguaaaccugaguccauuucucuggccuaacucacuauuucccugugucacacaauccauccuuuccccuugucuacccacaaguauacuuaaaaucauucauguagcccuuccauacauuuaaucuauuuguguuugcuuuucaagaccugauugcuucccuugcaguagauauaaaagagugucauucucuuacacuuaguuuuuauuccugauuaccagaauuacagguuucuuuugcuguauugugcaaaugucauauacuuaaaacagauauaacguuaacuuuaaaagaauuuuuuugguaugaaaugugggaaaguguucaaacauuuuccuuuaauauguuuaaauuggacauaccccuuuucccugaaggaaaaugucuuaauguuuaccgaauaauaaauaugauauauuuggaaaauccaacauaauugcacacucagaaauaacuguuauugugauuauucucccaggcauuaaauauaugauauaauaugcauguguguuauuuuuguaaguggauucuuagaaaauauaauguucuguuucugguuuuucacuuaacaguauuguagguaccuuuucugccuuaaugcguacaaaucugcucuacccccucccugcauaagcauucugauacaugacucuuguaauuuuaauguagcuuucuguugguagaucuauauauuuuccuuuuuuuuuuuuuuuguuaggaaaauauauugugauagcguggggguaaguugcauguuacauacuauguuuuugaacacuuacaaaguuucuaaaaguaaauuccuagaaauguuauagcucuuucuggggagcaagcagggauucagaauaauccccauauuucauuuuguucguuuguuuuaauuuguuaucauacaguguuaucggcaauugaaauacaaauauugugugaacuuugaagaaaauauuuuuauuuguucauuccccuuagcagaguugcugagucucauuccuaauuugaggccuagacuuuugggaaaacacagaggacguccaccuuuuagagaacagugauaacuuaccaauggggguuugccgguugggaguuauucugguaugcauaaugcauacaggccacuugaagguagaaggcaacuauucuuuuuucuuuugcuucuggugguuuuuguuuguuuguuuguuuguuuguuuguuugaagauuugggggaaguuaugccaggagguagggggcagaacuuggaaaaagaaaugaacuuuugaaaaaaugugacacuggguuacugaguccaaaaugucuuagaguugacauccuaggccaagucauuaucucuguaacaggaaacauuguaagcuugauugccuguuccugaagugacuugcaaugaaccccucaauaucagggaucagagugccucucuucauggguagugagaaaggcagugcccuauucugcagccuaggcugcugggcaaaggggagaauuuggugguggugaagggaaucaaggaggguuucugucauaagaaaccagugugguuuaccuuugccaggcgucugaguuccugaugauguuccugcaguuauccuuuuccuuaugauuuaaaagucuuuagcagcugagcacgguggcucaccccuguaaucccaacacuuuggaaggcugagggaggaagauagcuugagcucaggaguucaggaccagccuagacaacauagcgagacugcaucucuacuaaacauuuaaaaaacaaaauaaaaagaccgggcgcgguggcucucccuuguaaucccaccacuuuaggaggccgaggcggguggaucacaaagucaggaguucaccgucaggagaucacaggagguggagguuacagugagccgagaccgcgccacugcgcucuggccugggcaacagagcaagacuccaucucaaauaaauaaauaaauaaauaacauuaaaaaaaaaaaaaaagaagaguuuggcacuauaaguuuuggaaguccaguuuuggaaguugaacaagguuauuuaucuuuucagaacucaacagugacaauugaggaauuccacuguaagcuccaagaagccacaaacuuuccccuucguccuuuugugauuccauuucucaagguaauuugauaauuacugaauauaauuuaucuugaauauuuccucaaauucugcuaaucccuguuacgugauuuaaaucagagccgcuugccacguuuuuagaucuuuauuuugggcugguagagaggucugagugcaguuaacagauaaacgucagguuuaaugagaugagaauugcaaaagccuuaaguuguggucugugugcagacacugcugcuaacacauagaaguagcuagcauaggagagaauaggaggugcuugggcuggaagugugaaaguggaagggaggcugagguccuagcagaagaaauaacuggucacuaauccuuuggguauagucagagugugaagaguguugucugagaggcugucagacaaaaggcaaggucuuugcaguuuagacuuacucuaaggucaggagacgauguaggaagacaguguuugugucuccccgaaccccagauagucuaguuucuaaagaugucuucugcaauaauguucucuggagcauaacuuuuggagagauuguucugcauuaucaugcuuacaugauaaaugaaaugaggccauguuauauauguuauauuuacauggaauaaaaucuucuaaacagcuuuuggccagucacggugguucacaccuauaaucccagcacuuugggaggccaaggcagguggauugcaugagcucaggaguucaagaccagacuggccaacauggcaaaacccccgucucugccaaaaaaaaauagaaaaaaaaaauagccaggcgcuuguagucccagcuaguugggaggcugaggcaggagaaucacuugaaccugggaggcagaggaagcaggugagcugacauugugccacugcaccccagccugggugacagagugagacauucucaaaaauaaaauaaaauaaagaauaaaaaaagaaauauuuaagaguaagccgcaaggccgggugugguggcucacgccuauaauccaugcacguugggaggccgaggcaggcagauuaccugaggucaggaguuagagaccagccugacuaauguggugaaacccugucuucacuaaaaauagaaaaaauuagcacaugccuguagucccagcuacucacgaggcugaggcaggagaauugcuugaaccugggaggugcagguugcagugagccaagauugugccacugcacuccagccugggugacagaacaagacucugucucaaaaaagaaaaguaagcugcagacauuauacaucuaaauacuuaaauacagguaucaaaucaggaaaguaacauucauacaacacuguuaccuauagaccuuauucauauuucaccacaugucccacuaaugucuuuuacaacaaagaaaaacuugggagggagcauaguucuggaucugacucaggaucacccauugcauuuuguugucacgucucuuuaguccacuuuaaucuggcacaguuacucagcucuuugugaucuugacguuuuuacagaauacaagauaguuauucuaucugcgcaccuggauuugguuuucucugguguugauuugauuagaaucauuuaacagaaaaacuguauucaauuguuacuguauuuugaauuuugucaauauuuauggaaauuuguuuucucucuuuuaugaguaucucuauaauaccuuuaauuuuacugccuuuuuuuuuuuuuuuuuuuuuuuuuuggggagacaaaaucucgcccuguugcccaggcuggagugcaguggcgcgaucucggcucuacaaccucugccucccgaguucaagcgauucuucugccucagccuccaguguagcugggacuacaggcacgcgccaccacacccggcuaauuuuuguauuuauaguagagacuauuaauaguagcgaccauauuguccaggcuggucucaaacuccugaccuugugauccacccuccuuggccucccaaagugcugggauuacacgugugagccaccgugcccagcgucuaauuuugccucuuaacaaagccuaaaauauuuacugucuggucaaauaaauaugccccuuuuacuuucuuuuaccuuauuuucauuuccuaagaaaauguaacagcaucauacagauggguuaucuuacuaaaguacuaauaccaguuuuuuaaaaccuucuauuggagcacagcagauacacaggaaaaugcaucggucuaaggugcacagccuguaucauggcucgguucuaauggcauugaagccucggcugcucugagcagccuguggugccuuuuugagcccugaaacagcugugcugguucuaucuuggucuccuuuauguaugucagagcugguagacaauuauuuccccaagacucuagaaucaagaaagauuugugaaauuuguguuaauaggaaauaauuagcauguuuuuuauucaucaugggacacaugucagccguguaaagaucugacaugguguuuuuuucaauuaaguuuuuacaguugcaacaagauugagguuauagaacagacuuuaaaagaguuuuauauagucaaauuccuuauucuuaacucuguuauuuuggaaaacagcaugagguagguuguuauggcagcuuuuuggcuagcauuugggguuuugucaauuuauuucugcuuuaaaacagucacuaauuauggugccugcuaaauuaacccucagugaagggauggcuacuugcauguauuaaaacucuccuuucacuugcucaucugucccuugggauuaagccuuugcuuaugagcccagccugcauugcuuuuaaauuuggugagaaaaauauaauuucuacuuuauguuuuuuuuaauaaaaaugggaaaaguaaauucuguauaugaaagagaucgaguucugagcuuuuaaagauguauaggguuuuaaaaugugauuuguuccuauugcagguuuucuaaguaugagagacagaaaaauaccuacuuaaugaauuaucuuuuuacauuuuacaucacucccagugcuccuuuucaaacucccauguuucagaauaaucacaguuuccagaauucuguugcagcuuuuauacagagcuggaaggaagguugaguagugcuaucagagaugaguugggguccagaagagagaaaccagggcuuggaaugacucccacauaggcaguaguaauucucucacugacuaaagucuucagaagcguauguuuuaaaauuauuauguucaacaacccuuuauugagcuuugacuguauacuaggcugcaaagguaaauaagguacaaucucuuccuuaagcauauuuacaucugguuggggcaagagacaauugaaccaguaauucaagugcaguauaagagauaucauugacucacagaagaagcauuugaaaaucagacugccaaggagagaaaggcuuuuaucuuguaucaucugcuuugugaaagcccuuugaggugcugagccuucuuguguagggccuaacacuggaaaaacugccucuuccuuucaaggccaaccugccccugcugcagcgggaacugcugcacugcgcucgggcggccaagcagaccccaucccaguaccuggcucagcacgaacaccuucugcucaacacaagcauugcaucgccugcugacucgucagaguugcucauggaggugcacggaaaugggaagaggcccaguccagagaggugagcagaugagcuuugcuguccuugccuuccuggaaccgcacugguccuccccuuugcuuauaaaagagagagaauuugauugcugugguuguaaugucucaaacuuuuuuugagacaaggccuggcucugucgcccagacuggagcgcaguggugcaaucuuugcucccugcagccuccaucuccugggcucaagcgauccucucaccucagccuccugaguaucugggauuacaggcacgugccaccaugaccagcuaauguuuguuuguuuguuuguuuguuuguuuguuuguuuguuuuuggagagaugagguuuuaccauguugcccaggcuggucucaaacuugugagcucaagagaucugcccgccucaaccucccaaagugcugggauuauauggaugugagccaccaugcccagcccaaugucucagacuuucugugguuauuuuugcuuuauuccaauaccuagcugcauaauacaucuaaaaucuaugggaguagcuuccagacaugaguauuuuucgggaacucuucagaugccugcacacccgguaagaaacucuacucuagagaauuuaugggucgacuguuccagaagccucaggaguacaguucugccuuuuccuugaugcuguuuguagaaagaauuggaaaaaaaaaaaaaagaaaagaaaagaaaaaacaaaaaaaaagaaauacaaucugccaaaugccuuuuaugucaaacgcauuuuuuucugaucugagaaguuuugaaaaaguauagcaauuaauuauuaauauuugccaaugacucaccuuuacugagauuaaaauuaauaugaauuuauuuuagaaaacucccuaugaguggcuaucaaaauauucuauggguuaucaaagaaggcaauaucaacaauaguggauaggcuuuaaugacauuuuuuuaaaaguaaaaaaaaaaaaaaaaaaagaaaauuuauuacaguugaaucugagugacugaaaacccugcuacuacacaauuggacccacuguuaauuugacuggcuuuaaaaaaaaaaaaaagacacaauuggauuuguuauaugagccuuuuuccucccauguaguuucuuuccaguaacucaucuccacaguaacaaauuugaccuuaauacuuuccuaaguaugguugaacccguaacucagaaaaacggugucaucuccuuagucucuccuuugcuuuauaaggguuaauguuucugucugguuauggauggauuugaccucuuuuuucaugcugguauaagucagcaauuuacaugaggugccuggcccuugaagacaauucagcucaugccucaugucacaccuuuccuuagaggcuuccuguuuaugccagcauguagcaaaauaccuaauacauaguagguucucaggaaaugucugcaugaacacuuguugacaggaucagauacgcacuucugcuucuucuacaggagagaagagaauaguuuugauagagacacaauugcuccugagccuccugccaagagaguauguaccaucagcccugcuccucggcacaguccugcucucacugugccccucaugaaucccgggggccaauuccauccuaccccuccaccucuucagcauuacaccuuagaggauauugcaacuucucaccuguaucgggaacccaacaagaugcuagagcaucgagaaguucgugauagacaccacagucuugguaagcaaccgaagcagcaugguaaauucagacuggauucuuggauuucuuuccaacucaaugauaaagucaaauaauaugauugcuuuuucccacugauuggauaaaacaauauuauacauagacuauuagaaucauaguugaucuuauuugauaucaaucucauuugauaccuuguugcuaugauaugauagaaguacagcuagguguggugacuggugucuguaaucccagcucuuagagaggcugagguggaaggaucacuugaagccagucugggcaacauagugagaucccaucucuacaaaaaauuuuaaaaacuagccaggcuugguggcaugcgccuguggucccagcuacuagggaggcugaggagggaggaucaguugaguccaggaagucaaaacuacauugagccaugaucuugccacugcauucagccugggugacagagugagaccugucuaaaaaagaauaaagggguaucgccuauucucagaugguucagaagaagagaaugaaaaagcaaaggagguaaaauguuaacauuugagaacucuguuugaagauaugugagaauucuuugugcuccuuuugcagcucuucuauaaaucugaguuuauugcagaauaaaaguuuuuaaaauuaggccaagcucaguggcucaugccuauaaucccagcacuuuggaaggccaaggcaggaggaucacuugaggccagaaguuugauaccagcaugggcaacauagagagaccucaucucuacaacaacaacaacaaaaauuaaaaaugaggcaggaggggcugggcgugguggcucacgccuguaaucccagcacuuugggaggcugagguggguggaucaugaggucaggagauggagaccaaucuggcuaauacagugaaacccugucucuacuaaaaauacaaaaacuuagcugggcgugguggugggcaccuguagucccagcuacucaggaggcugaggcaggagaauggcgugaacccagaaggcggagcuugcagugagccgagaucacgccccagcacuccagccugggcaacagagcaagacuccgucuccaaaaaaacaaaaccaaacaaaaaacaaacaaaaaaaaugaggcaggaggacugcuugagcccaagaggucaagacugcaaugagccaugauggugccacugcacuccccuccugggcaacauggugagacccugccucaacacaauaaaaaauguuuuuaaaauuaagcaggaaagaugcaagauuucaccuuggaggagaaagugcauggacauuuaggucaggaggugaggcauaucgaaaucuuggcucugcauccuaacuagcugugugaucucaggcaaguugcuugggcucucugagccucagaagaguaauuucuaaaugauuguaacgccacccccugugcuagguuguuguuccauuuggaaugccugguauauaggugcucagaaaccuuuaaauuuaggaagaaacagaaaagaaaccuuaacaaaccucuucuaguuuuggacagagcgguuugucauguacucuuacacguuuucagcauaagguuuuuuggaguaaaacugcugagcagagaaccaaagggcuaucagcuuccaggguuucccuaaauuuccauguauaccuuguugaguaaaaaacugcaauacauuugcccucacuuccucuuacuuaggcucacuagcaucuuucagacgcuuggccacaguggggccccuggcaucauguagugggauaguagcugaauagggaaggcuguagcagccaugguguucucagagccaacauuuacugagucguagcuaccacuuagauuguguuguaaguacauugucuuauuuuauccucacaggagucccagacaauuguuauccccuuuuuacagaugaaggagcuauggccaaaaaucacuuagcuaauaauuggcagagacaaaauucagaccccaauugucuuaugcccaagguuuagauguacuggcaguauguuaugauacuuauccuaguguucaaccccuguuacuccuaugccucucuuuuaucuauuaaaaacugcuugcgggcggucuggcguggugguucaugccuguaaucccagcacuuugggaggccuaggugggcgaaucgugaggucaggagaucgagaccauccuggcuaacaugguaaaaccccgucucuacuaaaaauacaaaaaauuagcugggcgugguuacaggcaccuguagucccagcuacuugggaggcugaggcaggaguagggcgugaaccugggagguggggguugcagugagccaagaucacaccgcugcacuccauccuggcaacagagugagacuccgucaaggggggggaaaaaaacuggcuugcuuugauuggaaauagcacagugggggaaaaaacuggcuugcuaauuaaugguuucuucuggaccuuuuuugccaguuugacuugagaaagaaguaugcuaaaaacuagguauggggucucacuauauugcccaagcuggaccccugggcucaagugaucuaccugugucagccuccugaguggcugggacuauaggcccaccccaccacaccuggcuuuuauuacuacauuuuuugacagauuuuacaaaucaugaggaacucaauauauacugaaauaaacagauuaucacacuaauacauagucacuaugaauauuaugacuauaaauucagacugguaacagggguguuguguuaaugacucaaagacuaagcacuguuacuguaugugacuuagguuuaaaauaguagacaauucuuacugguauacccuuaauucacacaguuguuccauuccuggaaguuucaguauauaucaaaacuauccccccaccaaaaaaauuuuuuuaaguuacugauaauauuaagcuguuuccaagugguuauaccaguacacacgcuaguuuuggugguuaauuauucgcauugcaccacauccuugucaacacuuaguauuaucugacauuuuaauuuuuuccaguauguuagaugugaaaugcuauguaugacauaccuguuuauuucuuuuaccucuuuuucuuuagggcuauuucguguuuuacaauugauuuguuggaguuuuuuauauaaugugaaucgugauccuuuguugguuauauugucauuuugugggucccccaccccauugugaaucauugccuuaguagugugaucaaaguuauuaugaauauguguguauuuacuugguagaauuugcuucuauuguguuuuuccugcuaucuuugaauuuaaucuguaauuucuaauaggucuaaauggaggcuaucaagaugaguugguagaucaucguuugacagaaagggaaugggcugaugaauggaaacaucuugaccauguaagaaucuuguaguguguaaugucccuaacucuuuauuacuuuuuuuugaaacaggagucucgcucugucacccaggauggagugcagugguaugaucucaguucacugcaacuucugcuucccagguucaagcaauucuccugccucugucuucggaguagcugggauuacagguguacgccaccgugccuggcuaauuuuuguauuuuuaguagagacaggguuuugccauguuggccaggcuggucucaaaccccugaccucaagugaucuccccaccucagccucucagagugcugugauuacaggugugagccaccgcacucagccuacuuaaugcuaccaauaauuaauggaacauguaugcuugaagugaacauaaccacagccaugacauccuuugcuuuuaauaaaagcugguuuagcuacuacucccucagcugaggaauuacagagucacucccuaaucuuugugaugggaugaucacuucaggucagaaaccaaauaaagucauguaguauaaugguuaacaacaaagguuuguagccaggugcaguggcacaugccuguagucccagcuacucgggaagcuaaggcaggaggaucucuuaagcccaggagccaagacuucaagucuagucugggcaacauagcaagauggaauucauuuguauuuguuaaauuuuuaucaaaagaaacuuucuuuuuauuuuuuucaauucugcuccuucuguaguaaagagauugcuuuuuagcccacauacucauguuucguaguuuuagaacacaggucaguaacaaacuucuagguaauucaaccccccaaaauuguuuauauuccaaaauuauuuugcacucugaaagauagcagccuuccucaucucaucaaaauucauaauuucuguuagaaaugugugugugccuuauuuuaugguucagccacagcaaauuuacagugcugcagacccuagggauacaacaaaugcugcugcaacaugaaauaguagacuguuggccagaaggccaugcaucugagguuuuguccaaacacuggaagcccugguaguuauuguccucuuuagguaugucagccucaacaccaauguccuuccuagcugauggagaaacagacagcaauaaagguuuuaaauguaaacuugauauuccuaaaucuguacuuuaaggaaccugaauuccucauauugcguuggccugauuuacaguguugguuguuugaauguucuuaucucaucucugccuggcccccucugugacucaggcgcugaauugcauuauggaaaugguagagaaaacaaggcgcucuauggcaguucugcggcgcugucaggaaucagaucgugaagaacucaacuacuggaaaagacgguacaaugaaaacacagagcugaggaaaacggggaccgaguuggucuccaggcagcacagcccugggagugcagauucucucagcaaugguaaggggagagucuacgggaaacccaaaauaaaugucagccuuuagagcccaccaaucugucacagaaggcguuuucuacuugacuuuaaagaaaggugguacucaauuguggauuuagggaaacucaggugauuaugaaaaguaaaugagaaaauauaugaagccccuggcauguuuugguggguggcgcaggaaggggguuuuuuuguuuuggauagacaggaucucacuguguugcccaggcuggccuuggacuccuggccucaagcaauccuccugccucacccucccaaagcaccaggauuacaggccugagccacugugcccagccucguacuuggcguguucaaaaaauguuaauucuucguggagaaugagaauauuugugauuuuguucugucuuuaacucuuuacauauaugugugcuagguguuggucagaguguuugguugucaaauucagccuggcuggauguauguacuaggcacucuugugucaucacuuucauuucucacaguagcccugaaaguguuuaccuuaccuucccuccuccuguccccagcccaccauucaggaaaauaccacucaauccaccauggccugguggccuccuacaaaagguuuuaccauaccacgcuggguuguuuccccuugccuuucagagucugaagcagcagcaauccagaguacauccagcaaaccucaguuauuccccucaaaauguuccagcacauucacccaguaacugagaaagugcccuauccaaaggcauagcugagugacaggccaucugugauaagacucuucccacgcacucugaguucccaaauguucaccacgaagaacaagucucuuacgacagaccuaguauguuccauugaaggcagcuauuagucucuaaaagacuguaaggaaaacuugaggcaaagccagaauuaauacaguauguacagacagugggaguuaaaggcucaccuuuccccaccccacccacagcagcagcucuggagccaaccauggaauuacaaccauuagguggaauaucuagcacaacaaggcgucaacacauauguagaguuauauaguaugauuccuuucguaaaaacucgaaaaacaggccgggcgugguggcucaugccugugaucccagcacuuucggaggcugaggugggcagaucacagggucaggagaucgagaccauccuggcuaacacggugaaaccccgucucuacuaaaaauacaaaaaauuagccaggcgugguggcggacgccuguacucccagcuacuggggagguugaggcaggagaauggcgugaaccccggaggcggagcuugcagugagccgagaucgcgccauugcacucuagccugggugacagagcaagacuccaucucaaaaaaacaaacaaaaaacuccaaaaacagacaaagcuaaucuucuggucucccucacuuucugaacauuugcagaucccugugcgacuuucggacagggagaaaggcuuuuggagacguagcuaaaguuuacacccaagccauaccucauucaucagugaguccacaugugugcaggugagaagcauagaguacagagggagcugcagucgugagccagugguugcugagccaagauacagcucuugcuggagucauucaggucuugcuggagucauuuaaacauggcuaugcaugaccacuacucaccuuucucaccuuuugcaucaaggauuagcucuggggagcauguuuucugauuugccugagacaguccaguuuauaccuguguccuguuaauaguuauuacuagcauuucccucauucucaacaaugaaggcaaucuggaugauaaguuauauugucauucuagguuugguuucugacagcacuaucaaccugauuuagauaguauauuuuagugucauuuauauguuuaucucauguuuauuacuuguccauuuuaguauaguaugacaguauaauucauauccuaaauaaauguacuaugcaaaaugugaaccaaaaugacuccaaaaagugccacuggucugauuacaugaggagcuugggcacgguuggcuucaucaagaaagucuuacugugaaauuaguucuuuuuguuuguuuguuuguucguuuuuguuuguuuguuuugaaauggagucuugcucuguuguccaggcuggaaugcagugcacauucuuggcucauugcaaccuccuggguucaagccauucucuugccucauccuccugaguagcugggauuacaggcaccugccaccaugccuggcuacguuuuguauuuuuaguagagaugggguuucaccauguuggccaggcugggcucgaacuccugaccuuguaugauccacccaccuuggccucccaaagugcugggauuacagacauaagccaccaugcccagccugaaaugaguucuuagacacauaguuguuuuacauucuggcauauguuauaccaauaaucauaguuugaguagcauuguccuauauugggcaguauucuuagacauuucaaagaauuucaccaaugacuuuuuuuuuuuuuuuuuaacagagucuagcucuguugcccaggcuggagugcaguggcaugaucucggcucacugcaaccucugcguccuggauucaagggauucuccugccucagcuuccugaguagcugggauuacaagcgccugccaccacacccggcugaguuuuuuuuuuuucaguagagacggcuggucuucaauuccuaaccuugugauccacccgccucguccucccgaagugcugggauuacaagcaugagccaccgugcccggccucaccagugacuuuuaaauaaguaauuaguguuuuuguuugagacggagucuugucugucacccaggcuggaaugcaguggcacgaucuugccucacugcuccccagguucgagcaguucuccugccuuagccucccaaguagcugagauuacaggugugcccuaccacagccagcuaauuuuuguauuuuuaguagagaugagguuucaccauguuugccaggcuggucucgaacucccagccucaaguaaucugcccgccuuggccucccaaagugcugggauuacagacauaagcuaccaugccuggccaaguaauuaguguuuuuaaagucuuggguuagcugggugcagugucucacgccuguaauccccgcacuuugggaggcugaacgagguggaucacgugaagccaggaguucgagaccagccuggccaacaugucaaaacacugucucuacuaaaaacaaaaaaaguuagccaggcaugguagcacaugccuguacucccaccuacuugggaggcugaggcacgagaaucacucaaaccugggaggcggagguugugguaagccgagaucacacacugcacuccagccugagcaacacagugagacucugucgcaaaaaaaaaauaaauaaauaaauaaauaaauaaaagucuuggguuaugcagaaauccaugguguggauaguuauugaaguaaagugguuuggugauuuggagagaaauugacuagaggcuuuagauggcauuauuacuuuucccauuuaaauuaaugcaauguagguuuccuuaccugaaaauuuaugauucacaauguuuucacaaauagauuuuguucagacagcaagcaguguauuuaggugucauuaaaggaugcauaaauaagugcaaaaaccauaaggaaaagaagaaaaugcuuaucacagagaucaggagacugguuuccucuggcuguguggguggagggugcagaguuagugaguucuaacuacgucuauucuugggacaggauugucagucuggcuagcauuauuuaaauacuacuauggcuugccaugacuuaccucuuagggauuugggguugcugguacuguucuguuuccugaacucaggcuuaugauguuaaauuguauauuaauauuuuuauuauauuguauguuaauauuuuaugaacuggucagccaucuaacuuugcaaguaaaauuuuuuuuuguuuguuuguuuguuuuuguuugaaacggagucucgcucugucaccuaggcuggaguacaguggugcagucucggcucacugcaaccuccgccuuuuggcuucaagugauucuccugccucagccucccaaguagcuggaauuacaggugcuugccaccaugcacagcuaauuuuuguauuuuuaguaaagacgggguuucaccauguuagucaggucggucucgaacuccugaccucgugauccacccgccuuggccucccaaagugcugagauuacacacaugagccacugcaucuggccaaauuuuuaaacaaagaaaaagaauacuuaaucagcuaucaguuuuuccucagaaugacagucaagcucacauuccgggcccuucuggauguuaugauucugagacccaaaaaucugaauauaguccaccugugguggcugacgccaguaaucccagcacuuugagaggcagaggcuggcaaaucgcuuaaacucaggaguucaagaccagccugggcaacauggugaaacccugucucuacaaaaaauaugaaaauuagcugauuguggugguaugugccuauaguccggcuacuugggaagcugagguaggaggauggcuugagcccaggaggcagaacuugcagugagcugaguucgugccaaugcacuccaccugggcaacagagcaagacccuauguccaaaaaaaaaaaaaaaaaaaaaaaaaagaaucugaauauauguguuuaaugaguucaauaagcaggcaaguuugggaaaacugccucuaguuaaguccauagcagauggaccucauucagugucacagggcuuccaggcaacuuuuuagugacaugugugcacaauuaagggugaccacucucuagagguaagccucuaauauuggagacugaaauaaacagaaaugggaauuaauaguagcucuucagggaaaagaaaacuaccaauaauguagcauuguuaauaucucuggugagaaaaagagaacaacauuagaaaucuacccaacuuauauauccaaaucaugaauuucaaaaagaaugagcagaacaaguagagaggauagaauaguuauugaaauaauuccaaaaaauuaccaagaccugcaagacaguuccagguugaaucagucuaccaaguagacaacacaggaaaauaaauagacuuagucguuuagcaucauugaaaguuagaagacaauucugaaggaaaauuauuuuaauuuagaauucuauacuuaaccaaaacaauuaaguguuagauuaguaaccuacaauuuuucaaaaaaugcaccuccugccuacccuuucuccacaguaucuacuguaggauaugccucaauaugugaaaguaaaccagaaaaugggagacacugaauuccugaaagaggauccaacacaagaaaggaaggaaaggaaucccuaggcuggugaaggagagccccaagcauuaguggcaaagcaggccuagaaagcgcccaguccacgcuggaacagcccagaaccuugcuagagauuuccuuaaguaaaugaaauuuauaaaagauuuacacaacaggaggauaauuugagauugaauuggaaguaauuacauagcagccuggcacaauggcuuacaacuguaauccuagcucuuugggagacugagacaggaaaauugcuugaggccaggaauccaagaccugucuggaaacccugagauagugaaacccugucugugcaaaaaauuuagaagggaaauuaggcggucauggugguacaugccuaaaguccuagcuacucaagaggcugaggcaggaugaccugagcccaggaguucaagggugcagugagccagugaucagcuguguaucacugcacucuagccugggugacagaacaagacccugucacacacaaaaaaguaauuuguaaaaaugcugccuuuccucccccuacauuuuuccauaggcucaaugguuaacaauuaauguauucuuguagaauuuucuauguacauauuuaaagauaauguuuccuaauguuuuauuuugaaauuuccgaaacacguagaaauuuugaaagagaccacccuggccaacauggugaaaccccaucucuacuaaaaauacaaaaagaauagccaggcaggguggcgcacaccuguacucccagcuaccucucgggaggcugagguaggagaaucacuugaacccgggaggcagagguugcagugagccaagaucgcaccacugcacuccagccugggugacagagugagacuccgucucaaaaaaaaaaaaaaaaaaaaaucugugugcauuuauguuuuauacauuuauauuuuaggggguacuguaccuuaaaaaccgauguuuauaggggaaaaaauuaggacauaauagguaaguaaaaagaagaaagugaagaucacuuuuaaucucacuacuuugaaauacuguuaauuuguucauuugauggggguguguguuuuaaaacuaaauauuuacuguacuauuuuauaaucugguuuuuagcccuuauaugagaauuuuuuuauacuaaaugaaauauauguuugagucuaaguggugaaugagaaaucugaucaaaaauaaaacugcugaucauagacagcuucugacccuaugcuuuuuaugucucuucugcagauucucagagagaguucaacagcaggccagguacaggauacguaccuguggaguuuuggaaaaaaacagguaugugucugacugcuuguaggucauacauacucacuaauuugugggagcagagaacagauaacugggugaaugguugguaacuggguccuuugguuguauaauaacuugcuccucauagagcucuaggcuccugccucuccugcucuggcuuguccugcaugucuccugauaccugucuuguuaauuugcaggucaggaguuuggaauagcucccuccagucccuuucacacucuuccacugggucacgcugaggcaauaaguaccuguugacauguccuguuucugggcuugcaacagaguucauuuugccugaucucuucacugguggcuacaguauacuguguucacacuacugccacauuugugcccaaauucugcucugggcacagcucuguaaucccccugugcuuucuuucaccuucucugugccuaccauagugaagacuguucuugguaggccuccucuuuuacaagaauaaaggaggguggggacugccuauuuuguaaguucaaggaugaaccucacaucacuaaugucagccuuauccaaauauuggcauucuuucacuucuugccuccccaucccaguuucauuuuuuaaguccaauacaacuuuugguuuucuuacuaagauaaaauuuauuucuacaaaaauguaauaccuacauucauaaagacucuuuuaagagcaucuagacaguaguaaacaaauaaaagauaugaacagacacauuaugcuaugagaaauacaaauaaacauauugcaaaauauuuuuccuuacuaguagucaggauaauguaagauaaagcauaucugauaaauuaaccccuugucuuuaaccguccguuauugacaauuuuaaaagaccuuguugaugacacucaauaauugaucagaggcuuauauaagaaauuaagugaguaccugcagauucuuggaaucauuccucacuuuuccuuuuuuuuuuuuuugagauggaguuucgcgcuuguugcccaggcuggagugcaacggugugaucucggcucacugcaacuuccgccuccccgguucaagcuauucuccugccucagccucccaaguagcugggauuacaggcaugcaccaccacgccuggcuaauuuuguauuuguaguagagaugagguuucuccauguuggucaggcuggucucgaacuccugaucucaggugaucugccugccuuggccucccaaagugcugggauuacagacgugagccacugcacccggccuuuuuuuuuuuuuuuuuuuuuuuuuugagauggauucuugcucuguugcucaggcuggagugcaguggcacaaucucagcucacugcaaccuccaccucccagguucaagcaacucuucugccuuagccuuccaaguaccugggauuacaggcacccccgaccaugcccggcuaauuuuuguauuuuuaguagagaugggguuucaccauauuggccaggcugguuucgaacucuugacuucaggugauccacccgccuuggccucccaaagugcuaggauuaggauuacaggcaugagccuguaaugugcccagccacaagaucucuuuuaaacuagugaguuugauuauuugggagauaccuuugguuaacuaugguuaagagcccaacuuugguguugggccagcuagguuugaguccuugcucugcuacagugccaucugugaccuuagacgaccuccaguaagauagcuagccaaaccgagaugauuauuaauucaugcuuaagcugaggggauaaaauguaccuaagagcauuguuacacuggcucaauaagaggcaucugauaagagacuuaugaaaaguucuuggccucuggggugaagauuuucuuaaggccagagccauaagauggaaaguuguuucaugguagccuagaacucuguguuugaaccucccuugagccugugccaugugcaagagguaaaccgugagggaguguccuuaggcuucuggauugucuaguccuguggacuuacguagggagcuacguauuuugggacuucacauucacauucucauugggcugaggcucaaacauauggaauguguuauuuugcagcgucuacauuagggaaaucaagcagggcauuggugaugggaggaagugaacaggaaccagguaggaugaugguaaguggacaggguuuaaaaacccagggcuuuuggcagucugcccaaaucuaugucuuuagcccuuguuugugcaccuagucuuauuuauuuaauugccuccuggccauuuacaccuggaugccccagaggcaccuccaccuucucacuugccuccacacuagcuuuguguggacuguccauuucauugccuagcuuuagcauucuucucuuucaccuccacuuccaggcccuucggugcucccaaccuuuuucugccucaucccuuccucagugccacuuauuccugccuaaauucagccucuucuaucaguucaaucauugcaccagccucccgguugcuaucucugucuuuaaucuuccccuugcauagaauccuuuauggaguuuccuuugaaaauaaagucaagccgacugggcacgguggcucaugccuguaaucccagcacuuugggaggccaaggugggcggaucacgaggucaagagaucgagaccauccuggcuaacauggugaaacccugucucuauuaaaaauacaaaaaauuagccaggugugguggcgggcaccuguagucccagcuacucaggaggcugaggcaggagaauggcgugaacccgggaggcggagcuugcagugagcagagauuacgccacugcacuccagccugggcaacagagcgggacuccgucgcaaaaaaaaaaaaagaaaauaaguucaagccggggguggugccucaccccuauaacacuuuaacaccaacgcuuugggaggcugagguaggaggaucacuugagcgcaggaguucgagacaagccuuagcaacauagugagacaucgucucuacaaaaaaauuuaaaaauuagccgaguauggugggacacgccuguaguccuagcuacucagaaggcugaggugggaggaucaugauucagagaggucaaguccgcagugugcugugaucgcaacagugcacuccagccugggcaacagagcaaggcccugucucaaaaaaaaagaaaaagaaggucaaauuucuuagucuggcaugcaagacuuuuugcaaaaucucauuuccaucuaccaucucaagcaaaacacaugucuugauucuccccugcccacugaagagcugaucacuuuucuccuuggaacucuagucucuuacgaugacauacacgauggcaccugaaacacuuucauacuuggucacaagcagucaggagaguguggccugugucuagucacuugcguccacagcccuagcucggugcccaccuccaucuccguacccagccagcaccugcauggauggacacaugagugugaagaucauguguuccucccuguggaguuuuagaaaagaucacuuugugucagcucucuccuuacuuagaauugccgugggaugggagggaaaagauuucucggccaguugauuuuacugucacuuucuucuagaagaagcugugaauaaggugaaaauucaggccaugucagaaguacagaaggccgucgcugaggcagagcagaaagccuuugaagugauugcaacagagagagcacgaauggagcaaaccauagcggaugucaagcggcaggccgcagaggaugcuuuccucgucaucaaugagcaagaggaguccacggaggucagagcucugcgcccugggggcuggggugagcagcuggagugaccacgcccgcugccuuccucucauacgcugggcaggaagacacaggcaguccacucuugagcucaaugaggauaauuuuuauccagugccaggagaguuuugguucucaugcuaagacucuuuuacaugccaagauagugaauuauuacauuguauuuuuacauacauacauauauauauagagagagagagagaggcucaguguauugguguaaauuuugagaauucacccuaaagacagaguuugugugauugcacgaugaugaugaugaccagcauugacggagugggcuuacugugugccagacacccagcaaaguuguauauuuucuuuuugagucucacaauggcccuaauuugcagaugaggagacuguggcucagggaaugcaacuaauauaccccuuuggugcugaagucaggauacaggaguaagaaagugcaggguccuauagcaccuaggcuuuuuuuuuuugagacggagucucucucugucccccaggcuggagugcaguggugcaaucuuggcucacugcaagcuccaccuccuggguucacgccauucuccugccucagccucccgagcagcugggacuacaggugccugccaccacacccggcuaauuuuuuguauuuuuaguagagacgggguuucaccguguuagccaggauggucucgaucuccugaccagcaccuaggcuuuuuacaaauaggauagcugguuuguggacugaaguaacagguuggguguaucugccugauuguccaggacccaggauccagggcccaggacuuggugaugguucuauacaggacgcuugaguacuacagugaggagaaaaaucaacaaacugaaaaagaaucugugacaacaugagaacagcccuuuugaauuuaaugcaguuuuucuguaaauuucauuuuagucauuuuucagcuuuaaaacaagaaaccaguuucuuucuguaaguagguagaucucaucuacuggaugggagaccggcugucuuugggacauucucuugaaguucagcacucacucugucaccgaggcuggagugcaauggugcggucucggcucaccgcaaccucuaccuccggguucaagcgauucucccaccucagccucccaaguagcuuggaguacaggugcacaccaccgugccuggcuaauuuucauauuuuuaauagagaugggcuuucgccauguuggccaggcuaaucuugaacuccuagccucaagugauccacccaaccuuggccucccaaagugcugggauuacagaugggcuuuuuuuuuuuuuuuaacaaacaauagaaauguuauuuucuuguaauuuaaaugguccauuucaguauuguacugucacacauggcaaugugcagaugaaaaugccuaaauaccacguggcuaucacagaggauguggugaaauuccuuauuacagcucuucaauacagauacuauggauugugagaaaauaguuucuuuaaucccccucccuuuucguucucuccuccuccuuugucuuuuuuuuuuuuguguguguguguguguguguguguguguguguguguguguguguguggauaacagggucucacuauauugcccaggcaggucuugaacuccugggcucaagcuauauauacucuugcuucugccucccuaagagcugggauuacaggcaugagccaccacgcccagcuucuccuccuccuuuuucuuuagaauuguuuuugaggcugggcacaguggccaaugcuuguaaucucagcacuuugggaggccaagguagugugaacacuugagcucaggaguucaagaccagccuuggcuagauggugagaccccauuucugccaaaaaaaaaauuuaaaaauuagccaggcauggugucaugcaccuguaguccagguacuuuggaggcuggggcaggaggaucgcuugagcccaggaggugcaagccugaccaugaucguaacacugcauuccagccugggugggagagcaagaccccaucucuuuaaaaaaaaaaagaaaaaagaaaaaaggugaugacgauggcaagaugagggggaaagaaaagagaauuguuuuugagagugagauaucuguuucucuucucuauguuuaacuguguauguauagccauccauaucaguaucuguauuuguccuuauuuaucuacuuuuaucucuguuuaucuuuaacuaugucuaucuccaaagaaagaguauagcuuuuggcuuagagcauagauccuggaucuggacugcguagguuuaaaucccagcucuccauuuugagcauugugcuuuuaaggaauuguaauuuuaaauaagccacaaaguagccuccaggugaggugcacaccuggaccuaucccugcaaaaucacuuucaaaagcagggaagggauagagggccuguccuuuggaugaguuugcauuggaccaaaacggcugauucucguccaucaagaauguucagcuagaauauccuuguugaaauuuggcagguauuccuggaguuucuuguucaucuugugaaagguggucuggugugggggaggaaggaggccaggacuggagguuaggagcccugacuucuagccgaguucccucucauacuggcaguauacccuuaaaggagucagucuccaucucuguucaaugaguauagcagcuccuauccuauuggucugauaguuauuagggaacaggcacaguggcccaugccuguaauuccagcucuuuaggaggucaaggugggaggguccuuugaggccaggaggucaagaccagccugggcaauauaaggagacucugucucuacaagaaauuaaagaaucagccaggcaugguggcacaugccuguagucccagcuacucaggaggcuaaggugggagugugggaggaucccuggagccuaggaggucaaguccagcuugggcaacauagcaagacccugucuccaaaagaaaaaacaaaacagcagcagcagccuucguugagucagauuaucaguaaaaacaaugaagauuauucucuaaugagggaagcaauaucagcugggcgcuuauaauccugacacuuugggaggcugagacaggcagaucacuugagcccaggaguucaagcguagccuggccaacauggcaaaaccucaucucuacuauauauauauauauauauauauauauauauauauauauauauauauauauauauauauauauaguauauaauguguguguguguguguguguguguguguguguguauauaauguauaauuacaaaaauuagccaggcaugguggcacaugcagaaaggaguaggauaaauguucgucuuaacacauguggucuuaggauagauggcucuugggggagacccuggcacagaguuugguuugguuucugacuauuaaaaugagccaaaagaugaguccaugccuuaggcaggagagauggccaccugcccuaggcuggugcuguguaagguauuuucacacacacaucucauuucacuguuccugucaucuugcagggaaguaguuuucuuguuuuacagaugaaggaaacucagaaaggcaguguguauuucucauaguuaaacagcaguagagggcggaguugaccacagguguauguaguuccaaagcugggguucucuacauacagccccuugcuuuacugugcagggaaugaauggcaagccugccccucaaucccagcaaccacuaacugaugccugugucuugcagaacugcuggaacuguggccgcaaagccagcgagacaugcaguggcugcaauaucgcgcgauacuguggcucuuucugccagcacaaggacugggagcggcaccaccgccucuguggucagaaccugcauggccagagcccccacggccagggccggccgcugcuuccuguaggcaggggcuccucugccagguccgccgacugcagcgugcccagcccagcccucgacaagaccucggcaaccacaucgcguuccucaacaccugcuucugugacagcuaucgacaccaacggacucugagccccggacucugcuuacccugauggcugcucagcaccacagagugcuugggcugagggacugacuguuggaacccgugcauguagcugccgggucaucagcaagaaaugaauuggaggcaggaagaguccaagccugaauaauaacaccccacagccucucugugcacuugcugucugcggagccagugugccauucucugcacaugggcagccagccugagcugccuccuccauggcuuuccugguuuguuccucucuccacugaagcugacuuagccggccccuuuucaguguagaccaccagcuccccuccccaucuccuugagucagcagacuguccaaugugcucagccaggcuggaggcggcaggcggcaggcagcaggcuguggaggaggccccucggucagggagcggccugccucaccccugaauagcuccuucggccccaucuccauccucagcagaugacacugauuggccucacggggacuuggguaagcaacaggcggcauucaggacucuucucaacccugcuguucagacuugauaagaucucagaguccacaggaaagaagucacuguugcaauaaaagcacccguaguagcaaaaacauaaaacaaauaaaacuucccccacaucacagaugauuuuggacaagauuuuccaaccuugcuggcuacuuuaguuugggaccuguuuuuuuucucauuugauuuugcuugugcagaaaauaguuuccagcacauggauugaucugagagagaaugaggcucaguuguggauagucuguuuucucugagcauguuggccaacuaguaucgucaaauuauugaguggaucaucucuuggaaaugcagaacuucugccaccacuuggcuauuugcacagucaucuuguucuguguccuuuuaucucucagaccacacacaucuggaacgcugugggcaucuucugcccaugggcuccauuuggcaccugcugagccacaguuguccugcuggaugugcugugcagguugguaggacuugcccccacugucaaggccuggucucaucugaaaagcccuccuggaccucaaagaauucuucagaccucauaguuacaggucauuauaucuacuauguugauuuaucaucaggcacacaacuucuguuuccuucucuuguguuaucugauagcgucccuccuugagcucaucagaaagguuuuaugaaaugugaaccauuuugggaaaagcugaucaauuuuucuuccuagcuucccauuuucaaaugggacaucacucauaucccuuucagaauguuaggaacugccucccacauucuucccugucuuuuuggguuuuguuuuuuguuguuguggugguuuuuuaacacaaagucucacucuguugcccaggcuggagugcaguggcaugaucuuggcucacugcaaccucugccuuccagguucaagcaauucuccugccucagccucccgaguagcugagauuacaggcgcccaccaccacgcccagcuaauuuuuguauuuuuaguagagacaggguuucaccauguuggccaggcugaucucgaacuccugaccucaggugaccugccuuggccucccaaagugcagggauuacaagcgugagccaccaugcccggccugucuuuuugguuuugaugggagucugaggaccccgaccccuccugcucuccaucuuugagccucuggcauccucucacacccagaaaucaguuggaguaaguuuaauuggcccugcuccagcuggccuuugaagcacaaguuuaaaucuccaccuucugugcacugaccagagucuaaaauaaaaguugucaguaccauaaaggaaaagggauccacacagguagccuucuccuuggauacagguacaucuuacuguaagaauuucaaguccuggcugggcgcaguggcucacuccuguaaucccagcacuuugagagaccgaggcaggcagaucacuugaggucaggaauucaagaccaaccuggccaacauggugaaacccugucucuaauaaaaaaaaaauagaaaaaucagccgggugugguggcacacaccuguaauccuagcuacucaggaggcugaggcaagagaaucucuugaaccugugagccagagguugcagugagccgagauuccaccacugcacuccagccugggcaacagagcaaaacucugucucaaaaaaaaaaaaaaaaaggcaaaauuaaagaauuucaagucccuaauuuacucuaaccaagcauuuucagucuuacaaagaaaucuagugcacgacaccuuuaaaaugccuagauuuccauugccuaaaguaaggugugaccagugaaacaacagcagagaaucauguuccuuugcuguggaacacauaagccccacaguuuuccagucagccuaauacauggguaucccccgaccccaucugccuccuuaagccacaguccuugguggggaacucuaagggggacggagucaguaccccggacagggccacauuugcaugagacauggcugucucacaggucacagagccauuacaacagcuuacuaguuuuucauggauuuguuggauuaacaccuuaagcagguuuuuuauuguuauuuuguuuguuuguuuguuuugagacgggaguuucucucuugucucccaggcuggagugcaaucgcgcaaucucggcucacgguaaccucugccucccagguucaagcgagucuccugccucagccuucugaguagcugggauuacaggcaugcgccaccacgcccaacuaauuuuguauuuuuaguagagacgggguuucuccuuguuggucaggcuggucucaaaccccggaccucaggugauccccccaccuuggccucccaaagugccaggauuacaggcaugagccacuguguccggucuugagcagguuuuuaaaaucuccaguggccauaaaacuagccaggguagcucaugcuuuuacugguuggaauaaggagccaaaaccaacaaaauaauauuuauuagggcucgaugcccauuucuguggcuaaggcuuagguuuggugugcagagccuggccugcucuugugggcugugguugcugugacaguuucguuuucugaaucuuuguaaugcucuuccacccugcucgugcugcccagaggcugaucugcaaaccugggcaguauuccacacugaagcucaguuugcaaaccuucugcuguguuaauucuggucaguuucacacagaagucacgagggccucugcccaggaccuucuauucacauuucaagaaucccuuucugaaauucuccaacucucuggucaggaggaggagcaccauuggggcgggguaggcagcuagaggcgcaggagcgaauccagguuccuugcgugguucccagccucugcugacagcaccucagcuaccagguggggaguggaaauucagccugcuuagaggacugaccucuacaguucauauuugcagugacauaaaaggcaaagaggagcuggcauggugguacagaagguaucagucaagcgcaggcucuucagaaaccuagaaacuaaaaagagaugcaacaugugacuggccaucagccagacaugucuagggugagaccagugcucagcaccacccgccaaggaacacugaugaguugugggacauuauggucggccaagugaggaaugauugcagggaccagagaagaccaaagaugccagauguccccagaguuucuugagggcuggguuucacgucuuugcuuguccuuuuuguccccacuugccugcaccgugccugacucauccaguggggaaggugacucaagaaguuguuuaagccuaggccuaggcaguccacuucgggaggugggggcacuccacacuggggggcccugcagcuccagggcuggugcucuagcagauccgcucaggcacgguugggugaccguggggucaccgauugcguagauuauuucuagggcagugcuggguuagaaaugucugucuggaaacaggacacaucuugccaccacaaguccacaccuggccuuggcugcugcccgcucucugcagcguggauuuccuuugcccauuugggccagaaggucaccaggaguucaucacugcuuagugucaacuugacaucuucagcuuccagacagaaaacccaugcuuuacuuuguacagcccugucccagaguuaguaagccucggcuugucaccugcuugcaaaggguauagacaucauucuggguaguucuagaggauaucgcaacaagugcguuugaagguucagcacagcuggaauuguacgguagugagcucuucaaaaugaaaacagaaugaccggauggccaucuguccuggaaacuguagaauugaauaaaucacugaaaauagaacacuucuuggaggcuuucuucagaacugaacuagaaacaagguuuccaggcucccaggucaguagaccaaaccaacuuccuuagauuuuuuuuuuuaagcuguuugcagaaaacugggugguagcgugucugaaccaaacggaagaauagccagcggagcauggacuguuccagcacgggccagauggccagcugucgagagcagcccugcccagauugcggugggggcugugccagcggcuccgcagggcccuuccaacucuggagugucuguaguucuugugaaaccaaaacguugacuaccugccucuuuccucgggcaucgacgugcucauuuccaaagaugauggugcaggugaccuuuuccaucgugagcuaagagaagguuaggaggccugaggggcgggccuuguguccccuccucccccuccacagccccugagguggagcuucccucacagaccccaucuggucgagccuacggcugcccaguguacacucagugaugcuuauaccaaauagggcaugugcgcuggugucuguuggggacagccccaucccuaccuuggagucggcagagaagcagcaauaagcauuaggcgaaugauugaaagggcugcugcgccaagaggccuucaguccccuuaacguggcuuuccaacuuccugacgaggcuacaaaggcuccgcucacaaaagaaagccaauaauguaaauaaauagaaaacgaagccuccacgcgugguuuuuaaagggggaugaugaaugugacaccacccacagaaugcauuagaaucugguuuuucugugcuuugucauuuuacucugauaggaauuuuuguuaccuaacucugugcauaacuuauuuaauguacuguauaaaugaaccaaaacuguuaaauauguauuuaguuuguucuacuuaaaguagucaauaaaaaggcuauauuccuu

SEQ ID NO: 191255 - RNA, 23971 nt, Homo sapiens
uuacauaagaggcacugauccuugcuuuauucauguagaaauauccaacauugggaaucguguggguguagauacaaaaaaaggaaaaugggggcauaaacagcaguuggguucaucguggcaguugguggcaguuucagccaguguguggguugagggcccucuacugcuuuacccaucacccuccacuguuuuagccaagguguuugacaacacuuggccuguacuuuaagggucacagugauuaaaaacaacacagucaagacauuugggucugagugacugcuccugagcugcuuaguacgaagucgggcaacaagaaagcgaggagcagcguguaugcccuuauccucagcaagugagaacaaggcagaucacagcaccgacacagaagauggccuucucccaugugccagcggagaauccccuuccagccaaauccucaggaagcagagcaccacacaagcagcauuucuugguuucucauggucauauucaaaagcgacuuuuaaaucagaaaauagaaaaagcauuuguggugggucuuuuucaaacccagaacacaaguuggcuaggaaaacggaaagcuuccucuggcaucccuguuuggacuccuccuccucuuggaggaguuuccugaaccgcacacacaucgcuuccucaccaagagagaugcucaacuaggaucuuuuuuagugugccaguuacaagacacauuuacaggcuauguuucuaagaccucuuaguggccaacgaggaaggaggguaccuagcaccuuguauucccucaugugguaacagcugggggaggacuuggcggugagguaguagcaaccauccccacauacggaaaagaauucaaaucuauggagucauucccuggacacugaaaacaggcaauccuccuaagucucaaggucccaccacacucgcgugggaggccgugucuacuuuaacuauguaucucaagagaagcagagaagaaaaauggcugcccagaugaagcgccugccauuguucaguuucucagucagagcccggcacacacuguuuuauaugguugguuucuugcugauuucaccaagcacauuuauagaaaagaaaacugaaggacaaaccaaauugaaagaaucacuguuauaauaacuuuaauuuaucuugcauuuuacagaagucuaugaacgauuuuaaaaaagcaccuccuuaccccauaucacguuucucugacagguguuaaaguaggcaaugaguaugucaacagcuugagcaucagcgucuugcaaggacuucagaccaaccacucgccaaaaaucuuggcagcuuuuuuaucuuguuuuuaauacaacgguauauccacucugauggcaaaccuguccagccacaucuccacaacaagcuuugcaaaaucagugauuagcaaauuaguuagcuuuggcacggagcugugcucgcuugcccgugacagccuggaagccgguuuugauacuggcaacagaacaucuagaaugacaaguuucgcacuguaggaaauagagucguguguccuucugcaggauuguguccggugaucggcaugugugacaagugacauauuccucugcaaauaaagcaacacacagaauuaccugguggcugcagugagguagagaaguuucugccuucuuaaauacaucuacaaagaacuccacaagcccaggcugagaauuuagcugggcacccagaccagggaagcgcagcuauucgagggguaagaaaacacaagcugucugcuguggcgcuuccggcacuaaacaugggcugauacucaaugccccaggaugcaaggaagccugccagcuugcuuauucucguuucugucuagaggagagccacucaaacauguugacagacaugccaauuuuaaauaacuaggaacaaaagggggccaaggccaggccugaaucacaggcaaguuucucugacuuggccuucagcccuacaaucaaccagcagcuucaaucagcugggcuuucuuuaaaaauccaaauccuuuucuaucuauaccccuaguuaguaggcaagagccaccucccuuucacuaucauuuugucucugaucuuuuuaaggccagcuuuucccagcucacugcaaucaaauggcucuuccucuaacacugcagccucaugagaacauuucagggugaucuaaugaaaugaauuauacacuuacugauauaucuucucaagacauuuucuaucuguuucuguuggaaucuuccuuugauuacaaguugguuauuaccaucuauagaaccacuaugaaagaaaacaaaaauaucuccauuauuauuguuuuuuccuaaaggaaccaaauuccagcaccuuuaaacuuaaugaacuuaaaauauauucaguagcauaggauaaacucuaggacuggugcuauacuacuugguuucccaaaauuuauuuauuuaugagacagggucucacacucugucgcccagacuggagugcaguggcgugaucauggcucacugcaccuucaaucucccaggcucaagcaauccucccaccuaagccuagcaaguagcuaggacuacaggcacuccccacugugcccugcuaauuuuuuuuuuuugguagagauggaggggucucccuauguugcccaggcuggucucaaacuacuggacucaagugauccucccacuauggccucccaaacugcugggauuacagguguaggccaccacacccagccucaaaauuuauuuuuaauuaaauaguuugcgucuaaugauguacccauacuaacaucaaauccaauuaaaucuccagugauaacaaucagauuuauaauugauuuuaagucuaaaacaaacugauuccuucauuguaugugacaguccauccaacaaaggaaaaaaucuuuuacugcaucauaccauguacaaagcaaggcaaaggagagaccuagaaauauaaaaacaggaaaggggcuacguuuguuuuuuaaaauucuaagcaccaaauauuuugauucaggcaugguuagaaguauaguugauaaaaauauacuaaaauugauugugguagcaguuauacauauuaaguuuaauaugugaucauacuaaaaaccauuggggccaggugugguggcucacgccuguaaucccagcacuuugggaggcugaggcgaguugaucaccugaggucagguguucgagaccagccugaccaauaugguggaaccccgucucuacuacaaauacaaaaaaauuagccaggcgugguggugggcgccuauagucccagcuacuggggaggcugagacaggagaauugcuugaaccugggaggcagagguugcagugagccaagauccacgccacugcacuccagccugggcgacagagcacaacuccaucucaaaaaaaaaaaaaaaccccauuggauuguauauauuauuuauauauauuuauuuuuuugggggggggggguccaaggguggagguuuaauaggcaaaagagaaagaauagcucugucuugcgagagagacggacguccgagugggacucuccuggauuauacacuuuaaauuuguaagcuguuaucucaauaaagcuguuugaagaaaaaaaaaggauaguugaaucacaagccacaaacugucaaugguacuuaaugauaaacugauaggaaacuguugacaggcacuuuugagaaagcaaagcucuaggcuagauauuaucauucauucaaaauuauaaaucauaaagugaaacaacaaaauucagucaagcaggguuaaauuuccuccuccacagauuguaacccuuaaucuccaggcuacagugauugcaaugcuugauguagaaauucuuuuucauucacugucaaaauaaauggaauuuucucgaaaacccauuuaacccauugaccauaaguuuacuggccacaacuuguuauaauaguuuaucccaccucuaacaaaaccucuagauuauucuaacaauagaaaaaacaaugcuagcuuuugcucccucauuaguuugugcaaguuacaaauaacgaugguaacaaauuuauauuuaaaacaugcugggugcgguggcucacgccuguaaucccagcacuuugggagaccaaggcaggcggaucacaaggucaggaaaucgagaccauccuggcuaacacggugaaaccucgucuacuaaaaauacaaaaaauuagcugggcgugguggcgggcgccuguagucccagcuacucaggaggcugaggcaggagaauggcaugaacccgggaagcaggcuugcagugagccgagacugugccacugcacuccagccugggugacagagcgagacuccaucucaaaaaaacaaaacaaaacaacaaaacccacaauucuucuacaacagagccuacguauccaccacggucaaguaaauuaccccuuaaccccacaccaaguguagcaaaucccaacaguuuaaagagaguaggaagagaacaccuuaauuaucucuguacugccagugacgcacaggugucaagccuguuaggugaucaagcugcagggacagauagaccugauuguaucuaucuugacugugccacuaacuagcuaugugaccaacuacaacuucacuuuacugaaccuguuuccgaacgugaagauaggaauauuacuuucuacuucauagaacuauugugaagauuaauugagauggcacccaaaaaagcacuuggcacaaaagaggugcucaauaugcauuagucaucauuaucaugaccuacucuacauuacuuauuuuuaaagggacauuaggcuuccagauaguagucaaacucauuggcaugggguccaugagaucuuggccuuccugaaugggaaugacuugcucagugccuucaaaaggugagcccugaagacagguaaguaccuauuucaucacagauccugguuucaaugguuucuccagugccacucaucaacuuacuagcuguauuucuucaacagccuguuaccaauuuaggaaaaaaaagucugacuuuaagaaaaccaauuccucuaaaaaucuaauauuugcuccauaaaaagacucaagaguuucaguuaguaacaggaaagucuaaacauggcaguucugugguccucugguugguacaccagcaggccuguucagaugucaacucugugcccuauuccuaagcagccaagcucucccacagaaaugaagugauuucacuccuccacuggccuaaaaguuucucuaauaaucaggugaacauuuucucuaaguguguuacauauccuuuucaagaaagguucuuaugaaauguccagcaguacuguauguaaauguauacaguuucuuaccuuguacccaauucagccaacaaaaaugcaaggagauguuugggcugacgauguaaucuaaaaagaaaaucaaaauauauaaaccuuaucucucauggaaaucucaccaaacuucuaaaaaaucuguucauuguuuugaucugugauuauuuagcuauuaagugaauuucacugcaccauuuauuuaaacuuugaaauaaagauacaguauaugacaccacuuuuuuuauuguuaagagacagggucuuguuuuauugcccaggcuggagugcagugaugaucauagcucacuguaaccucaaacuccugagcucaagccauccucccaucucagccucccaaguagcuaggacuacaggugugugccaccaugccugucuaauucuuuaguuuuuguguagagauggggucucacuauguugcccagacugguauggaacucauggucucaaaugauccuccugucucagcuucccaaagugccaggauuacagaugugaacugagccagauagcacuuguuuacacuucaaugcccauaagaccauauuacauuuuaugacuacauacaugugcguaagcaucuagaaacaaggauggaaaacaucaacaccgacuucagagaauaacaacuuccucugggaaggaaaaaggggccaggaaaagauacaaagguggccuuaauuauaacuauaaaaccaccuuuuucuuuuguuuuugagacuaucauaaaauagcauaaaaccuucuuuuuaaagaaguaaaaaaaucugaagcaaaugugucaaaaguucaacauauaccaaaccuaggugauggauacuuggauguuaucaaacaggcuaauaaauauauauguuaauccauauauauuucauguguaaaauuuucauuaaaagaaaguguaugucuagaaggguuccaugguagcacaacagaaaaauggaaacaucuuaaauauucaccaacuagaggagugguuaaauaaauccauucaaggguguauucuacuuuuagaaauaucucaauauacaaaaaaaaaaaaauguacauacacauauaaaauaaaaaacacaaauauagagcaaugccauucaauauuuucauuucauuuuuuaaaucuauacuguggcacugaacuuguuccaacaagcaggugcuaacuacaacaauuuuuaagcuuuuuuccccaaaaugcaauaggugagaacugguaaaaauauaauaaaauagguaagcuccuacauugcuagcgggaguaugaacuggcacgaccuugcuagaaagcaaugugcuaauguuugccauaaaaauauccauuccuuuuaacucagcaauuucaucuugccuuaagauucuauucugagcuacuggaaagauacauguauaaagauguucggugaaguuuugccucugauaauaaaaaccugggagcagccacguccaacuuauggaacuguuaaaauauguuguguagcuauuuaaaacacuuacucagacuaaugacaugaguaaaacuuucacaauauauugagaaaauagguuaaaaaccaguaugauagcaauuuauuuuuaaaauauguacauaaaacuggcuaaacagaaaaauauuaaacuaugauaaguuagcuaccucuuuuuuuuuuuuuuuuuuuugacagagucucacacuauugcccaggcuguagugugcaauggcacaaucucagcucacugcaaccucugccucccagguucaagugauucuccugccucagccucccgaguagcgggauuacaggcacgugccaccacgccugacuuauuuuuuguauuuuuuaguagagccgggguuucacuauguuggccagccuggucucgaacuccugaccuugugauccgcccaccucggccucccaaaguggugggauuacaggcgugagcuacugcgcccagcaguuaucuaccucuuaaugguggacuuugcagaugauuuuccauuuucuuuagcaugucuuuaucuucuaauuuuucuacaaugaguauauacuacuauugucauuagccaaaaaaaucuaaacuauuuaaauauauguaaguaaugacaacaagugguuaucucugggugguaaaauuuugagugaauauuaucucuuuuguguuuaccauauuuucuacaacaagcauguagcacuuaggaaauuaaagaacaaagaguggauaaacucagugguccuaaggaaacugccagaaaacaugcagcugaggagcucagagaaaagccauucccagacaguaacccagggcugacucuggcauagaaugugaugguaauuaagaaagauacaaucucaucaauuguguccuggcaaugaucauccaaggaagaggcacccaaauucaggcacuuucccugagcucacugcuugcuuggcaggccuauccuagagcaacugaugagccuuuccacucccugggcucccaaggcuccugagaacuacauugagccuccucacucuucacuacaucuaguuaggauccauccucagugggucagcaugaguugauuucucucaccucugaaugcacuaauaaaacaagcccuccugggcaacacagcaagacccacguuucuacaaaaaaaaaaaaaaauuuuuuuaaauuggucgggcaugguggugugcaccuguagucucagcuacuuaggaggcugaagcaggagaacugcugaagcccaggagauugaggcugcagugagccaugaccacuccacugcauuccagccugggcgacaaagcaagaccguuaucuuuaauaaaauaaaacagcccugagacuuaugaauugaagaaaaugacaggcuugaacggugaacucccucaaccccuacaccuguguguucuuuccaucuauaauaaagucgacaauaaggacauuuaacauucuuaaaacugcaaugagaaucuggcauuugggaugaagguacuccauuaaccaacuuacaguuuacagauaucuguaaaguugacaaaagaaguuuucuugguuccuacucggacgacuuguggagguuucaugacaaauuuccuuuucuccccagcaaccauaucuggauucuuuucccucaugauguugaacacucgauucagcagcuauaaaaauaaagugguauucaugaauacgcuuaguaacugcagggguauaaaguuccccuuugagucauguugcuuaacagcaaauacuucacuucugauuaaauauacacaugcauuacuacaagucugggagcuccuugagggcagagguucauccccaaccagcauuugguucauuauagaugcucagcaacuccuuguccaaagugaaaugaaugaacaaccacucauucuguuguuucuauggcaaaguacaugauacauggaaaaguaagauucaggaaagcccaaacuagcaaacuccagacuacccuggcccuaaauuagcuaauucaccacugcccuccuaauuccuagagggcugcaugcccucagcaguccacaaauucagguggggacagugaguaguacuacaaugacugcugcacucugggcaggcugccccacgggugcgcaccaggaauugcugugcacuggcugugugaccucucugcaucuguuccaccaucagucauuacuucaacggccguuccaauaagauuuaucuugcucuucuuugagcacuagugaauagcuuagccccuuuucacaacagauuuugucuuaccuccucguauguguagucucuuucugagccugcccaagcagggccugucugauuacugaaugagauaccaucaucuuuuuuguugucuucaucuucuagagcuacagauaaaaaagauuuuaagaaugaggggugggcccuacuacaauacaaaaguggggugggucuagagaaaugaagaguuucaaagacaucugucuucccuuccacagcugcauucacaacagccuuaagcauaaagaaaccaaagcucacaacccuuuuccuuagaaacagggauguuaugacuuucaaaaaaggcccuuaauagagaccucucuaauuaggaguugauaacauacugaaauguuucuuaauuuaacaaaucaaagauaaaauaaugcauuggaauaauuagaggaaaaaguccaacuguuuugagcacuuaagaaacaucaacauccauaaaacucaucuacugacaaaaguucucuaaagacccuauagcauuuagaaacuaauaaaacuguaaacacgaguuuaaaaaauuuuuuuaauuaaaaaaucggggccgggcgcuguggcucacaccuguaaucccagcacuuugggaggccgaggcggacggaucaccugagguugggaguucgagaccugccugaccaacauggagaaacucccaucucuacuaaaaauacaaaauuagccgagagugguggcgaaugccuguaaucccagcuacucgggaggcugaggcgggagaaucgcuugaacccgguaggcagagauuguggugagccaagaucgugucauugcacuucagccugggcgacaagagugagacuccgucucaaaaaaaaaaaaaaaauccgguuauaguaauuuucccaagccugaaucaguauguuuuuaauguaaucacaguuaacaaauucuuuaacugccauuaucaagccaaacacuguuuccuuucgcuuccauuaucagucaguagaaauaaggggcaagaaaaaaauuuuaaaagcacccuccacccccaucaaggagaccagggccaaaggcuugaguaaccucuaaaugugcugcugaguccucagcauuaccuucaucuuucucuaguauuucauccucaucugggaacuuaacauucuucuuuuucuucuuuuuauugccaagcauaaugucaaggucauccucugguucaguugguucuugaacaucacuuucaaucuuaagauccuaagaaagugagaugagucugaacauuugauacugggacuauucuuuuuuauuuauuuuauuacauuuucuguugagaugaggaggucuugcuuuguugcucaggcuagucucaaacuccuggccucaagagauccucccgcccuggccucccaaaaugcugggauuacaggcaugagccaccacacccagccuguucuuuuuuaaaaaugacgugggcugacauuauuuuggcagggaaaaaaaucacauauucaaaauugaaguuacagauaagaaacgccugucagaaauggaccaaacuggcucacagagacucugccauuugaacugugaauucuucaagacacuugugggaucuuucccccucauucaucucuuuauucuucagccuuaggaucuuauaauuauuguccuuauuuccaaaccaggcuacugucagaaucacggcagaggccaggcgucuuggcucacaccuguaaucccagcacuuugggacgucgaggcagguggaucccugaggucaggaguucaagaccagccuggccaacaugguaaaaccccacaccuacuaaagauacaaaaauuagcuggaugugguggcaggcaccuguaaucccagcuacuugagaggaaucgcuugaacccaggaagcagagguugcagugaguugagaucgugccaccgcacuccagccugggcaacaagagggaaacucugucucaaagaaaaaaaaaaaaaagaaucacuugagaaaauuuaaaaguuuaaaucggauugaugaucuucagcaggaacaggguucaggaguacuuuaaagaaguuucuaagugauuuugauauagucauugggaaagauuuuuccgggugacaccaaauauguguuuuuccacaccaacccuccaaugccaguuagguguccuccaguuuauuucagacacacacuauccagaguuaucaucagauuucacagguuuaagggcucaguuccucaagacugccuucacuucagaugccagucaccacguauuggguucccaugcugccugcuucuguccaacauggcuauaaacucggaaguucccacauucgccaucaagagucaauaauuugccaaaacgacucauagaacucaggaaaguacuuacuacugccaauuuauuauaaaggauacaacucacaaacagccaaacauaagcaaugcauaggacaaguuaugggggugggagcugagggguggcaaggagggcaggcguggagcugccacaccagggacaucacccuccuagcaccuugcugugcucaccagcauguuagcucuccgaacccaugucuagggguuucauuacaaagguaugaccaauugauuacauuauuuacuucuuauuauuauuauuuugagacugaguaucacucuguaacucaggcuggagugcaguggcaugaucucggcucacugcaaccuccgccucucggguucaagugguucuucuaccucagccuccugaguagcugggacuagaggcgcacgccaccacaccuagcuaauuuuuguauuuuugguagaaacgggguuuuaccauauuggccaggcuggucucaaacuccugaccucaggugauccaccggcccgggccucccaaagugcugggauuauaggugugagccacugcaccuggccaacugauuacauuauuaaccacuggugacugagcucaaucuccacaccuucccucucuggagguggcagggggaccacugaaaguuccaacccucuaaaaucauagcuuuguccuucuggugaccagcccccauccuaaagcuaucuagagauccccagauaagggaucccuuacucauuaauuaguaucuauuuugugugugccuacauccugaacugggacaauggcuacagucauuucagaaaucucauuagcguaccaaagacccuguuaucacuucggagauuccaaggauuuuagcaguugugagccaagaacguaaagaacaaauauuuauuuuuuauuauaugacagucagccuggcaccagucuguggcguggucuuugggcaucacuccaauagaugacauuaucaaagagggaaaggcagaagccauggggaauuaggaucaagugauggaauggaauggaaacaaaguaaagcuugaccccaagauuaguugccagaggcauggauguaaacagggcauauuaaaaccuagaaaugagucauaaacaucccagaagagcagaaaaggccagucucaguuuccagcuuucugauuucuccuuccuucuaccagcuuauccagcucccuauccugaacugugcugucaaccuuacucauucauuaauaucuauuuugugugugccuacauccugaccugggacaauggcuacagucauuucagaaaucuuaccagcagaaaaguuggaauagcugggaguaaauaaagcucagauucgggaucccaaauccaguuguguagucuuagugccacauguggcuaucaagaccaaucugccagccaggcgcaguggcucacaccugucaucccagcacuuugggaggccaaggcaggcggaucaccuaaggucaagaguuugagaccagccuggccaacauggugaaaccccucucuaccaaaaauacaaaaauagcccagcgugguggcgggugccuguaaacccagcuauucaggaagcugagggacgcuugagcccaggagacggagguugcagugaaccgagauugcgccacugcacuccagccugggcgacagagugagacuuugucucaaauaaauaaguaaauaaauaaaucugcccaugguauuagcuacauaccauacaaacaggacaccagauacucaccuagucucuaagucaauaaauaagaacuuagaaaugcugaauauaaguuagcauacacuagccaacuucuagugcuauacuauuauuauuuuaucccaguaagaucuacuuccauauugacaccaagacacagcagaagguggagaacagcaaaaaguauuuuucuuuuuuuuuuuuuuuuugagacagagucucgcucuguugcccaggcuggagugcaguggcgcuaucucagcuuacugcaaccucuaccugcuggguucaagcgauucuccugccacagccuccuaaguagcugggacuacaggugugcaccaccacacccagcuaauuuuuguauuuuuaguagagaugggguuucaccauguuggccagauuggucuugaacuccugaccucaggugaucugcccaccucggccucccaaagugcugggauuacaggcaugagacagcacguccagucugcaaaaagcauuuuucaaggcuuuucaaaagcccucggauggucuggaaauucaggugggagaguagcccaagaccucaaaaacccuucaagugaauguccgugccuugccugaugaccaggauaccucuaacauccucuuauguuaugccuucaaaaauaguauucaagcacuuauuuagaacuaaucuuccaauaaaagcuacuggaggaaucaaccaacaaagccuuguuaaccaaaacuuucuguagcacaucucuacaugucgcccuguuacccaggauauuuaaaucccauuucugauuauaaucugagcauuuuucucaauuucccuauaguagaaggaaaagagaauccccaaacagggagagaacaagaugaauccagauaaaaccagcuuguucucaaggauucuaaauuauccuugaaccaaaauaucucugcaaacaggaaaaauaucuuacucauuucaguacucuagcaauuaccacacaauacuucaaaagcuugacuugcuguaaucacucauacuuauuuacugaauuaacugucauaaaauuaugacauuauuucuaaaacccaaugaauuacuguauacauuuccugcuacaugugggauguacuuuauucacuugaguuugagcaaauaaacuacuuaucaaagaaaauuuugaguagagggcacaagauauuugguguauguuugcuguugugugugugcgcgcucuaugugagugaguguguguacugcuauuaucuuggguuuuauaaauagacauguggauucugcuaaagugauuccuaggcagggucuuuaaaaugguaacucuagggaggaaaacagaucuucagcuccuuccccuuucauccauccaccuacccucccuccuauucaccuuccugcccaccuguuacuuacucccuguccaaaagaauuuugagauauuuguauuagaaaucaauucaguaauaagacucacagggucucaaguauccacaagaucagagaacuccauaaaacuagccugagugcucugguuugccuacaggccacauugucaucagcuaccaaccaccacugugguucauucuuugcugcuuagagguacacauaucaauuuguauauauucaauauguuaccaaaaguuuaagaaaccaaaggaauauuugcucagaaggauuucucacucauagaaauaguucuccacagccaaaaaucucaguauaguuaaggacaagggacauuugugaucaucuuaauggcacacaauacaauauguaagaccuaaauuuaaauuccuugaaccacaaucccuuuaagauaccuagucagacacacucccaagaaaaugacgcuaccaguggcaauuaagugcuaauaacaaaagcaaagcuaguaagagaugagucaaagagagggaaacaucagccauuagcaaccuugcaagaggucaaauuuuaccuucaacaagaaagcaauacuaccuuuacaccuucuucagcuucaucaauaucaaauaucuuuuuaguuuuuuucuucuuuuucuuuugauuaaagaaguucaagucaucuagaucaucagaagcaucuaaaaagaccaaggcauaauuauuaacaacuaaaaggcaaagcaucaaauuaugaguuacacaaacauaguucagcaauuaaucaagucaccagaaaagacugacuauuaauuagucccuccacaaucacaaaacuuaugguucuuuuuuuuuuuuuugagauggagucuugcucugucgccaaggcuggagggcaguggcgcaaucucagcucacugcaaccucugccuccuggguucaagcgguucuccugccucagccuccugaguagcuaggacuacaugcaugugccaccaugcccagcaaauuuuuuguauuuuuuuaaguagagacaggguuucaccacguuagccaggauggucucgcucuccugacuucaugauccgccugccucagccucccaaagugcugggauuacaggcgugagccaccgcgcccggccacaaaaguuaugguucugaaaaacaaaaugguaggucaucucaaagaucuauaggaaaaaucugguuaggggaccauguugagaauauuuauuuaguaaucugaccauaucacucuucacuguucccaagacaaagucagagcucuaacacaauuuccaacucuccaacuuuaaaucuuccacuucugcuucuugccuuccucacuucaaucccugguucuaacccuacugaacuacuuucaguuccuacugcaauauacgugcggucucucaccaacaaaccuucccgugggcccucuuaccuccaucucacaggaucuugguuaaauuacuuccaccaaagccuucucuaagcuuauccaucuuuccccacaacuggguuagguauccccagagugauuggauaguaucuucugcuuacuccaacugagguacuuauuaccagcuugcuuaucuaucucccuacucaauacuaagaguauaugccuuguucaccuaaauucuacugucuagcucaacauuuuauugaaucaacuaaucaucaaaaggccuaacaaauuauuucacauucauuaaaauacagcugugcaguaaauacaaguuaucagugaaauuuuaccuaccauuaaugaguaauaauagguucuguucaacaaguuuuccauuugaccugccauguuauaaacuagaaauauuuuaggauccuucugcuacaaaguuuuucaagaaacuauuuacaaauccauuuuaucuuauuacaacaggaaugaguuacuuuccaaauuuguuuuaaacauguagaagacacuuagcacagggcagaugcucagugaaugucaguugucucuauccuggcacaguguuauauucaacagacacauacaauguuuauagaaacauuucucucuaacagucaaauuaugucuauguuacagcacagggguaaguaacuaaagcuggugucuaaccccaaauacuuuaggcuauaauuuuaaucucucauauacauuuucagacuugcuaagacacaaaacugccuaucuuaguaccauuucuuucugcccacacucaaauacaacuaccauuaaaaagucagagaagagaccugauggguucaacuggaaaaccagcucuggaacagcaagguuucaucuuugcaacuugugaauuaaauggaaacaucccugcaacaagccuaucagaaaucuaaaaagguccacugcauacagacuacugauggccuugacuucacuggaacagccuugucaggcugagaggucgcugcauauccaaaagccaaaacgcucauagaaccagggcuucuaugacaacaguaacucucucacaucaaccacgcaccuuuuuuccuaguguccucuucaucagcuuccaaauccuuguccucaguuggcucuggcuccacuucuuuuguuucugaaggcuggguuuccucuguuuggguauccccuuccucaucuaacauaaaaggcuucuucuucuucuuuuucuucuugcucauaguaggaucaaaaaucaucuguuuaaaagacaaaaaacaaaaagggaccaaaugauuguuuuuaaugaugcucacauuccaaauaugcuuuauccucaaaaggcauacucuuaaaagaguaugugauacauuaaaacaccaaaggggaguuuaccaaaaaauaaaauaaauuguccacccaaccuucuuguuacuauuaaacaucaggugaacugaaacauguacacaucuuucaauuuguaaaguaucacagauacuucacuuucacuuucaugagcaaauuuggacauuugaaugaaucauggaauuuagggaagggacuuuggcaacaaccuaugcuaugccccucacuuuacagauauaggaaaacaauaccuaagcgggguguaaauuuuuuuguauuguuuuuucuuugaaacagggucucacuguugcccaggauggagugcaguggcaugaucacagcucacugcaaccucaaccuccuggacucaagugauccuaccaucuuagcuccccaaguagcugggaccacaagcaugugcuaccaugcccagcuaauuuuuuuauuuuguagagacggggucucccucuguugucccagguggucacaaacugccaggcacaaacaauccucccaccucggccacacaaagcaauggaauuacagguguaagccaccgcaccuggccagggguaucaauguuuuauucaaggcugguaacuuggggcuguuacacagagacuugagagacuuuugaccugauuaaaaaaacaaaauuuuuuuuaacuacaaaucuucaaggaaauccaucagcaacucuucauauagcaaaucucugaguaagagaaaccucuauacaacauuucacucugcuuuuuguuuaacauuaaagguucuuuuuuuuuuuuuuuuuuaaaugaaacagggucuggcucugcugcccagguuggagugcaguggcaugaucucagcugaauccaaccuugaccucccagacucacaccauccucccaccucaauuuccugaguagcuggaauuacaggagugcaccaccacacccagcuauuuuuuguauuuuuaguauugaugggguuucaccaugcuccccaagcuggucuugaacuccugggcucaaaugauccaccagcuucagccucccaguguuaggauuacaggugugaggaccaugccuugccccaaaauucucuuauucuuaucuaaauguccacuauagaguaggugaaaaacuaauuuauaauuuguagacuaucugcuugcacugaucacuugaagaaagaaaaguuaucuagacauaauaguuuaaacaacauacagggcagacaccugauagaguagaaagcgcaggaggcugggugcgguggcucacgccuguaaucccaguacuuugggaggccgaggcgggcggaucaugaggucaggagaucaagaccauccuggcuaacaugguaaaaccccgucucuacuaaaaauacaaaaaauuagcagaagguggcgggugccuguaguccuagcuacucgggaggcugaggcaggagaauggugugaacaugggcaguggagcuugcagugagccgagaucgugccacugcccuccagccugggugacagagcaagacucggucucgaaaaaaaaaaagaaagugcagggucuuugaagucaaauagaaccugauucaaaucccaaguauuuuuuuccugaaccccuuaccaaucucucuccauauucuauuaauaccaugcuuaaauucagcauuuugcccagugaucugcuguggacagcguuaauaguaaaguguuuaaaagcacaagucuggagcccaucugacuagauuuaaauucugacucuggcuuguaccuguguuauuccacggcucauguguaaaauggagacaaguagcagaaugacaacaaaccacacaagguuacugggaggguuaaagaaguauguaaauguaaaacacuugccauagugccugguacguaaguacucgauaaauauuagcaauuguaauuuauauaauacuuuaccauucauaaagcaugguuuucucuugauuccuaucacugaaauuucaucaauucaggugcucuaauuucccaaacauauaaaacucucaaaagcuucccaaaauugauuauaacauaaacuuauuuaugucccaagaucauuaauggaacuagacugaaaccaagcuacagucuguaauaagguaauacaguuacuguccuugcccaguagagaaguaugguauuugcauagcauuuucaaaguuagucuuuucucccuuaacaaggauccaacuguauaaauaauuaaaucugaaaugcagucagucugaagaacauuaucuggccaacuuaaagaagugucccuaccaagauagaagagcaaagaggaaagagucccccacugcaaggaguacugcaauaauacagggaaguagcuacauuucaucuucauucuagaaauagggagacuuggcaaaaggacagacaaaacucuagacacuauaaauuugguucuggaagggauuaccauccauuuauugcauuuuuucaagcaucaaguucccuagaauauuaauugccuuuuaaccauuauucaucaagacagacugaagauggcaaggauccugauaucaccagaagacagccucacaagugccuucuuauccccugaaaaaccuuauggucuacagcuaaacaguuugguuguagccuuguaaaggauaauaaacauccaggaaucauaaacugaaauaauuaacaucucucucaauuacugucuggauacuuaacauacauacucauugccuuauuuuauucauaccauccugcgaaguacaguuuacaaauaaggaccagggaucccgaagcagcacccaaagcagaccuccccaaaaaugaggccauguuagucuugacuaaaauggcuuuuuaagacuuucaugucuagcuuccaaauuauaagcugacuacacuccaaauugguuuucuuuuaugaaacuaguuuggauuugaaaagcaaauagcuguugacagugcacauauggaaaacuacagaucacuugaguuauauuuuagguucacaacaaagccuucaaaagcauaaauuuucuauuuucaacuucucacguuugauuggagagggcaaagaaaagguauaccagcuaaaauuacccugaugcucaucaaauuagaagcuuccucucauagaucauaccuuacccaagaaaucaacuuuauagucauacuauacccagaagcaggugugagucacaaaagaacccacagagaagcaagacauugaucuaaaaguuccuuccaaaggugaccagaacaaaugcuaaguguugccaucucugugugauaggauugugggauuuuuuuuuuuuuuuuuagggacgggagucucacuauguugcccaggcugaaauguagugacuacucucaauuguaauuauagcgcacugcagccucgaacuccuggccucagccuccugaguagcugagauuacaugugaaugccaccaugccuggcuuagauucugcuguuuuucuuuguauucuuuuguguuucauuaacuucacacaacacacaucccauuuugaaucaaauacuuuuuuuuuuaauuuaaagcuucuuuuugcaaaaacaccuuaccauauuuuaugaaaacccaauguucugacuccuugugaaugggaccuaguagcaaguaggcaaguauuaaauauugaugcugcuuuuaacaaauagucugaaaauuacugaaugccuauugaguaggggauuuuucuuuucccuuaccagguagcagccauauuucuaggauucugcuuuuuaaagaucaugguuccauguugggaggcugaggcaggaagacuguuugaggccaggaguucaagacaagcuugggcaacaaagcaagaccucauuucuacaaaaauuaaaaaauuagcgggugcaagagcaugcacguguagucccagcuacuugcgaggcugaggcaggaggauccccugagcccaggugacagaggccacagugagcuaugauugugccaccgcacuccagccugggaaacaagagcgagacccugucucuaaaaaaacaaaacaacaaaaacaaacaaaaaaaaucauaguucuacuagguugaaaaucguuauguuuuggcaaguuucuggcuuaauuaccagguuuaaaaauaaaugugugcaguuuauuucaauuauacaucaagaaaaaaaaaaaacaaaaacagaaggcugggcauggugguucacgccuguaaucccagcacuucaggaggcugaggcaggcgaaucagaaggucaggaguucaagaccaacauagugagaccccgucucuacuaaaaauacaaaaaaaaaauuagcugggcaugguggcaggcgccuguaaucccagcuacucaggagaggcugaggcaggagaauugcuugaacccaggaggcgguugcggugagccgagaucacgccacugcacuccaguccagcgacagugcgaaauuccaucucaaaaaaaaaaaaaaaaaaacagaaauaugaauaaaacagaaaauuacuuuuuaauagcagccucuuuaauugucuagccugaccaccaggcaggauuacuuccacucugggaaaguccuuggcaguuuauaaaucauuuucaaguacagaguuuuaucugauccucacaagucuguacaguagccagauguuaaaggaauggccuaaaaauacuuaccuagucaacagcacuacaggaaccaggcccuauacccuauucuucauaccccucucuacuccuaacuucuaccuggcagaauggaagccaaagaccaggguucuuguccuacuaacuuucugcaugaucuuggacaaguuaaucucccucggcccugguuuccuguaaaauacaguuggaccggcaccccuaaguggccaaacuaauacuuuauuggcuuccaaaguccuaugccgaaaugcugguucugccaucuuugcuucacaaaauucuguucauccagcaguaaugcauucauauuccacuucuuucaaagccuaaucccacugaucccucuagcccuccaagucacuacguugaugguccuauuucuaccuugugugucaucuaguugacccauacacagaauaacaccccauggaaucuugcacacguaaguacuguauuugccaaagguuaugagaaguuugaaaaaugaguagaaacaaaacaagugugaaacacugccacucucagaacuuuugaaauacagcagccuagagcaaugucuauaaccgccaaggaccauauacaaacuuucaguuucucuaacccauuaagauccuagucaaucuggaauucuacugguuuagccacuuaguauuugaucaugggcauuauacaacucuguaacacucaaauuuuucaucucuaaaaugggcacaacaauagaccuauuuuacaggacuguugugagaaccaaguaagagacuggaaucccguccagaauauauuccaaauuccuuaacuucgucuucacagcccuccaugaacuagucauuaccugcuuggcaaguguucaccccuuaacucuaaucaaacuggagauuauucuacuuccugugagcacauuuacuggccuuucucgaccauuccuuugcccuugugaucaaggcuuccuauugccugaggaaauucucaacaacuuacggggccucccccaauguuaagcaauaccuacugggaguacuuaacaucaacuucauuuuaagucguuagacguuauaucaacuaggauaaaucugagggaaagggauuugaggaaauucacugagauccaaguaccacgguaaaaaaagauccagccaguuucacagcccgcacuucccgcucacgucgccgguagcccucuguuaagggaagcucaggggcucgcccggaaacuuuccgggaaggucagucacuuccugaggcugcagaaucuuuuucucucguucuaaccccaucacccccucgucuuuuuaaaaaacaaugcuaggaaggcaaacaagggcgggauaccggccccgacaagauagccuagaaaguuuuaacgagggcguuauaccaagccaagagaggcuccucgcggcaccccuggcacccccggcacccagugaggcgagcuggggcggcagugcccagcagaaaggaaugcagggaucgccagccccagucucguucgggguuauuaaccgggcauucgagccccuuccgggaggacgacucaacgugugcucuccauuccggaaacgccaaccacggcaggagguccgccucagcgcugccgcccugaggaaagcgggcugcggccaagccugcggcuccggaguccucgccggcucugccgcuccgggccgccuaggcgcggcugccucacauggcggcggccggcugcuaggccgcaggcccguucucccacacuggaguggguuaggcuucucgccucaauccuuagcccuuacgccgggcucagauccucaccucguccccagacauggcugcggcucgagugggcucggcacggacgggaagucagacgggucagccccaggccccggcggcagcgcugccccugccgauaccucucccaccaccgcacuaggcucuugcaucagcgaaaggaaacgacaccccgcccucuccuccaagcguuggaaaugcgccu

SEQ ID NO: 191256 - RNA, 27366 nt, Homo sapiens
gaggccccgcccccugagccuggguagcggcgcgagggccgggagaaccguucgcggaggaaaggcgaacuaguagguuggggcggccacggcggccggcaugggucacguuuccucgggaggaacgaugugagggaggggucuggcaagagauuggaauuccggaggccgggagaccuuguggcugaaacccuucguaggagcggggcaacuagugucuagugaggggguugggcuggcgcgcacugaucccagacuuuccggaucuucugccuuuagaucgggccggugucggggcauguaggccagugagacuggagccaguuagagcuacaacggggagcgauuagggccaaacuuuguccaggguggaagcgagcgggcccgugaaguggggccagccugggcagccgaccgugucguugccucggggccuuuccaggcacuggccuaaguccuggcgauaaagugcgaccgauuuccuugugggcguuuugaggcuuucggugaucugacccgucugucauucauucuucauucauucaugugaugaaugaauacaguacuaagcgcggcuaauuacuagguagagaagugaucaagacaaacacuguuccuacgguacagggaaaagugaugggcuguagaauguagaagcccggggcggagaacagggacagcuuccggaacgaaaucgcgagcccagaucaggagugguggcgagaguuccaaagagaagacagcacgugccaaguccuggaagggggacagaggccaacauauccuggucacugaagacaccugacucugaaucuguuucacgcccagggaagagaugacaguggccggggcuaggcuacaaacucuggaaauggagauaaauaaaggaauucaaaguacuauauacuuaggcagcaaaauccauaggauuuggggagagugagauguaggaaacaaguacucaaggcuuggguaccugggugggguucaucagagaagaagcagauuugugggagacaacaacaaauucuauucugguuguauggagacucgcaggaaaaaauuggauauucuaguuugaagguaggaaaguauugcugugaagauguagauuugaaugucaucagcaaaacauaaauaaagccaagggaggguugaggcuguagaaugagaaaaacaaagggcccacuuagcaccuucaucugauuucuuuucuuucuuucuuuuuuucuuuuuuuuuuuuuuugacagagcuuugcucuuguugcccaggcuggagugcaauggcacgaucucggcucacuacaaccuccaccuccuggguucaagcuauucuccugccucagccucccaaguagcucggauuacaggcaugcgccaccaggcccggcuaauuuuguauuuuuaguagagaugggguuucuccauguuggugaggcuggucucgaacucccgaccucgggugauccgccugccucggccucacaaagugcugggauuacacgagugagccaccacaccuggcccauggugauuaucuuuaugucuuauccuccuccauauccccaguaccuagucaagggaguggcauuaaaugcaaaucaguguuugccaacuaaauaaaagcccaacagcaaacagauguuggaauuucagaguuguggaacgaugggggcucauggaggguuucauuacucuaaugucaagguaauggguucuuguccuggcucugccacuaggcuucugugugaccucugacaagucuccuccuaccuauaaagagaguacagccaaaaaauggucucauguauagagcuucaaacacugcugauaaauuucacacugauuuuucucuuuuaauccacacagcaaucuuacuugaaagggaagucggcugggcgggguggcucacgccuguaaucccagcacuuugggaggccgagagugggggaucacgagaucgagaccauccuggcuaacacggugaaaccccgucucuacuaaaaauacaaaaaauuagccgggcaugguggcaggugccuguagucccagcuacucgggaggcugaggcaggagaauggcaugaacccaggaggcggagcuugcagugagccgagaucgugcggcugcacuccagccugggcgacagagccagacuccgucaaaaaaaaaaaaaaagaaagaaagagggagggagagagagagaaagaaagaaaaagaaggaaggaaggaaggaaagaaggagggaagggaaagggaaagggaaaaggaaggaaggaaagaagggaaagggagaagucguauuauuauggacucaaacccaggucugucugucugucugacuugaaccuuguucuuuacuaugauugcccucauguaugucucacucaacagggauauuaucaggacccucuugagaucacaugcgcauucuuucaaagcauugugcugaggcuggcagacuuucauaauuggccuggcacuggcucugucauggggacagggggacagagcugaaugugauggagguuuccuauuauucucuaacucccuuccuggggaccacugaguugggcaaccauguucuguuaaauggcaacagggcagaacaaaauuagugacuguguuuccagauuuuuacccagaucuuaaacuccugaggccugcugaaaaaugaaugaguaucagggugugaguuuguacaccucuguaugucucugggcaaccaaucagacaacuucuccuauuacauuggacacuuggguuucagcaauuuccaucuugcuaaugugauuucucaaaaauauuuucugucuuuuggugcuuugaugauaaauguccauauauggaauguagucauuuccugcuacuaagauuccuucugguuuguauaagggaggaguucaccuuauucgcauuucaugguauuccacaaagagcucccucccccuucccauguaauuuauuugagaucugcugacaugaguuguuggagcuugaagggaauuaauaauguacugcagugacuccuaucccaggaaaacuuguuaaaaauacaaagccucggcugggugugauggcucacgccuguaaucccaguacuuugggaggucgaggcguguggaucacaaggucagaagaucaagaucauccuggcuaacacggugaaaccccgucucuacuaaaauacaaaaaauuagccaggcgugguggugugugccuguaaucccagcuacucagggaggcugaggcgggagaauuacuugaacccaggaggcggagguugcagugagccaagaucgagccacugaacuccagccuaggcgacugagugagacuccauaucaaaaaaaaaaaaauacaaagccucaaccccuccuucccaucaggccucuugcaucagagucucugggauggggcccaggaaucuguauucuuucccagcuccccagaauguucagccagguuuggaaacugaucuauccgauucuucuuguuucacaguuagggaaucuguagcucugggaagggaaggaacuugccccagucacaucugauauuagugcuucuuucuccaaugaagagccuuuaggcugggaguccagagacauggguucaaguccaggcuauaccagucaucaccucgggcaagucauuucaccucuccaagccucugcuuccuuacugugagaauaaugccauuguguugggaaucaaaagagagaguggcaauggaaaugcuuugucaagcuuucuauuuugugcacauggaaguuguuaagagcuagaaccagccaguguucacuccuguauaccacgcuguucccuuccaacagaggucaggguccugcuguguuggggguggccgccagccaguuucggugguugcugggcuucaggccaucuguuaccaacucucuucucuccaucuuuugcagguguugggauggccaccaacugggggagccucuugcaggauaaacagcagcuagaggagcuggcacggcaggccguggaccgggcccuggcugagggaguauugcugaggaccucacaggagcccacuuccucggagguaagccccuagcuccuccccacagcauucaccauggcccacugucuggccccggccaggcugagggucacuccuuugcaucagggaccauaucucuuuugccuuauuuuuuccaguaacuaaaauugaucucuagaaguagaaaauaaaaaggcaguguccuggaguaaucaaauuuaaauaugggguuugaagugugacuuaggcaaauuacuuaaccgcucucagcugcaguuucuucagguguaaaaaugggauaauaauaggaccuaccucacugguuugguaagagaauuacaggaugauucaugugaagcacuuugcccagugagcuauuacugaaaaccccauaaucacucuaccuucucuguaacugguuugugauauaugcuuucaagccuuucucugugcauuuauauacauagauagguauauauagaaauacgucuuuuuuaaaaaacaaauuguaucauauauauuauucuaugauauguuuuugguuuuuuauuugucugucuuagaacuuucuaaugccuucuauuagggucaucuucauucugaggcauaguauuccagauguggguguaucacaguuuagcuucccucuacucaugucuauuuaggugauuucucauuauuuuaugaccauaaauagcauuauagggaacauccaugcauaugucuguuggggcaccuaugugaguguuucuccagguucaauacguaaaaguagaacugcugaguccaaaccacaccuuuuuaaaaccucauccuuagggaagaaaaaaaaauaaaaaaauaaaaucuuuuuuaauuuggugacuagguaagacauuuucaugguucaaauucaaaugguacaagaguuuacccuaaugcagcuuguguuuugguuucuuguugauccuuucagauggcuuauucauaacaaguaacuaauaacaaguaaauauauuccuuggggccucgcucuguugcccaggcuggaguguaguggcacaaucuuggcucacugcaaccuccgccuccuggguucaagcaauucucccaccucagccucccaaguagcugggacuacaggcaugugccacuacgccuggcuaauuuuuuuuuuuuuuuugguagggacaggguuucaccauguuguccaggcuggucucaaacuccugacuucaagugauccacuggccucugccccccaaaauugcugggauuacaggugugaaccaccgugcccagccuccuuuugcccacuuuuuuuucuuuaacuuaacaguacaccuuaagaccauauuggugacuaaagagcugccaacaucucuucuuuuuuuagccagacccauucuuuuuugucucugugugcccagaaccuacacaggccugauggaguccacacucaguaauuguuugcuaaggcccaaguaaaugacaaugucugucaccuaaggcaggcugaugguauggaauagaauugcuugggcugugaaccuagauuuugugaauuacuuguaugaaucuaaaaugaagcauuuucucuuccacgcuuuuguuucuucuguuaaucaauagguaccaugugaagauccaacacuuggucuuucugggagguuauggagccuagaaaaggcguaauccacaaugagauuucuaauccagaaaaaaagucagaaaguguacguguguguguaugugugugugugugugugugugagagagagagagagagaaugauuuuacuccaaaucuuuaccaaaugccugcucuaugccgggccauuguaggcacugaggacagagaggugagucagccagagcccuagccucuggggcuccuggucuaguuagagaacauaccacaaaacaaaauuaaauaacaucagcucuaugaggaaacacaggcagucugcuacacaaaguuaacuaucauuuauugaguauuuaguaugugccaggcauuauucuaaacacuuuggaaucacugacuccucaccacaacagagauaaggaaaccgaagcccagagaggcuaaguaaccuaccugagguuauuuaaaugguaaaauaauuggcagagccaggaugugaacccaaggaauuuggcuccugaguccaugcucugaacauccaugcuuuuuuuccucucccaagauacuauauaggacagcuggaagaaagaguaguucauuaugauuagaugauugagauggggggugguauuugaacuagaccuuaaaagacaaauagggaaaaggaacagcauagcaaggacccaaaaguaggaaaaggcaaaaaaaaaaaaaaauguucaagagaaugcagcugaaaugcagggcgcauaaguggauauagugggaaagaaggcaggccagcgucagacagccgcggggccuuagcuacuggguggaggaggaguaugaacuuuauccuguagaucagagcugcaaacuagccauaucuaggcugaguauuuggcuccugcaguguuuggggaguuaauuuguuuuuuacaauaaguaauacguucaaauacauuugaacagggcgcaaaauucaaaaggguauucaguacagaguaaguccccuuccuccagccacuguuucccugaccaggggcaagcauuguuaacaguuguuuucaccagaguauuuuuaaaaagucagagccaacauuuaaaaaaaaaaaucaugaaauuaaaacaaaaaaucuagcaacccaacuugucuugaaaaauuauaucaucuggcaacucuggccuacuuuccugcauggcaacaauuggcuagagcagaguucuggcugcccccuuuagagaagaugcaaguacuucuuuuugccacaauuccuaucacucccuguugcuuccuggcuacaaagcagaauuuugucaugcacgugcuauagguuuuuuuaaauaguagaaaaauguuucuuuuuuuuuuuuugagacagagucucacucugucgccaggcuggagugcaguggcacgaucucagcucacugcaaccucugccuccuggguucaagcgauucuccugccucagccuccagagcagcugggacuacgggugugugccaccacgcccagcuaauuuuuguauuuuuaguagagaugggguuucaccauguuggccaggauggucucgaucucuugaucuugugaucugcccgccucggccucccaaagugcugggauuacaggcaugagccaccgugcccggccaguaaugucauuuuauguuaaugucucuaucaaaagugagaagacuguguguuucagccuuuagccuguagauagcagagaacagcuauaaacuauugauccuaaauucaggagggcauaaugagcccugggacagaggcagagggaugucuuagcagaaaaacucugaguuuuugaggccaagaugagacuuguugggggcagcagagcucuauguguucaagccaaggaaaugcuccuguagucaucacauagcuacucaggguauuaggucaccccuuauguaaucugcagucauucccauucuaacucauaaaggcuucagacugaauaaaccuuauucucacaaauagccuuccucaguuuuaucuuagaugcugaggccagggcagugguacacaccugcagucucagcuacuggggaggcugagacaggaggauugcuugagcccaggaauuugaggcuauagugcacuaugauggcaccuaugaauagccacuguauuccagucugggcaacauaguaagaccccacuccaaaaaaaaaaaaaaaagaugcugagaaggguaauuuagaaauuaucuaccaaaauuuaaaauagauuuaccugaauuacuugauauuuuuacuuuuagaaauuuagaauguauggacuuucucauauaugaaaauaucuagaauguauauucuaggauacccauugaaacauuaaugguaauaggaaaauaaagaaaccaccuauauacuagauucaauaaauuaugguauauccuaagaguagaauaauauacagcaauuaaaaauaaugaaaaugcucuauuugaacauauaaggaaauauuuaaaaagcacaauguaguauaguuugcuaugggggugaaaaaaagagaaaauauauguguauacauauauaucaauacaaagaugacuggaaggaugugugagacacuagucugucauuugccucuggggaggagaacuggguggcuggggcccagucuuuuccccaggagacuggaaugagagugagacauacuucucacuauauauucuuaugucucuuuugaauuuuguaucauguauuuguauuaccuguuaaaaaaauaauaauauuuuggcugggcaugguggcucaugccuguaaucccaacacuuugggaggcugaggcaggcagaucacuugaggccagguguuugagaccagccuggacaacacagugaaaccccaucucuacuaaaaauacaaaaauuaccugggugugguggcacacaccuguagucucagcuacuugggaggcugaggcaggagaauugcuugaacccaggagauggagguugcagugagccgagauuguaccacugcacuccagccugggcaacagagugagacucuaccucaaaaaaaaaaauaguacuuuaaaaauaaauaucuaaauaccaaguucuaacaccguaaacuuauaccaccauaaugacaaacugauauuaacucaaagguuaaacucaggaaugcuuuauaauacaagucacaagauuuucuuuucaucucuuacccaaguucuaguucaguuguuggcagggaucucagaaugcacuuuucccuucuagaaucaguguccuugaugguauuuggguuucucgucuaugauaaaguccaaagaaugcggaaugcagcugaacucuaggccuguuaaccugagucaccaucacuaacauugguggaaaaaacacuccuggcuucuacuaagggaaccagaguucacuuguccuacccaguaaccaaaucaaaaucaaaaggcaaggaaacuggagugugagcuccugaugcauggaagggccugggcuugaacaucaaccagcaaggagcaggcuuccauguauguauguguguguuguguuuaguaaccauccugguucaaaucccagcaccccguuacuagcugaauauaauuuuggaucuguuaacuguucugguucaaaucccagcaccaguuccuagcugaauauaauuuuggaucuguuaaccucucuuucucaggucccgucucuguuaaguguggauaauaauaguaucuuccucacagggcugaaugaugaaucuauguaaaguauuuaaaauaguaccuugcacauaguaagugcucaauaacuuguggguuucuuuuuguuauuugcauuuugcuuuuuugcuucucucucuucaauacguagagauaaacuaucacagaaucuggaagcucucuggguuccacucucccccuuccacucucccaagguaaccacuaaucuacaguugguguguccucaguaaauauaggccagacuuuccaugggauuccauuugcaggaagacaacccguucacaggugcccuaccccugucccauucucucuucuugaucacagguggugagcuaugccccauucacgcucuuccccucacugguccccagugcccugcuggagcaagccuaugcugugcagauggacuucaaccugcuaguggaugcugucagccagaacgcugccuuccuggagcaaacucuuuccagguaggggacagugaagcauuggggggccaggagcugccagagccaaggaacuggaagauugcagagccgugagguguuacugugucagcugacuuggugggauagaggaaagguaccuccaaagaacaaaaagucauaggagucaggaaagcuggcuucuaauccuggcucgaccaguuauuuauauggccucaagccacucccuuuccuucucugggccuaagguuucuucaucugaaaaaugaagagacuggcuuaaauccaagaucccuuuauuguugacauucuguaauccgugacacccuacuuugaagacugauauuuccauuuggaauuaggggaagucagccugguuuuggaggaaaacagagguagggaagguuauuggguuaaagucagauuuucuacuucuccuaagcagcgacacuuucuugucaccucaggccucucaucuuuggaugggaugggguacagacugggccacacucagggcaugaggaagcaaccucugaaaugguucagcccauccgcccuucucugucucuuucccuugaucuuuuuuuuuuuuucuucagauucuggggcaauuucuuaaaauuucuuuauuuauuuuagaauuaaauauauauaggcugggcgcgguggcucaggccuguaaucccagcacuuugggaggccgagguggguggaucacuuaaggucaggaguuugagaccagccuggccaacauggugaaaccccgucucuacuaaaaauauaaaaaaauuagcugggugugguggcgggugccuauaaucccagcuacuugggaggcugaggcaggagaaucgcuugaacccaggaggcagaggcugcaguaagccaagaucacgacacuguacuccagccugggcgacagagcgagacuccaucucaaaaaaaaagaaauaauaauacauauauauauguauauauauucauuguagaauuaaauaucuagaaauauuauguauuuacauauacaugcuagauguguauauacuguacagguugagcaucccuaauccaaaaauccaaaagcugaaaugcuccaaaauucaaaacuuguugaacaccacaugacucuaccaguggaaaacgccacgccugaugucaugugacaggugcagucaaaacacagucaaaaguuuguuucaugcacaaaauuaauuaaaauauuguauaaaauaaucuucaggcuaugaguauaagguguauaugaaacaaaugaauuuuguguuuagacuugagucccauccccaagaugucucauuacguauaugcaaaucuuccaaaauccgaaagacuucuggucccaagcauuucggauaagggauauccaaccuguaauugcaugucuuugauuaauuuuucaacagaaauuagacuuuuguuggagacaaaaucuuuuaaaaaugugugggugaauaugagaaggggucauaaugguaagaagcuuggaaaccauugacuuguagccaaaaacccaaugagucaugaauguaugaaucugcccaccaccuugccccugagcuguuucuuggaaugggcccagcuuuguaccugcaauccuggauugugggaaacaugagcagccuggcuuauaacccuaaugaugcaauuaugaaggagacuugcagcucaucuuugcaaccccugccuucucuguuccucucuccucucauacacauauaaacccuaguuccuaagggagaagagcccccuacaaaacaugaaggggagcaccucuucagaaaaaggaaagugugucucaacuuccuuggaggcugaagcccagcugggacucuccuccuaaccaagggcuggcaugagagagcucacccuugggagagagcuggcugaggagcagaggaacuucagggcaggccugggcuacuuggcuuccccccacuggucugcugugacguuucuguaacaaggugauucaggcuugagcaggugugcagaauccacccugaaucucaaagggcaguaagugugauguuaaucaccuguggauuccuucuuacuguggcucuuguugagacuucagaaaaccauacuggauaggccccuaacacaugucacaugucauggcaguacacugagcugugacgaugagccugcauagacacagccauuaccuucaugagguuuauagucaaacaggagagaugacacuaaucaucacacaaagaaaauguaaaauugcaacugcagucagugcuguaaaggagugguucuuaguucuaugagaacacauaguagggggaucugacucagauagggaaggcuucccugaggaaaucacaucauaugaggacuaguugaagaagaaacaaacaaacaaaaaaaacccaggauauuuagcuugggucagaaaaaucuuauuggugcacagggcauaacugcugucuucuaaucuccaagggcugcuguggaggaggaggagaaggcucacccugggaggucgcagaggguaggaaaagcuauggagaguuaguauuaggucaaccagaaggcuugccaaccaucagagcuauucaaguagaauagauacaucaugucauuuucuagcucuucuucggugcaguauguucaauucuuugaauguaauaucuuauuggcuuuuuaccacaacucuaugauauaaauauaauuauauucuccauuuuaaagaucagcaaacugagacacagagaggugaaaugauucccugagguugccuacuagugagugguagagcuaggauuugaacccaggucuagaguuggauucuuagccacuguucucuaccacauuggggcggacauucaaguuuuggccaguagacucagagaggauucaggagucaaugacugaggaugggacuccuugaaauuuuagguccaauuaagccugcaaaauguucucuguuucuuccuccagcaccaucaaacaggaugacuuuaccgcucgucucuuugacauccacaagcaaguccuaaaagagggcauugcccagguaaccauucccagcccuacuccagucuguaaccugucccucccaucucuguuuguuuucuguuuugcuugaagaauuugguccaggcccucagcucaugggaaucugccucucacugguccucacuggguuuaucccagugaccaauucuaggaugaccagaagaaugauuccacugggcuugggaguguuugcugguaccucuaaucucuguguagaguucaugguaccugugugcucuguggcuagguccucagagucagucccugggcagguacugucagccuucaguuuuccccacagacuguguuccugggccugaaucgcucagacuacauguuccagcgcagcgcagauggcuccccagcccugaaacagaucgaaaucaacaccaucucugccagcuuugggggccuggccucccggaccccagcugugcaccgguggguccccugggcagcccccggcauaccuguggggugacaugcugauggguguacagucacuggcuaggccagggaacuccagcuaugauugugcuuuccugggccccgggucacauguugccccuggccaccccgacagcaguuuccacuuguaaugagauccuugguaugucagggagaaaaaggaccucauagcucaucuaguccugucccuccauuguacaggcagagggaacaauaucuugagagccccagagagaggaaugcagggacuucugucugggggcugggccugguagcauccauuucuagccagcagugaugcuccagguugcaaugauuuuagauggucugcagcaggauuccagacagcaccuggaggcccagaguaaggggcuccagcucacugggacacuaggguagguugggguggggacagaggcucucaggucuccuccaggcauauacaccaggggccaagguuagggcagcccagcauauuccaaccugaaguggaucuuacaggaaugugaugggaggaugcuuuuuagugcucagcugauucucagagucauguugcuguauauaugaggucaugggcagaggggucuuccagguccauccaauuacugaacagccaucucucuuccaacagacauguucucaguguccugaguaagaccaaagaagcuggcaagauccucucuaauaaucccagcaagggacuggcccugggaauugccaaagccugggagcucuacggcucacccaaguaagggugugaaaagguagcaggaggauccugcuuuaguuucagcauucauggguuuagcaacuucuuuucuugccagccaucauuagagaauaaggggauuuuucuaggaauagaaacuuauaccuuuacaugccaaaauuauuuuaagguuuccuucuuaaauaacagaugcugacuaugauuuaacuuuuucuuauugaguggaggucaucauuaugacugucaacaauugcagcuugcuguaauacaguagugcuaccuaggguuagagaggcacgcaaggcuguuugccugcgcuaauagcucugacugcuaggcuuuaaguucuuagucauuuccuuuuuuuuuuuuuuuugagacagagucucacucucucacccaggcuggagugcagugguacaaucuuggcuuacuucaaccuccaccucccggguucaagcaauucuucugccucagccuccugaguagcugggauuucaggcgcaugcugccacaccuggcuaauuuuuguauuuuuaguagagacgggguuucaccauguuggucaugcuggucucgaacuccugaccucgugauccgcccaccuuggccucccaaagugcugggauuacaggcaugagccacugcacccggccucucauucauuuucuucauaguuuucuugucuguuucccaauucucagcucuuacuuuugacugcuguugguaugcuugaauuuggaauccuccaccccccaugcccaugccucccuucugauuugcugugguuugggaaaacaaaugauccagauuguuaugauugggucugaagagugugagggccucuuggaugaguaaaugcauaagcuuugacuacgaaauuuuaugguauccuuuuuaacugcuuagaggcauuuuuugcuuucuuccuauuucucaagugaagauguuagguaagugauuuucagaucaucgaggggccgcuauacuaacaguuauugcaauguuaauauagcauuaauaguccuuaauguacacuuacuagugcuacaccuugugcuaagcucuguacauacaggaucucauugaauucucauaauaagcucucugaggucaauacuguucaacucccucauuuuacagaugaggaaacugagguucugagaaacgaagugaauuguuaaggcuaagugaugaguugguggcagaucccaaagucuaccucccucuaaaaccuccacucuuaaucaugcucuuaccuccaagggagccucucuguccuugcuaagccucacuaagcccaaagaaaccucagacuguaagcauuuagaagucaucagacaaauauucuuucaaguauauuggcuagguuguauuuuaagagagugaagccaggggaugggucagcuggggaacugcugacagacaaaugcugcagaggguuuugccugccagccugucaguaacguggacagaaaauacuuguguguccaaaauuaggcacugguagguaggaguuauguggcaccugagccagaacuggcuucccccauugugagagugagauagguucuucugcugacauagcacaugaccuuggcaaguuaguucuucucugagcuucaguuuccucauuuguaaaauaggaguaauaauaauaccuaaagggguguuagugagaauuaaaugagaucauggaucugaaaaauguuuuuaaaaaucuguguggaucauuaugugguacuuucaauaauaauaauaggccgggugcaguggcucacaccucuaaucccagcacuuugggagaccgaggcggguggaucaucagaggucaggaguucaaggccagccuggccaacauggugaaaccuugucucuacuaaaaaauacaaaaauuagccaggcaugguggcaggcaccuguagucccagcuacuugggaugcugaggcaggagaaucacuugaacccgggagguggaaguugcaguggccaagaucaccccacugcacuccagccugggcgacagagcgagacuccaucucaaaaaaaaaaaaaacaaaaaacaaacccaaauaauaauaauaauagcuaucauuugacaaguauuaguuuuaauucauacaacagcaaacugaggcuaagagaguuugaauaacuugcccaaaguuacacaaccgguaaguauagaauucaucugccucuaaagccuauguucucucuacuucccuauucugccuuuaagagauaugguuccacaguauugacugaaaaacugcauugguagagcagauuaauuuucgucaauuaucucaugauuuuuaaaauuucuuaaaaauggaagccugcaaaaugacuuacaauuucaauuuagacaaacucucaaagcauagggccugugguuagaaugaguagaauaagaaaaggggacuacuggugauaaaaguuugggaacugugaucuuuuuaacaccaauuuuuuucuuuuuuuuugagacagaguuucguuuuuguugcccaggcuggagugcaauggcacgaucucggcucacuacauccuccaccuuccagguucaagggauuuuccugccuuagccucccaaguaacugggauuacaggugcccaccaccacgccuggcuaauuuuguauuuuuaguagaaacgggguuucuccauguuggucaggcuggucucaaacucccgaccucaggcaauccgcccgccucggccucuuaaagugcugggacuauaggcgugagcuaccaugcccagccauaacacucuuauuuuauagaugggaaaaccagggcccaaggaacgaaauugccuuacccaagucaauuaccaagacacacuacaagucacuggcagagccuggacuaccuacgacucagggguccucacccccagcccgcaugcguccuuagcugacaacuuuccuacuaggaaacagacugcugagaacugcucagaacugaaggcaggagaggucaaauauguuuucugagcccagcucugauuguuuagcaguuggcaggcugacuuaauuagcuggggcgugcaguuccucuuuaaccuccagcugccagccuuccuccuccgccucuuuuuggaggugggccagccugggccaacugccucccucccacacacacccucacccaugagcgggacaguuuaggcugcaaagugaagagcaaagccauuggcccuuaggacucucucagggcaagaugacuugugagagcaccacuuuuaguuugucucucaggcacccaacucaaagccaagacucagcuuaacaucacaucugaccucaugagauuucaggcaaaccaggagaggggacuuacuaagaccuauauuuuggcuaagcagaaaggagucaggcaaacagaguuuagacuaagagguucagccaaggucaggagaagcagagauagacaagagaggcuaagcagaggaggucagggaauacacacuuagaauccuaagccaaagccuaggguuccaugggucucaggaagaagccacagacacaaagcaguacagucacagcaaaaauggaguuuggaggcugagcgcaguggcucacaccuguaaugcuaacacuuugggaggccgaggcgggcagaucaccugaggucaggaguucgagcccagccuggccaacauggugaaaccccaucucuacucaaacuacaaaaauuagccggcggggguggugcacaccugaaaucccagcuacccgggaggcugaagcaggagaaucgcuggaacccaggggguggagguugcagugagccuagauugugccacugcacuccagccugggcaacagggggagacuccgucucaaaaaaauaaauaaaauaaaauguaaaagaaaaaaaaugcaguuugguacugcugagcauuagcccuaggaaucucuuaggggacuggaccuaucuuugacaacggaaauauguuagcuggcagccaaacagauaguucccuggcauaagcuuuucccugagcccucaagccccugccucuuuaagaaauacaugaauaaucagagaggaagaagccacauaagcccuagugaucucauuaauacuaugagaucaaauguggcccuguguacauuauaggaaucuugggagggcccaggagauaaugucguuguuuguaguuggcccuguggguuucuguaggguuccaucuuguguaagaaccacauuccuuuauuguauccuuuacaaucuaguaauagagccauuagccccggacccccugcauuguucuuuuacaaaauguuccucaauacucccacuuguuuauucuuccagaaagauuuuagaauuauguuaaguucuaagaaaaaguccucuuggguuuuugagaugguuuuaaaucuaaauuuuaauuugcacagaaauucaucaacccaugacaucauuacaauauuucaucugcccacuggagaagggucagaggcaucuucauuuuugaaguuuucuauuuucaggaaaucauaugugauagcaucaggugucuaugccugagguaaucucaagguuccugagagagggaacaucuguucuuucagggaagcgguguucuuauucuuauuccaggagguggggcgguauggggguugaggggagaaacaaaagaagaacaaguucuauaguagccucgggccaccugugcucuuuccccagugcucuggugcuacugauugcucaagagaaggaaagaaacauauuugaccagcgugccauagagaaugagcuacuggccagguaaguaaaggaagggggacuucuagguguggcuccaggauuagggguggggcacucagaacauagcauccauucccucuggcucuugcccauuuuucccaggaacauccaugugauccgacgaacauuugaagauaucucugaaaaggggucucuggaccaagaccgaaggcuguuuguguaagcauucccaagaauccaguggaaggcugguuuaugaaacucauccugccacccucuuccccaaaaugauucuuucuucugggagaugugauggcuugcuuccuucucucauaauuccugaaauaucucauccucccaggaaauuuuggagaaagccagccacgcugugcuucuaucagagcuguugacauucuggaucagggucuccuuagagaucaucuuaguuuucauaugcccuaaguucccaaaaguuuucuugccucuccuaguaaggugaggucaggccugagaagcugagcugggcagucagggaggaagaggagcagcuggcucaugcugugauuggucuggaugccacugucugagcucgagccuggauuuguguuccaagccaagccuuauccuuuucucuaggggccaccaccagguagauuuggugcuacauauuuggguagcauugcagcacauauauuuagaccuagaccuuugugauuguuaaaauuaaaacuguccauggaauuucacaauaccacucacuguuuuucaaaaugugcuuuuaucauaacuaaacaaaguaguuaauuuacuuuucagauaaacuagacaauaucaaauaggucaaagaaaaggaaaagacauuuaaaaagccugugucuuaaucagacucaucauuuuacauguuugcguuuucaccuucaccccugccauuaaaaauuuuuucauucugguuucagcugcuuuaagcaguggaaauauaaaguguguuuuacuacacauggcaguaugauucugcugcucgguaauuucgagccaacauuuguaugcauuuaccaaauuugauucuagugaccuucuuguuccuucuggccuucuuagaaugacucuaaaucuggcauauucuaaaguauucuguauggcacaccucccuguuuucaguggaagcccugguaguguggauaucuacuuucacugguuccagugaaccccugaccaggcucccacugugggcugaauuuugaaaaagccaaauucaucuugaugcacccugaaauagauugaaccacugaacaaaucaguuauaauuuaacacagcagccuucuccauccuguguuccagggauggccaggaaauugcugugguuuacuuccgggauggcuacaugccucgucaguacagucuacagguugguauuuucugugagaccauucuuugccuccugggacccacaagagcuccacagagacccaauucaggcuuauaacaaccuggguuuuccgaguccucacuucacuucuuucucagggagcuugcugcuagaaccuccuauccucccucaagccuuuugcuaccuaucacucuacacagucuucuagaauuugaauccucaggaauccacagagcuucagccauuuacacuguuuccagagaugugcuggcaaauguuuaacaacaaucagcucucacugguugauauaagccaguuccagcauacugcugaccauuuuuuuuccugccaacucuuaccuuuccuuuaucugaaucagaaaguuuuaucaucuccucauucauguuaaugacaguuauaucaccucauuuugcuauccuaccauguaguuucauuaguuuccacauccauuauuucauuuaacccucacaaccacucggugaggcauauaauuauccccauuauacagauggagaaacuaacguuuagagagauggagaggcuucucuaaggcccuacaggaaguucccagguuuucugacuuucaggccgaugguauucccauucuucuccucugcuccuaacauccacaucauggagaggcuaagaagcucugcucucagcugggagaugauaaaggaggaaauaaguuuagaaauaccaugggcagugagcuggaggucaugagcuugacugccucugugugaugaugggcaaguuccugacccuuucuaggucuguuucuaugagcggggggagcuacacuagaaaacugagggggcuccuucuaggucuguaauucaucuaggacuccccccgaggguugagcuccacaugaggaggcucuauagaggugguaucucgauagaacauccuuuucuuuagauaggugguuagcagugguggcaacuugcugacuacaggagagauaaacugucuauuagaaaaauaggucuaggccgggcacggugguucacgccuauaaucccagcacuuugggaggccaaggcagguggauuaccugaggucaggaguucaagaccagccuggccaacauggugaaaccccgucucuacuaaaaauacaaaaauuagccgggcgugguggcauaccccuguaaucccagcuacucaggacgcugaggcaggagaauugcuugagcccgggaggcagagguugcaguaaguugagaucaugccacugcacuccagccuggcugacagagcgagacucugucucaaaaaaaaaaaaaagaaaugggucuagauuucaaaacacgacaaagaaaacuuagaagaguuugagauaacaaggaaggaaaguaguguuuaaagagguagacuuuuuuuuuuuuuugagacagaguuuugcucuuguugaccaggcuggaguacaguggugcgaucucggcucacugcaaccuuugacuuccaguuucaagcgauucuccugccucggccuccugaguagcugggauuacaggcacccaccaccacacccagcuaauuuuuguauuuuuaauagagacaggguuucaccauguuggccaggcuggucucgaacuccugaccuuacgauccacccaccuuggccucccaaagugcugggauuacagguguuagccaccacaccuggccaagagguagacauuuuuagggaacugagcagcucagagcagguuuagacauggagagagaucuagaaggcuuagugacuuacuagaugacccugggcaaguccuugcuuaucuuugguuuugcuuuccugcuucuaccauaaugggguauuucucuggguuuauuucugauguucuggucacgugugauucugcguggaaugccagacuaguaguuggguuccugggguuauugaugaagaucaggucaaggugcuacagguggaccaguaguaucaaaggaaggacagcauugggugggggucacaggagagaccugauccugcugugugcaguuugcaguggucuggagccaaggacagacugucuccccauugcaugagaaugggaaccagaguugggaggcaugauccccugcuguuuccuugccuuuuauacccucagcucuugugguaauaaaccauucauccugugaucauccacuugagaccuguguucauauuauucucuuagccugaguaucccuucccuauugagucucacuugucaggcucuaccuguccuucagaaccccacucaaauuucaacuuauucagcaacaacaacaaauauuuauugagcaacuacaaagugccaggaacuguguuagacacuggagauacaacagaaaaugaggaaaaugauaagagcccugugcuauggagcucacagucuggucagagaaaugggcaucagaaaguaaacaaaaauauggccauuuacuguggcucguaccuguaaucccagcacuuugggaggccuagguagguggauugcaugagcucaggaguucaagaccagccugggcaacauggcaaaaccccaucucuacaaauaauacaaaaauuagcugggugugguggcgugcaccuguagucccagcuacuugggaggcugaggagggaggaucacuugagcccaggagguagaaguugcagugagccaagauugcgcuguugcacuccagucugggugacagagcaagacccacgucucaaaagaaaaaaaaaguaaacaaaaauaggaaaaaaaaauugggauuuguguguguauguuugugugcgugugcguguaugugugcauguguguguuuuagucucagguaacugcuuucaaugaaacaacuggguaaaaagagaauuaugggaaauccacauuaaauagaguggacagggaagccuucucugaaaaggugacauugagcugagauguaaggaugguaaggauccagcuaugcaugggaaaagccgaaaggaaggggguuucagguugagggaaaagcagugcaggcccugaggagggaaagagcuuugugauuugaggaaugacaggccugugugaguagaauggcagagacuaggagucagggaugguacaagguugaaaaaguagacaggagccagcuccugaaggaucuugaaggccaugguagggaguauggaacacagugggaagcugagcacguagacaaauguucuacccuuacaccuucuauuguuucccacagauugggggauucuugccuuugcaggggcucacagucuggcacaaugauacauaacuacaacauaucacaccuggcucacaaggauguuagaaugauccugggugauaaugagggugaagauacaaaucaugauaccuggcaccuaauggauggauguucaguaaacgucagcugaaguaaaauaaagucgaauuccuuuugucuucuucccucugcagaauugggaagcacgucuacugcuggagaggucacaugcugccaagugcccagacauugccacccagcuggcugggacuaagaaggugcagcaggagcuaagcaggccgggcaugcuggagauguugcucccuggccagccugaggcuguggcccgccuccgcgccaccuuugcuggccucuacucacuggaugugguacgugggcagccuguuucuccuaccacaggccuccuagguggcagagaccuacagcccaauguguuggggaggguggagcuggcauugugacaaggggaagguggagcuggcaagguuggugaugcucuggagaaccccuagaacucugagcagaagggcagccucauaauggaaggaugggggcuggaauccauuguaagcucccucagcaaagguagagaugaggauggcaaccagagggaagggacuaaggcagguggcaagaauugagaaguguaucaggcugccugcugcagagcccugagcuguugcuaaagaaaggccuguucucauugcaucggcugcugcaggggguuuguugggagugucauccagauaguagcauccugccugaaggaauuuguggcuguucucccuccugcucuuccucugaugcugcucugcauaaccagcuggaccuaagcuucuugccucuuuagccuuuaaacuuuugauaacugcuuucugccuccugccagggugaagaaggggaccaggccaucgccgaggcccuugcugccccuagccgguuugugcuaaagccccagagagaggguggagguagguggaucucccuuugcagggcuccucaaugagagggacuagcaggcuguggccagugcucauuggcacuuacucugggcacagucccgggcaugggggaaacuauuggaacugacacaggccacauguuggacaguguccccuaagacccugugaccaaguccgggagcacaggggaaucugauuaaccagcauugaaggguuuggacaaguuuuaccugaggugccuguggguagauuguugggaaguagaguagggucauauuaggagacuggagagaauacaugucuguuuuccuuucuaguuugaaacuccuugaggucaggggucaugucugccucuccagaggagaggauuuuuuuaaucuuugucuuaagagguggguaggaauuucccagguggaaaggaggaagaguguuccauacaaaagggacaaccucaagccaaggcaccgggccaugaaagugugagauguuuggagguuaaugagaaacuggugaggcuggagggggagcugggaggggacagggauuuaggcuggaaaaaugguuugcauccugauuauaaagggccuugaauauauacugagaaauuggauuuuaucuuaagggcagugggaagccauuagggaguuuuaagccaggaagggacacauugauccaggacucaagugguuagcaguggugggaacuugcaaaacuuacaguuucugcauuguagaagauguccuggaaugaggggagacacuggaagcagaaagaccguggaagaggcugauacaguuguucagaagagcaacguagaggccugggcuagggcuaugacuauggggccaacuggagagacauguccuagauagugagaggguaguggaagggaggaguuaaauaugacucagggguaccuuuugccugauugggaguaggaagguccaggaggggcagguucaggcagaaguaauaaguucugcuuggacaaguugaguuuguuugggggccagucauaugaugucuaagcagggagccugcauuaaauauuuggaaguuaacaauuuuuuuuuuuuuuuugagacggauucucgcucugucaccaggcuggagugcaguggcaugaucuuggcucacugcaaccacugccucccagguucaagcgauucuccugccucagccuccugaguagcugggacuacaggugugcgccaccacacccagcuaauuuuuguauuuuuaguagagaugggguuucaucauauuggccaggauggucucaaucucuugaccucaugaucugccugccucggccucccaaagugcugggauuacaggcgugagccaccaugcccggccggaaguuaacaauuuuuaggguauagauggagacucaggaauaggagagaucuccuugggaaaauguacaugggggagagagcaagcguggaggaccaauuccccugggaccccagcauuuaagagaaggagccagcaauggagcuugagaaggaacagcuguagguaggaggagaaccagggcagaacaguguaguggaagauguguucacugcaugaguaagggcucuccugucaaagugagcuucccuccugagaagccagauaugcccuggcuucacugagcgggugccaggaacugaggcugcugacuugcccauguggccccaaaagugagggcaugggauggaggagguaggcagaggguccagggugacuggccaguuucauugcagguaacaaccuauauggggaggaaaugguacaggcccugaaacagcugaaggacagugaggagagggccuccuacauccucauggagaagaucgaaccugagccuuuugagaauugccugcuacggccuggcagcccugcccgagugguccagugcauuucagagcugggcaucuuuggggucuaugucaggugagccaaucaggagaagcucuuuccacuaccugcuugcaagagugccagccaagugagccagccuagaggggaacacuggaaagagucaggaauccugggcuucggugccagcucugccaaucacuagcuuuauuaccuguuucuuuaucuauuaaaugaggccaaggacccaagaccugcccaccuuaccaggguaucagaugaagcccugaugagaaguccuuugcaaccgugaaggaaacuccaaauagcaccaagaggacucagaacacaugguuugacaaccuaggacuagaaggagacuccagagaggcauagagacucuaaaauccuagcacuuucuugguauagacaguuacccagguacugcucagcuggguccagggaagguccuggguuuggggcugaguccaggugauguguguccccugccuccauuucuauaggcaggaaaagacacucgugaugaacaagcacguggggcaucuacuucgaaccaaagccaucgagcaugcagauggugguguggcagcgggaguggcaguccuggacaacccauacccugugugagggcacaaccaggccacgggaccuucuauccucuguauuugucauuccucuccuagcccuccugagggguauccuccuaaagaccuccaaaguuuuuauggaaggguaaauacugguaccuucccccagcuuuccaucugaggaccagaaaaguugugucucccuuagaugagaucuagacgcccccaaauccuugagauguggguauagcucaggguaagcugcucugagguaaagguccaugaacccugccccacuccugucagccccucaucagccuuuucagcagguuccagugccugacuugggauaggacugagugguaggaggagggggaguggaggggcauagccuuucccuaauucugccuuaaauaaaacugcauugcugauuca

SEQ ID NO: 191257 - RNA, 90412 nt, Homo sapiens
ggccgcuugcuuccuguuuguccgacgaggagacauggcggcggcgccgguagcggcugggucuggagccggccgagggagacggucggcagccacaguggcggcuuggggcggauggggcggccggccgcggccugguaacauucugcugcagcugcggcagggccagcugaccggccggggccugguccgggcggugcagguacgaggcuggaccaggaggggcggggcggggcggaccaggcgggagcuggcggggggccggggaagaggccuuuccaggccgccgcuggacgggccaaagcccuuuuggcuggccggaaggccucccugugagcugcccggacgcucucagcugcagcggggccgugggaagcagcuggcuugaugucccuugucaggggccgagcggggcugggcugcuguggacacugauggcguguacgaacccugggcccaguuucuggauccucccuucuuugcgccacgucuacacgucugggggacccugucguguuuguuuuagccucugugggccucgaguuuaucccguguauugggcgugggggagggggucaucauugcagcccccaaaugguucccgagcauuucauaaaugucauuuucucaggccuuuccuugacacucuuuccuuccccuuucuaaaguagguccccauuguuauucugucacagccgcgaauucguuucguuuacauuacuuucuuagucuauaauuucguauuucuuuguugucugccuuuuucucgcccgucucccacauuaggcugaguuccagcgggugcagagacuauaucugguuugcuaguguagagcgucacgguuaagagggacucuggagucaggccuggguucaaagcccugcuccucucucuugcuugggcaggugaccuuucugugccucaguuuccucacuuguaagaugaagaugagaauuaguaaccuaccuuuuaagauuguuguggagaucaaagggggcaauuguguaaagcauuagugcauuucuggugcauacuaagggcugaagguaguuaauauuaagcaucugacuuauaacaggugcccaacauaugauuauuguuauuuuugagugagcgaaggacacugcuuuaggguaaaccagguugaauaggaccuaguccacuacuucuuccacccucccccaccccgaaccuugcuaacaccuguaaaacauuagcuuuauuuaaagacagcuuuuucauaaaaaguuugaaggauacucaagaaacugauaaagugguuggugggagugaggugggaauugggcuaaagggggagaaaaugggagugagacuuuucacaguguaacuuuauuuaaauuuaauuugaauaucacuuccucaaaugacgaaaaggauagaauaaaauaaaggcuagggggucuguguguauggaggacuguggacgaaaggagcaguugugagugagaaauguuuuccuggccaucacacaaccauagaugagcagccuuuuucccccuuguguucuuaagaccugacuuaagacccuguaaucccagcacuuugggaggccgaggcaggcagaucgcuugaauccaggaauucgagaccagcccaggcaacacggcaaaauccugugucuccaaaaauuuagccgggcauggugguggugugugccuguggggaggcugaggugggaggauuaccugagccugggaggcggagauugacagagugagacccugucucaaaaaaaaaaaaaaauccuagaaauacuugcucuuuccuucuuaagcuaagauaccuuaccgagcuggguguguagagacaggcagaaagaggacuaacuuuuagugagcacauaaccuuuagaaaaaguacgguacaaggcauauguuaucuuuaauccucaagcuuuugaguuaugcuucaagacucauuucuuaauauggaugaggaaacugaggcucagagagguuagaugauauguuccuaaacacccauccugauaaucaguguucugagaauaauagggagccacagaaguucuuuagcaugauaaaugaggcaauuuaggcaacuuaauuuguuuccagugcugaaugacuuagaaugggaggagccuagaaaagcccaccagaggcugggcacaguggcucauuccuguaaucccagugcuuugggaggucgaggcggguggaucaucugaggucaggaguuugagaccagccuggccaacauggcgaagccccgucucuacuaaaaauacaaaaauuagccgggcguggugguaagcaccuguaaucccagcuacucuggaggcugaggcaggagaauugcuugaaccugggagguggagguugugagcugagaucacgccacugcacuccagccugggugacauagugagacuucaucucaaaaaaaaaaaaaaaaagcucaccagauacaaggcugcuggaauauucuggagccacaaaagcaaggcagguuauugugguaacugaugguuguauauaggugugggagcuauuucagaaguugaaguagagacccccugccuggagcuauagugaggauaaaauggggaccuucaucuuucaaauauuucuuuucuuaguuuuuuuuuuuuuuaauuuauuccaugcugugcccuuccgcuccucucucccauccugcagaauaaguuauuugcuuacccuuuuuuuuuuuugagacagaaucuugcucugucacccaggcuggagugcaguggcaagcucaacuuccugggcucaagugauccucccaccuuagccucccuaguagcugggacuacaggcgugugccaccacaccccauuaauuuuuguaucuuugguagagacaggguuuugcucuguugcccagauuacccauauuuuuauacuguuauggcaugugguauaguaggaaaagaccagauuuaaacauuuuuuauuuuuuauuuuuuagacggagucucgcucuguugcccagacuggagugcaguggcgcaaucucgguucacugcauccuccgucucccggauucaagcaauucugccucagccuccugaguagcugggauuacagucgugugccaccacaccuggcuacuuuuuguauuuuuaguagagaugggguuucaccaugucggucaggcuggucuccaacuccugacgucaugaucccccugccuuguccucccaaagugcugggauuacaggugugagccacugcgccuagccaaaauuuuuucauuguaguaaacaaauauauaauauaggccagguacauuggcucauguguguaaucccagcacuuugggagaccaagaugggaugaucaccugagccaguuugagucaagccugggcagugugguggagccccagcucuacuacaaaaaaaaaaaaaaaaaacauuaaccagguguggaaaugcaugccuguagucccagcugcucaggaacccgaggugggaagaucgcuugagccuggcaagucaaggcugcagugagccaugaucacaccauuacacugcagccugggcaacagaaugagacccugccucaaacuauauacauauauaaauauauauauguaaacauaaaauuuaccaucuuaaccauuuauaaguguauaggucaggcccagugugguggcuuacaccuguaaucccaacacuuugggaagcugaggugagcggauuguuugagcccaggaguuugagaccagccugggcaacauggugaaacccuguaucuuaaaaaaaaaagguguauaguuaaguaaugugaaguauauucccauuguugugaaacagauuuccagaacuuuuucaucuugcaaaucugaaacuaccauugaacaacuucccauuucucccucccaguccuugguaaccauucuucuccuuucuguuuuugugaguuugacuacuuuagauaaccccaguauaguaauacaguauuugucuuuuugugacuggcuuauuuuacuuaacauaauguccucaaggaucaucugugguauagcaugugauggaauuuccuuggaaaaaaaaaucagauuuuaaaguaagguggaccugaauugaauccuagcagggugaccaagauuaaguuauuuaaccucucuuaacuucaguuuccuuauuucuaaagaggugaugauaacaucuaucccauaaaguuguuaggaggauuaagugaaauaauauguuuuaaaagcguagccaguguggcauauaggaauaguuguuuaguaaauaguugcucucagcuaguaguuaauuagacugggcuuccugaagagacugugucuuauuuuucauuguaucugcagagccugaaaccuugccagccauuugauauucaggaaauugcuuaaauugaaauacuguguccucagucuaauuucugucuguacuugccaagcaaucucauggcuuuaaagaguuccagagucagauuaccuagguuugaaaccuagcucugguauuuacuuacuaugugucuuuaggcaaguuauuuaaucuguuuaugccucaguuuauuuauuuguaaaguaaguaucauaggaccugaccuuccaagguuguggugaggaccaagugaguuguacauauaaagcacuuaaaauagugacugaaacauacuuucucagcuauaaguacauagcuuacugcuauaaagauuagcuuguauuguuauuaauaacugcucuauacgcugacggauccuaaguuucuguuuccauucguguuucuccuuuuagcucuggauggguagguauauccaauugccuucuagcauuuccacuuugaugucuaaugggcaucucaaacuuaguaugucgaaagccaaaauccucucccuuuuccaucagaccugaucuucuccaucucccuaaauggggcauaagggaagccugagucaugacuacuggccacauaauuuguaaugggucaauucuacuuggauuuuaguuugcuuuauuuucuucccuucguuuuguucugcccucugucaaggcaauaaaauaugcuggggugauacuuuggaguuuacugagccuuuucauauucaucagcacauuugaugcuuaaugcaaaucagaucuuauaaauccuuugcuuaaaacucuccagccucaucucauugcaguugauagaaucaauucuggauuccuuaccaugggcguacaaggccccaaaugaucaguacgaguugaaggaaaggauagacugaguaaacgcugggcucuaggauagugcagcucacauuacaggucaugacccgccaucccuggaugcccuucaguuuggcaaucuggugacagacuggguugugggaugcuguuauauuucccacauggcagucguugcuuccuuuaugauuauuggcauaucuaaaugccccugaguguuccuuacuuuauauuuuuucuuuagauucacugacuuuuuuuuuuuuuuugagauggagucucgcucuguugcccaggcuggagggcaauggugcaaucucagcucacugcaagcuccgccucccagguucaugccauucuccugccucagccucccgaguagcugggacuacaggugcccgccaccacgccuggcuaauuuuuuuuuuuuuuuuguauuuuuaguagagacgggguuucaccguguuagccaggauggucucgaucuccugaccucaugauccgcccaccucggccucccaaggugcugggauuacaggugugagccacugcgccuggcugacuucuuuuuuuugugagauggagucucgugcuguugcccaggcuggagugcagugcacagucucggcucacugcaaccuccgcuucccggguucaagcgauuccccugccucagccuccugaguagcugggacuauaggcaugugccaccaugcccggcuacuuuuuguauuuuuaguaaagacaggguuucaccaugcuggcuaggcuggucucaaacucuugaucucuugauccacccaccucagccucccaaagugcugggauuacagaugugagucgccgugcccagccagauucacuaacuuuuaaaaaaaauuucauuaggcacuacuuguuuuagccucauucuaaccauuaguauuuaugaaaccuaggcauuuaagucaaacaaaucuuaccuggcuuuucaaagguaauuugauacugaaaaacuccugauuaggauaaagucuuauucauauauauauacacacacacacacacacacacacacacacacacacacacacacacacacauauauacacacacacacauauauauacacauauauauauacacacacauacacacacacacacacacacacacacacacacacacacacacacauaugccauucauuucaaugggaaguuuucguauucacaagcccuuaaauuugcuccuaauuuuacugaaucauaccccauuaaaggacacaaaaguauucagugguuaacauguauugucagaauaacccaacaagguauuuuaucuuuauuauccuuuaagauaucuauuuaggcugggugcgguggcucacaccuguaauucuagcacuuugggaggccgagcuagacggauucuuuaagcucaggaguucaagaccaaccugggcaagaugggugaaacuccaucuuuacuaaaaauacaaaaaauuauccgggcgugguggugcgugccuguaaucccagcuacuugguggcagugguggugguguggggggcugggagggggaagggggcagggcugaggugggaggaucacuugagcccaggagacggagguugcagugagauugcgcgagacccuugcauuuagugugguauuuugaggcauuagaugucuuacauuuaggauuaaagaaacaaauaagaugcacaguuaucuucauggaauuuagccuuuaguuauuuuuaaaaacaauaaaaucaguggaaacuguaaaugucuagaaaugucauauuugcuaaacagguugacaguuuagaggguaugauguaagagauuaucacugcuguaaacuguuaaaccacaaguacuucaagagaaaacccaugugauaccugccaguaauucaacugggaagaugacugaaugguggcacuuuugucacagugcugagcuguucacaaggaaaacaaaauucuaaugauuuuuuuuuuuuuuuuuagacagggucuugcucuguugcccaggcuggaguguaguggugaaaaaaaacuacugaaaccuccgccuccugggcucaagcaauccucccaccucagccucccgaguaucugggacuauaggcgcaugccaccauacgcagcucauuuuuguauuuuuuuguagagauaagguucugccauguugcccaggcuggucuuaaacuccugggaucaagcaaugggccuaccuuggccucccaagugcuaggauaugaguguaagccgcugugcccagccccaaauuauuauuuuuaaaugagaguacaugccuuguaagacaauguauaaauaguaaagaaauugcuugugaagucaaauauuuggacugugauuagaucucugcguaucauggagcuuguaacaaaaaaacagcagugcccugccugcuuugcaccucuaaguuccauacuccuaaugcuguucaguguccauacuuagcuauuucuuuugcaagagaaggauccaggaaacaggagagccaguauuucuaaauaacaugguuauaaagcuguuucuuuucacuuuuagauacuaucuauuuucuucgcucuugaaagacuaggauuuaauucacacauucgauuccuucuuacucgucuccacuagucuaccaauguaguuauaucacagcuuuggcuguuguuaaguauuuacauuaugauguuagcauuauuauuuacagcagggccauauauuguacaauuauauuuguuuuauauaauuuuuuuguaguguuaaaaacaguccucuuccauuuuuuaaauugaaggauaaauauacauauacccuguauauauauacauauacauauauaugcauauaaacauauauacauauacacauauaugcauauaaacauauauacauauacacauauaugcauauaaacauauauacauauacacauauaugcauauaaacauacauacauauacacauauaugcauauaaacauauauacauauacacauauaugcauauaaacauauauacauauacacauauaugcauauaaacauauauacauauacauauauacauauauacacauauauacguauauacauauauagauauauacauauauacacauauauacauauauacacacauauauacauauacccuuuugacuuucauuagcauaauagugcauccuuuaauuuauuuuacuguuuuuaaauuuguauuaaugggguacaagugaaauuuugcuacauugguguaucgcaugguggugaagucagguauaaugcauccuuuuaaauuguuuugccuuguguauaccuuuuuuuuuuuugggacggagucucgcacuguugcccggcuggaguggaauggcgcaaucucggcucccugcaaccuaugccccccgaguagcugggauuacaggugcccgccaccaagucuggcuaauuuuuuuguauuuuuaguagagaugggguuucacuauguuggccaggcuggucucgaacuccugaccucagguaauccacccaccucggccucccaaagugcugggauuacaggugugagccaccgcgcccggccugcuuucuguauacuuauaauuuguuccuaaauucuaaaacuuuuuuuuuuuuuuaaagaaaucauuugaagcccuucauuccccuacugcaguuuagcaguuuagcaguuuaguuuagcugcuuacuaggucugcuauacagcugaguucuugggacuucucuucaccaaauccagagcauuuuucuuucuuuucucauguuuuagaccuuguuuccucaauugucuuccuuuuuccuggggcacacucucugguagccucccaagaaagaguacaugggagguaacuuuuuuuuuuuuuuuaaagcuugcagaucagaaaaugucuuauucugacacauauauuuaguuugacuggguauagaaguauaaauuggaaguuauuuuccuguaauuuuuuuuuuuuuugagauggagucucgcucugucucccagauuguagugcaguggcaccaucucagcuuucugcaaccuccgccucccagguucaagcgauucuccugccucagccuccccuaguagcugggauuacaggcgcccaccaucacgcccagcuaauuuuuuuuuuuuugguauuuuuaguagagaugggguuucaccauguuggucaggcuagacucaaacucuugaucucaggugaucugcccaccuuagccucccaaagugcugggauuacaagugugaaccacugugcccagccaagaguguguuacaguuuucuauguagccgucuugcauaacuuuguuagauuuauuccuuagcguuuuuaaaagugguauuguaaguaguguuuuuaaaacugcauuuaaaaauuguagcuguaauauaaaaauaagauagauuuuuauauuauucauguauauugcuguaauaguugauaauuuacauuuagguucuuuuggauuguauacuguacagucaucugugaauauuauaucaucugcaaaugaaucuuuuaucuuacccuuaccaaucuuaugucuucuauauaucuugccuuacucugcugccugagaccuccaguaugaugaauagaaguagcauguuccugaucuaagagggaaaaaaccuuaaacauuuugccauuaaguaugauguuugcaguggguuuucuguggauaccuguuacuagaaauucauuuuuuuauuugaguuuaucaugaauggauguuaaauuuuaucaaaugcuuuuucuguaucaauugagguauucauaucauuauucuccuuuauguuaucaaauaauuauucuccuuuauguuaucaauguggugaauugcauugaauaaaauuuucaaauauuaaaccaacuuuuaauuucugauacaaauuuuaaauuuaauucaauuuuugaauugugguuuuucccuuacaucgucguuagugaaacuggccugcaguuuuccuuuugacagguuuugguaucaggguuauaauggucaguaagcauggcuuuaguuguaccucaucaguuuggauguguaguauuuucauuaucuuucaggauauuuucauauauccacuucgauuucuucuuugacccaugcauuuuugagaaguauauuauuuuccaaacauggggauuuuauaacuaucuuucugauguggaacauagucuguauuucaguucauuuaaauguauugacauuugcaguauggccuagcagcuggucauuuugcaaauguucuauuuguauuuguaaaggacauguagagugcauuuacuagauauacugcucgagguguguccauuuuguuuaauuguguuaaaauauucuguauucucacuaauuuuugucugcauauaucaguuuuugaaagagauguguaaaaucucccauuaugauuauggauuuccuuauuucuccuuuuagccuugucaguuuuugcuuuauguauguugaaguuuuuauuagauauuuucaaauuuaggaucauuaacauuauccaguuugccauuuuuauccuuauuaaagugccuaucucugguaguacuuuguuguuguuguuguuuuuguuuuguuuuguuuuugagacagagucucacucugucacccaggcuggagugcaauggugcauucuuggcucacugcaaccuccaccuccuggguucaagcaauucuccugccucagccucucgaguaacugggauuacaggccugugccaccaugcccagcuaauuuugcauuuuuaguggagacaggguuucaucauguuggccagucuggucuugaacuccugaccuaagugaucuaccugucucggucucccagagugcugggauuagaggugugagccaccaugccuggcuugguaaugcuuuuucuuugcucuugcugauuuuaauauaguuauacuaccuuuugguauauguuuacauugaguauuauuucccauucuuuuacuuuuagccuuucuguuucucugguagguggcauaacaaacuuuguuuuuauuuuauuuuauuuuauuuuuauuuuauuuuauuuucuauuuauuuuuugagacaggguugcauucuguugcccgggcuggaguaugguaccagaucacaggucacugcagucucggccuccuagcaucaagggauccuccugccucagcuaccugaguaacugggauuacaggcacaugcugccaugccuaauuuuuuuuuuuuuccuuugguagagacaggguuucacuguguugccuaggcuggucuuuaacuccugggcucaagugaucugucugucucugccucccaaagugcugcaguaacaugcaugaggcccuguaaccggcccaaacuuuguuuuuaauuggagcauuuuagcauauuuagauuuaauguaauaacugacauuuugguguuuauacuugcuuaauacaauauaugcuuuuuuaauguccuauccuuuguucccuuuucucuucuuucuucuuuuaaauauuucuuaaacaacuuuauugaggcaugauuuauauacaauaaaauuuacccauuguaaguguacaguucagugauuuucagcaaauugaugaaguuaugcaaccaucaccacaaucugguuuuagaacauugucauccuaaaaaguucacuuauguucauuuauuuauuuaguuuuuauagcagcuuuauugagauguaauucacauauugcacaagucacccuuuuaaaguguacaaguugguaaacuaaggagauaaaaggguaaaaaaaaaaaaaacugaaguguacaagucagugguuuuuacuguaugcacaaaguuaugcaucuaucaucacgaucaauuuuagaauauuuuaucacccaaaaaagaaaccugguauucaguagcaguuacuccccaguuuccccauccccacagccuuugccaaccagugaucuuucugucucuggauaugcuuauucuggacauuuuaaauuaauagaaucagacaauauauggccuuuugagacuggcuucuuuuagguuuuuuuuuuuuuuuuuuuuuuagauggagucucgcuuuguuuuuguuucuguuuugagacaaggucuggcuuuaucgcccaggcugaagugcaguggcgcagucuuggcucacugcaaccucugccuccugggcucaagccauucucccaccucagccucccgaguagcugggacuacaggcaugugccacuacauccggcuaauuuuuuuuuuuuuuguagaggugggguuucgccauguugcucaggcuggucuuguacuugugagcucaagugaucuguccaccuuggccucccaaagugcugggauuacuuuggcaucagaggcaugagacacugugcccaguuagacacuggcuucuuugauuuagcauaauggucucaagauuuauccuuguuguaguaucaguacaucauuacuuuuuuugcugaauaauauuccauuggauggauauacuauauuuuauuuauucaucaguugauggacauuugaguuguuucacucuuugguuauaaugaugucuuuuuuuuuuuuuuuuuuuaucuugcucugucacccaggcuggagugcaguggugcugucauagcucacugccgccucauucucccaagcucaagugaucuucucaccucauccuucugaguagcugagaccagaggugugcaccaccacccuuggcuuauuuuuuuuuuuuauuuuuaguagaggcgagcucucgcuauguugcucaggcuggucuugaacuccugagcugaagcaauccucccgccuuagccucccaaagugcuaggcaaauauuggggcaaacgguucauaauacuccuuuaucauccuucgaaguccauggagucaguaauaauaacuccucuuauguaccacauauuaguaauuuguguuucugucuuuuuuucuugauaagccugguuagaguuuaucaaucguauugaucuuuuuaaagaacuaacuuuugguuuuguuuucucucuugauuuuuuguuuucaauuucagugauguuugcucucauuuuuauuuuuuucuucuguuugcuguaggcuuaaacugcucuuucuguaguuuacuaagguagaagcuuagauuauugacuauagauauuucuucuuuucuauuauaugcauucagugauauacacuucuggcuuauuacugcuuucgcugcaucccacaaauuuugauaaguuauauuuucauuuaguuuaaaauauuuuaacuguaagaguugauuugccauuuuuuugucuggcaguucuuuuaggcaguuuuugccucauauuuugacaugcuguuguuaggugcauauaugauaaggauuguuaugucuucuuggagaauuaaccccuuugucauuaugaaaugacccacuuuauuucugauaauuuuuuuaugaagccugcuuucucugaaauuaauauaacuacuccaucuuucuuuuuaugugauuuaucuuucuccauccccuuuucuauuuuuugagacagaguuuuggucugucgcccaggcuggggugccauggcgcgaucuuggcucacugcaaccucugccucccgaguucaagcgguucuccugccucagccucccgaguagcugggauuacaggcacuugccaccacacucagcuaauuuuuguauuuuuaguagagaugggguuuuaucacguuagccaggcuggucucaaacuccugacuucaggugauccaccugccucggcuucccaaaguguugggauuacaggugugagccaccgugccuggccuuuucccuuacuuuuaaccuaucuauauguauauuuaaaugaguuucuuguagacagcauauuguuggaucuugguuuuuuaaauccauucuuuuagucucuuuccuuugauugguaaguuuagaccauucauagauauuuacagugauuauugauauaguuggauuaauguauaccauguuuguuuuauuauacuuguucuuugucuuccccucuuuuucugccuuuuaugggcuuaacugagcaguuuauaugguuccauuauuuuucaucucuuagcauaucaauuauucuucuuguaaaaauacuuuuagcaguugcccuagaauuuccaguauauauuuacgacgagucuaaguccacucucaaugauauugugcuguuugugagugguacaagaguauuuccaaucccuccuucuuauuauaacauaguaauaggcuguuggggagguuuugaagauuuauagaaagaggcuuuuuauaguagugcuuagagauaaauuuguaacuguccuggguggguuuggaagucggcugcucuccuuugccguaucagcuauuaucaucaauaauacaauaauauguucucucuuuuuuugacucacaguucacugagacuuuuuugacggagagggacaaacaauccaaguggaguggaauuccucagcugcuccucaagcugcacaccaccagccaccuccacagugacuuuguugagugucaaaacauccucaagguaacucuuaaggaccuuggaggggcguauucagggccucuaggugacacaagaugucugcuguuuuuuuuuucccuuccguuggcuuuuaaaaauagccuguuuuuacugugugagcuauagaaaauuugagaaauucagaaaaaguacaaagaagaaaauauacaucaccuauaaucccaucaucccaagauaaucaccauuagguucccuguguuauccuuuugggcucuauguguguuuauuuuguggcagugcuugcuuaauuuugggaggucaacacuauccugugauugggaugacauucuuuuugaaaaggguuuagaagauuacauacugcugaaggcucguggaagaggccuuaugguuguugaauauuauuacuaacguaagaagauugaaggggccagguuugaugauugggaaaugaguggaaagagcacggagacauuaugcuaggauaauuguucucaaacuggaguguguuuaugaaucaccugaagagcguguuaaaacacagaguucugggccccaccccugaaauucugauucaguagggcuggaguaucuaaacuuuagcuguaguuuggaucuaaauuugaauuuagagcaccagcucuaaugcaguuaaaacccauguaaguggggguccgguuccaggauggccaaauaggaacagcuccagucuaugguacccagcaugagcgaugccuaagacaggugauuuuugcauuuccaacugagguaccggguucaucucacuggggcuugucagacagugggugcaguccacggagugugagcugaagcagggcggggcauugccucaccugggagucgcaaggggugggggaauucccuuuccuagccaagggaagccaugacagaugguacccagaaaaucgggacacucccacccuaauaacugcacuuuuccaacggccuuagcaaauggcacagcaggagauuauauccugcgccuggcuuggagggucccaugcccacggagccuugcucacugcuagcacagcagucugagaucaaacugcaagguggcagcaaagcagggggagggguguccacaacugcugagacuugcguagguaaacaaagcggccgggaagcucgaacugaguggagcccaccgcagcucaaggagaccugccugccucuguagacuccaccucugggagcagggcauagcugaacaaaaggcagcagaaacuucugcagguuuaaaugucccugucugacagcuuugaagagaguagugguucucccagcacagaguuugagaucugagaacagacagacugccuccucaagugggucccugaccccugaguagccuaacugggagacaccucccaguaggggccgacugacaccucauacagccgggugccccucugagaugaagcuuccagagaaaggaucaggcagcagcauuugccguucugcaauauuugcuguucugcagccucugcuggugauacccagacaaacagggucuggaguggaccuccagcaaacucugacagaccugcagcugaggguccugacuguuagaaggaaaacuaacaaacagaaaggacauccacaccaaaaccccaucuguaugucaccaucaucaaagaccaaagguagauaaaaccacaaagauagggagaaaccagagcagaaaagcugaaaauucuaaaaaucagagcgccucuucuccuccaaaggaacacagcuccucaccagcaacggaacaaagcuggauggagaaugacuuugaugaguugagagaaggcuucagaugaucaguaauaacaaacuucuccgagcuaaaggaggauguuugaacccaucauaaagaagcuaaaaaccuugacaaaagauuagacgaauggcuaacuagaauaaacagcauagaaaagaccuuaaaugaccugauggagcugaacaccauggcucgaaaacuacgugacgcaugcacaagcuucaguagccaauucgaucaaguggaagaaaggguaucagugauugaagaucaaaugaaugaaaugaagcgagaagagaaguuuagagaaaaaagaauaaaaagaaacaaacaaagccuccaagaaauaugggacugugugaaaagaccaaaucuacgucugauugguguaccugaaagugacggggagaauggaaccaaguuggaaaacacucuucaggauauuauccaggagaacuuccccaaucuagcaaggcaggucaacauucaaauucaggaaauacagagaacgccacaaagauacuccucgaggagaggaacuccaagacacauaauugucagauucaccaaaguugaaauuaaggaaaaaauauuaagggcagccagagagaaaggucggguuacccacaaagggaagcccaucagacuaacagcgguucucuuggcagaaacucuacaagccagaagagagugggggccaauauucaacauucuuaaagaaaagaauuuucaacccagaguuucauauccagccaaacuaagcuucauaagugaaggagaaguaaaauccuuuacagacaagcaaaugcugagagauuuugucaccaccaggccugccuuacaagagcuccugaaggaagcgcuaaacauggaaaggaacaaccgauaccaacuacugcaaaaacaugccaaauuguaaagaccuucgaugcuaggaagaaacugcaucaacuaaugagcaaaauaaccagcuaacaucauaaugacaggaucaaauucacacauaacaaaauuaaccuuaaauguaaaugggcuaaaugcuccaguuaaaagacagacuggcaaauuggauaaagagucuagacccaucagcgugcuguauucaggagacccaucucacaugcagagacacacauaggcucaaaauaaagggauggaggaagaucuaccaagcaaguggaaaacaaaaaaaaaagcagggguugcaauccuagucucugauaaaacagacuuuaaaccaacaaagaucaaaagagacaaggccauuacauaaugguaaagggaucaauucaacaagaagaguuaacuauccuaaauauguauguacccaauacaggagcacccagguucauaaagcaaguccuacaaagaaacuuagacucccacacaauaauaaugggagacuuuaacaccccacugucaacauuagacagaucaacgagacagaaaguuaacagggauauccaggaauugaacucagcucugcaccaagcggaccuaauagacaucuacagaacucuccaccccaaaucaacagaauauacauucuucucagcgccacgucgcacuuauuccaaaauugaccacauaguuggaaguaaagcacuccuuaguaaauguaaaagaacagaaauuauaacaaacugucucucagacaacagugcaaucaaacuagaacucaggauuaagaaacucacucaaaaccacucaacuacguggaaacugaacaaccugcuccugaaugacugcuggguacauaacgaaaugaaggcagaaauaaagguguucuuugaaaccauugagaacaaagacaugacauaccaggaucucugggacacauuuaaagcaguguguagagggaaauuuauagcacuaaaugcacacaagagaaagccggaaagaucuaaaauugacacccuaacaucacaauuaaaagaacuagaaaagcaagagcaaacacauucaaaagcuagcagaaggcgagaaauaacuaagaucagagcaguacugaaggauauagagacacaaaaaacccuucaaaaaaucaaugaauccagaagcucguuuuucgaaaagaucaacaaaauugaaagaccgcuagcaagacuaauaagaaaagagagaagaaucaaauagaugcaauaaaaaaugauaaaggggauauuaccaccaaucccacagaaauacaaacuaccaucagagaauacuauaaacaccucuacggaaauaaacuagaaaaucuagaagaaauggauaaauuccuggacacauacacccucccaagacuaaacugggaagaaguugaaugaaucccugaauagaccaauaacaggcucugaaguugaggcaauaauuaauagccuaccaaccaaaaaaaguccaggaccagacggauucacagccgaauucuaccagagguacaaagaggagcugguaccauuccuucugaagcuauuccaaucaauagaaaaagagggaauccucccuaacucauuuuaugaggccagcaucauccugauaccaaagccuggcagagacauaacaaaagagaauuuuagaccaauaucccugaugaacaucaaugcaaaaauccucaauaaaauacuggcaaaccaaauccagcagcacaucaaaaagcuuauucaccacgaucaaguuggcuucaucccugggauacaaggcugguucaacauaugcaaaucaauaaacguaauccaucauauaaacagaaccaaagacaaaaaccacaugauaauaggugcagaaaaggccuucgacaaaauucaacagcccuucaugcugaaaacucucaauaaacuagguauugaugggacguaucuuaaaauaauaggagcuauuuaugacagacccacagccaauaucauacugaaugggcaaaaacuggaagcauucccuuugaaaacuggcacaagacaggggugcccucucucagcacacuccuauucaacauagugucggaaguuuuggccagggaagucaggcaggagaaagaaauaaaggguauucaauuaggaaaagaggaagucaaauugucccuguuugcagaugacaugauuguauauuuagaaaaccccauugucucagcccaaaauccucuuaaacugaugagcagcuucagcaaagucucaggauacaaaaucaaugugcaaaagucgcaagcauuccuauacaccaauaacagacagccaaaucaugagugaacucccauucacaauugcuacaaagagacuaaaauacuuaggaauccaacucacaagggaugugaaggaccucuucaagaagaacuacaaaccacugcucaaugaaauaaaagaggacacaaacaaauggaagaacaucccaugcucaugaauaggaagaaucaauauugugaaaauggccauauugcccgagguaauugauagauucaaugccauccccaucaagcuaccaauuacuuucuucacagaauuggaaaaaacuacuuuaaaguucauauggaaccaaaaaagagcccacauugccaagacaauccuaagccaaaagaaccaaagcuggaggcaucacgcuaccugacuucaaacuauacuacaaggcuacuguaaccaaaacagcaugguacuauuaccaaaacagagauauagaccaguggaacagaacagagcccucagaaauaaugccgcauaucuacaacuguccgaucuuugacaaaccugacaaaagcaagaaauggggaaaggauucccuauuuaauaaauagugcugggaaaacuggcuagccacauguagaaagcugaaacuggauccuuuccuuacacuuuauacaaaaauuaauucaagauugauuaaagacuuaaauguuagaccuaaaaccauaaaaacccuagaagaaaaucuaggcaauacuauucaggccauaggcacgggcaaggacuucaugacuaaaacaccaaaagcaauggcaacaaaagccagaauuggcaaaugggaucuaauuaaacuaaagagcuucugcauagcaaaagaaacuaccaucagagugaacaggcaaccuacggaaugggagaaaauuuuugcaaucuacccaucugacaaagggcuaauauccagaaucuacaaagaacuuaaauuuacaagaaaaaagcaaacagccccaucaaaaacugggcgaaggauaugaacagacacuuuucaaaagaagacguuuaugcagccaacagacacaggaaaaaaugcucaucaucacuggccaucagagaaaugcaaaucaaaaccacaaugagauaccaucucacacuaguuagaauggcgauuauuaaaaagucaggaaacaacaggugcuggagaggauguggagaaauaggaacacuuuuaaacuguuggugggacuguaaacuaguucaaccauuguggaagacaguguggcgauuccucaaggaucuagaacuagaaauaccauuugacccagccaucccauuacuggguauuuacccaaaggauuauaaaucaugcugcuauaaagacacaugcacguguauauuuauugcagcacuauucacaauagcaaaagacuuggaaccaacccaaauguccauuuaaugguaggcuggauuaagaaaauguggcacauauacaccauggaguacuaugcagccauaaaaaaugaugaguucauguccuuuguagggacauggaugaaucuggaaaccaucauucugagcaaacuaucguuaaggacagaaaaccaaacaccguguguucucacucauaggugggaauugagcaaugagaacacuuggacacaggguggggaacgucacacaccagggccuggcaugggguggggggaggggggagggauagcauuaggagauauaccuaauauaaaugacgaguuaauggguacagcgcaccaacauggcacauguauacauauguaacaaaccugcauguugugcacaaguacccuagaacuuaaaguauaauaaaauaaaaaacagcaaaaauaaauaaauaaaaaccauguaaguuauauugaacguaaugaaacugaaugacaguguucuucagaggugaaguuuugauuauuauaucacauaguaaguuauuuuaaaauguaauagaaacuaauuaaacuuagucuuuacguuuaagaagagacauuuucauauuuugaaucucacagucugauagaaauaauuauagcuucuuaaacuuguuuaaaaaugcuuuucaaagaguugcacauuauuugcuucuugcaaaaucucaggagauugaggugaaguuaaaggggagggaaauuaauauuuguauaucuuugcuaugugaucaucauuucuuuauucauuaaguaaguacuuauuugaaacuuacuauguuuuagguuuucuuguaagauuuuuuuuccucuuagcuuuguuccauaugaacaaaggauucuguggccgucaguuugagaacuacuacccuaugugugcuguaucaaauacucugucuuggaaucuguggggaauacaaagugggaucuguuuguguuguccucaaggaacguuuagucuagggaagaaauaacauagguuuggccgggcgcagugacucacgccuguaaucccagcacucugggaggccgaggcggguggaucacaagguuaggagauggagaccacggugaaaccccgucucuacugaaaauacaaaaaauuagccgggcgcaguggcgggcgccuguagucccagcuacucgggaggcugaggcaggagaauggcgugaacccgggaggcagagcuugcagugagccgagaucgcgccacugcacuccagccuggguggcagagcgagacucccucucaaaaaaaaaaaaagaaaugguuuguaaauaggugcaaaguaaaagugcuaaauguuacaaaugaguuguagauuguuuugggggucugaagagcaugcuucugguugggggaaaucaagaagacuuccugcaggagauuauauuugagcagugacuugguuauugcuacagaacuagucaccccgaaaccuagcagccggaaguaacaagaaucauuuaucugucaacaauucuugguugacugaguggcuccucugcuucaugugcuguuggguagggugguacugagauaucuggaauguccaaaauggucucucucacaucccuggcagguuggugcuggcugucagcuggagaucaacuaaggauguugcucuuggccucauuucuucuccuuauggccuccccauuggcuguguucucacagcaugauguuuggguuccaggauggcaagagcgaagucugucaggcuuuuuauuuuuuuuuaaugacagagucucccucuguugccgaggcuggagugcaguggcucuauguuggcucacugcaacgucugccuccguggcucaagugcuucuuguacuucaaauuccugaguagcugggauuacagguguguagcaccacauccggcuaauuuuuguacuuuuaguagagaugggguuuugccauguuggccaggcuggucucaaacuccuggccucaaguaauccgcccaccuuagccucccaaagugcugggauuacaggugugagccuggcuuucuuaaggcuugugcuggaaguggccuagugucacuucuaccacaugcuguuaguugaggugugucauaccagcccagauuuagugugagaaggggcuuuacaggggccugaauacuaggaagugugguucauuggggacugucuuuguguucaugggaacuccaguugggacuaaagcucaaacugaugcuuuagugucuggucuguguugguuacuaaaacaauguauguacuuuuuuuuaaaaaaacuaggaaauuucuccucuucucuccauggaggcuauggcauuuguuacugaagagaggaaacuuacccaagaaaccacuuauccaaauacuuacauuuuugacuuguuuggagguguugauguaaguagcuauuuauuauuacuacugcuguuacuacugcuuaaugguuugggaauuuaacuuuugaaaugggagauaggaaagauuucagaauuuauaacauuucagauuuuaacuuuuagaagcuuagcggcauuuacauguugaagcagcauaguuuuuacuucagaagaauucauuuauuuaaauugguguauaccuuuuuaaaaaaauacuaagugaaaaguacaucucuaaauuucccaguguccccuccucagaaccaguugugauuacuaguuucuuguguguccugcuuaagauguuuuguuuuuuuuguguguguguguguguguguguguguguguguaaauauuccccaccaccuccaccuuaguuuauuuucuccgcacauagagugauauaccauauacacggcuacacuauucuguaccuucuuucuucuucuuuuuuuuuuuuuaauuaaaacaauuuuaggccgggcgcaguggcucacgccuguaaucccagcacuuugggaggccaaggcagguggaucgugaggucaggaguucgagaccaaccuguccaagauggugaaacccugucucuacuaaaaauaccaaaauuagaugggcacgguggcaggcacuuguaaucccagcuacucaggaggcugaggcaggagaauugcuugaagccgggaggcagagguugccgugagccaagaucauaccacugcacucuagccugggugaugagcucucaaaaaaaaauuaaaugguuaguguuuccuggugugauugugccauaauuuauuuacccaggccccaguugacuggcauuuauaauuuuuccacaccauuucucuuacagacaagguugcaguaaagaucuuuuacauauuuuuguauacaugugaguauauaccuuuggaacaagaacguauguuuuuuauuguuuauaaaucugaaguuuaccuaccuaagaaguuuugucaguuuauauccccaggaacaaaguaugagcgucuguuuacccauaccaucaccaacauacuguguuuauguguguauuuuuauagacuuuguuacugaaguauaaccuucauacagaaaaguacaccaauaauuaccacaaaauacauucacuuuugcacuaccacccaaauuaggaaauagaacauuaccaguacccagaagcccccuuccacaaacaguguauuuuaaguauuuacuaagcaguuaugagaaaagugauauuuuuccauaguuuuuuuuaaucagcuuuauuaagauaugguucauauaccauacauuucacccauuugaaguacacaauucagugguucuuaguauauuugcagauaugugcaaccaucaccacagucaacuuuagagcauuuucaucaccucaaaaaagaaacuccauguguuuuaucuagcacuccccuaccucuaccaccuccucccccucuccccacacuaguauacuuuuugucucuauagauuucucugucguggacguuuuguauaaauuuaguuauauaauauguggucuuuugugacuggcuucuuuucacuuagcguaaugauuucuagauucaucuguguuguagcauguaucaacacucauuuuuauggucaaaugauguuucacaguguggauaugccacauuuuuuauuuguugagaggcauuuggauugccuccgucuuuuugcuauuaugaauaacagugcuauaaacauucuugcacagguucuuuguggacauguuuucauuucucucaggcauauacauaccuaggaauacaguugcugggucauaugggguaacucuauguuuaauuguuugaggaacugccagaauguuuuccaagaggcccugccauuuuacauugccaccagcaguguauaaggguuucaguuuuucuguauccuugccaacacuuguuaucugucauuuugaaaguguuuuaaaauuuaaaaaaaaaguacugagauggcguuuugcuuuguugcccagacuggucucaaacucccggacucaaacagucccccagccuuggccucccaaagugcugggauuacaagcaugagcccccgcuccagcccuguaaugauuacagccauucuagugagugugaagagacaucucauuguggucuugauuugaauuucucugauugccaaugaugaccaucuuauucuugaguuugucauuuguauaucuuccuuggagaaaugucugucucuccuuuuucaauuucuuaguugagauauaucucuuuugaauauuguguuguaagaguucuuuauaaauucucugcauaguuuuuaaaauucauucuucuaugacugagauuggauauuuuuucuuguguuuauaaguaguuccuuuucugccaguuuucuguuuugcaccuuuuucgauuugauuauuuguccuuuuucuuauugaucuguaagugcuuuugauuuuuuaaaggccuuugucauuuguguuuuuuuacuauuuugagaauuaaauuuugauguuauuuuaaaauuagaaauguuuaauuuuuagauugucagauugaucaguguuuuacuauaauggcuucagaguuuugguucaugccuuucccacuguuggauuuaaaccaugccuauuuccuucuaauauuuuacaguuuuuauuguguauguuuaaauuuuugcaucauuugaaguuuauuuugguguaaugacugagggguuaggaucugacuuugcuccccuagauaucugcccuuaaccccauuaccugaagugaacaugagggagagggcauuucuggguauuaugguuagucuuuaucuugaucuauguggcgauuguacaggaaugguguucaguguguaaaacuacaugugcaauuuauacucauggccagguacagugacucaugccuguaaucccagcacuuuaggaggccgaagcaggcggauugcaugaguugaggaguuagagaccagccugggcaacacggcaaaaccccaucacuacuaaaaauuaaaaaaauuagccgauugugguagcacauggccugcagucccaguugcuugaugggggcugggugggaggauugguugaguccgggagguugaggcuacagugagccgagaucgcaccaugaacugcagccugggugacagagcaagaccccaucucaaaaaaaaaaauuguacucuuuaugcgguaucacguuauacuucaauuauuaaaguuuccuuuuguuuaaagcuaccauuuuccaguaaaguaaagauugagugugacaucugcaugcauggcaucagccacagccuuucuucuuuaacugcugcuccgcauucccucuccacagcagugucggugguccuagggcauuuacuuacuuggcuagcucaagagacccuuuacuuuugaauuguuucaucaagaaaucuacuuaguaagaacugauguauuuaugggaggaaaaauaauaauguaggucuguagccugugucuauuugcaguggaaauguggcucucuaguaggagccuaucccaucuucggacaucuuuggaucaacuguucuugauuuuguggggguuuuucuuuccugcuuugaguuagggcagcuucuccaggaaucccagucauuuuauaaacaugggcuccugcuuaaguaauuaugcaccucacugaccuucaguuugggugcauuuguuagugaacucucuugcuguccugcugcugguaguauuuuccaaacagcuuguuauuucuuccucugcuaauaacuagcaagaacccaaaguaagccucucuuggucaugcugcccaaagcucagugggaucacuccuugucagccugacccuauccauaacaugacugugaaaagugugucuuagaguuuacaaagcagaugugaaguauguaacuaaguggagugaagcagacccagagcaagcucaucugcauaaauuaaaugaguauggggaauguuuugggcuagagagugugugccugcuuuuauggaggaaaugacucuuccucucccauugaguguuucccugagagguuaugggaaaucuagauuuguagguaaaaaucuuccagcuuuucaguaauugugggccagguguaagccauugcuuggcauucaggaacuuuuauucacugacauagucuaucuuccauuugaaguuaauuuauuuuaaauacauucuaugcacuugagcaucuuacgucuuacuuggaugaaugugaucucuuuugagaagaauugguguaguauacuucagagcuuuaaacauuacuacucauuuugcccuguuguuuccauuucugugacucugaugaagacguaagucaaaaugagauaaagcuuguguauaccaagaccguuagguguaacauuauuuguaaugacuaucuaccaggagaagauaaugguuauucuaucuauuuuguugaauuuuaugaaguuguuaauauaauguuaaaguuauaguaauaugggaaaauucaugaugaaaacaggcuauaaaaugguuauauacuguauaauaauuacuucaccuuuucuagaggaugaccuuaggucucuauuauacaaagcaaagcaggcauauguucagggcaguuuucauuguugccucaagucaugagacuucuuucuuuucccuccugcaagugcaguuaacaauaaauacagaugugcagaaagcugagcccagugcuucucuagaauugacaaucugugguguaguaguuuaggauuuuuauuuuuaaucugcugcuuuaagcuaaaauaacacaucucucuuaauucaggauguugaauuauagugucacauucaugccacgagcaaucucauggcaugugaauuacuuucuaaagauuuguugcugguuugagaugagcagaggcuuucucagacccucaagcugaacugucuagucucaaagauuugccugcuggcuuuuuaauuuaaaaaaugcuauggaaucuuccuucuucauuuggcuugaggugucuuggacaugcugccuaaguauuggccuauagcuagaaggggcuaaggaagaauuuuucuuuuuguucugggguagcuccuagcuugauuuaaacaauaauaaaaaauacauacguauauagggaaugucuuuaaacauaugggcuuagucauauucucagcauauagauaauuuuuaaaugcuuuaagugaaaauuggacuuuuuuggaaaacaaagguccuaauuuuucucauuuuaaaaggaaaagguguuugucaaggaaaaugugaaaaacugucuugggacuugucaccaaaauucaaccacuguuaagauucgggaguauuccuuucuaacauuuauuuuuuucuguuuauauuaaccuagaauuuguuuaacagaauuuuuuuuaauuacagcuuuuaaaaauuguugggaugauuuuagagauagaguugcacugugucacaggcuggagugcagugguacgauccuagcucacugcagccuugaaccccugggcucuagugauccuccugccucagucucccgaguagcugggacuacagguucaugccaucacacguggcuaauuuuuuaauauuuguuagagauaugggggucuugcuuuguuccuuaggcagucuccaacuccuggucucaaaugaucuuccugccucaccuucuucaguagcugggauuauaggcacgagccacccugccuccccagcaauaacagcuuuauugaaauauaauuuacauaaaguuaauucuuguaaccacccaucaguauugugcagugauaaccagaacauuuuuaucacgccaaaaagaaaucuuguacaaauuagcagucacuccccaucuccccuucuccccagcucuggcagccguuaaucuauuuuaugucuguauuaugccuguugugaaauauccauaauguccauaauaugccuguucugucaguccguucucaugcugcaaugaagaaauaccugagacuggguaguuuauaaaggaaggagguuuaauugacucacaguuccauguggccugggaggccucaggaaacucacaaucauggcagaaggcaaaggagaagcaggcaccuucuucacagggcagcaggacagagugagugcaagcaggggaaaugccagacacuuauaaaaucaucagaucucaugagacucccucguuaucacgagaacagcaugggggaccugccuccaugauccagucaccuccaccuggucccacccuugacacaugaggauuauuacaauugaaggugagauuugggugagggcacacagccaaaccauaucaccuguuacggauauuucauaucaacagaaucguccacuguguggcuuuuuaugucuagcuucuauaacugagcaugagguguuuuauuguuuuaaauaauagcuuuauugagauauaauucaugucauacaagucacccauuuaaaagauauauuaaaagauauaauucaguuuuuuaguauagucagaguuauauaccacugucaccacaauugauuuuaaaacauuuucaucacuccaaaaaagaaacaccauauucuucaguagccacuccccauuuccucccaaggccucccucccacauccuuaggcaaccacuaaucuacuuucugucuuuauagauuuaauuauucuggacauuucacauaaauggagucauaacaauacguggucuuuugugacuggcuucuuuugcuuaacauaauguucucaagguuaauccgugucauaacguguaucaauacuccauuccuuuuuauugucaagaaauauuccacuguauggauagaccacaucuuauuuauccauucaucaguugauggacauuuggguuguucccacuuuuggcuauuauuaguaaucugcuaugauuaauaaugcugccaugaacauuggcauauaaauuuuuagguggacguguuuucauuuucuauuagauugucuuacuaaaaaauuucccuugguauauaccuagaaguggaguugcugguaacucuguuuaauuuuuaaggaucugccagacugcuuucugaagcagcugcaccauuuuacauaucuaccagcaguguaugaagguucuaauuucuccacaucuuugccaauaguuacuauuugucuuuuucauuauaaccaucguaguagguaugaagagguaucucauugugguuuugauuugcauuucccugaugacuaauguugaucaucuguuuauuauuggacuuuuggagaaaugucuguucaucugcuuucuccauuucuugauuggguugucuuuuuauuauugaguuguauuaguuucuggauacuaauuccuuguaauuugcaaauauuuucccccauuaaguagcugucuuuucacucucuugaugguguccuuugaaacacaaagucuuuaauuuugaugaaguucauuuuaucuuuuguuacuuggguauuggugugcaucuaagaaaccauuuccuaauccaaggucacaaagauuuaccuauguauucuucugagaauuuuauauuuuguaucuuacauuuagaucuuugauccauuugcauugacuuuguuuaucaugugaggcagggguccaguuucauucuuuugcaugugacuauccaguugucacagcaccacuuauugaaaaaacuacucuuucaucauugaauugucuuggcaaccuugucaaaaaucaacugaucauagacacggguuuauuuuuguauuuacagaucaagauuguuuuggcuguuaugcaucccuuauauuugcaugugaauuucaggaucagcuugccaauuucugcaaagaagccagcugagauuuugauagugauugcauugaauuuguaggucaauuuagggaguauuaucaucuuaacaauauuaaaucuucugauccaugaacuacaagauagcuuuccauuuuuuuagauugucuuuaauuucuuucaaaaauguuuuguuguacaagucuugcacuuguuaaacuuauuucuaaguguuuuuacuguuuuugaugcuccuuuaaauggaauuguuuucauaauuccaguuuuuuuugcuucuugcuacaauuuuagaaauacaguugauuuauguauauugaucacauaucgugaaaucuugcugaacucuugcuuauuggcucuaauaguuuuuuugaguggauucuuuaggaauuuucuguauucuagauugugacaucuguaaauaguuaguuuuacuuauuccuuuccaauuugggugccuuuaauuucuuuuuuuauuuuucucuaguugccuuagaacacucaguacaauguuaaauugaaguggcgagaguggacaucuuugucuuuuuccucaucuuaaugggaaagcauuuagucuucacuguuaagcgugaugcuagcuguggguuuuuuaauaaaagcccuuuaucaggcugaagaaguucucuucuauuccuuguugauuguuuuaucaugaaaguguuuuggguuuuuuuuuccaaacgcuuuuucugcaucuguugagaugaccguguggcuuuuggcuuuuguccuuuauucuauugauaugguguauuauauugauuuucauauguugaaccaaccuuacauuccugggauaaauuccacuuugucauagugucaugguguauaauccuuuucuuguuuuuuuuuuuuuuuuuuuuuuuuuggagacaaggucucucugucacccaggcuggaaugcaguggugugaucacagcucacugcagccucuccugggcucaagcgagccuccuaucucggccuccugaguagcugggacuacaggagcaugcuaccaugcuuggcuaauuuuugguuuuaauuuuuguagagacagggucucacuauguugcccaggcugguugcauacucuugggcuuaaguaguccuccugccuugacgucucaaagugcugggauuacaggcauaagccaucaugcguggaguauaauccuuuuuguaugugucuggauuuuguuugcuaggguuuucaggauuuuuguguauauaugcaugagauacucaucuguaguuuucuugugaugucuuuguuugguuuugguaucaggguaauacucgccucaaagaaugaguugggaaauguuuccuucucuucuguuuuuuggaagaguuugugaagaauugaucauucuuuaaaugucuuguauuguucaccaauggagccaucauguccaagguuuuucuuuauggguaguuuuuuguuauuguuguuuuuguuuguuuuuuuuuaaaucacuaagucagucucuacuuguuauagggcuguucagauguucuguuuuuucuucuucuucgucuucuucgucuuugucuucuucgucuucgucuucuucaucuucaucuuugucuucgucuuuucuucaucuuuucuucaucuucaucuucgucuucuuugucuucaucuucuucgucuucaucuuugucuucgucuucgccuucuucuucaucuucuuugucuucgucgucuucuucgucuucuucuucuucgucguagucuucuuccucuucuucuucuucuuauuucuucuucuuucuucuucuuccuucuucuucuucuuuuuuuucuuuuaaagagauggagucucacccugccauccaggcuggaguguauuggcaugaucauagcucacugcagccucaaccuucugggcucaaguaauccuccugccucagucucccaaguagcuggaacuauaggcguaccaccacgcccagcuaauuuauuuuauuuguagagacauggggucuugcuguguuggccaggguggucucaaucuucuggcuucaaucaguccucccaccucagccgcccagagucuugggauuacaggcaugaacaaccaugcucagccucuguuucuucuuaagucaguuuuuaguuuuaugucuuucuaggaauguguccauuucgucuaggucaucuaauuuguuggcauacaguuguucauaguaguuccuuauaaucacuuuuguugccauaagguuggugguaaugcccucuccuuuauuucugaguauaguaaucuguauccucucuccuuuuuucuuggucagucuaguuaagaauuugccagucuucaaagagccagcuuuugguuuuguucauuuucuguuauuuucuauucucuguuucauuuguuucaacucuuauucucccuuuugcuugcuuuggguuuagucugcucuuuuuccagugucuuaagguagaagauuagguuaucgauuagaaacaauuuucuuuggccgggugcgguggcucaugccuguaaucccagcacuuugggaggucaaggugggcagaucaccugaggucaggaguucaagaccagccuggccaacauggcaaaaccucguuucuacuaaaaauacacaaaguagccaggagugguggcaggcaccuguaaucccugcuacucugaggcugaggcaggagaaucgcuugaacccaggaggcggagguugcagugagccgagauagggcuauugcacuccagccugggagacaaagcaagacucugucucaaaaaaaaaaaaaaaaaaaagaauuuucuuuuaauauaggcauuuacagcuauaaauuucccucugagcacuccauuagcuacaucauaaguuuugguauuuucauccuucuuggauacuuuauacuuccccuugugguuucuucuuuggcccauuauuauuuaggauggguuuuuaaaauuauccauauaauucaugaauuucccaaauuucguucugauuuuaauuucauuccauuguggccacacaacauacuguaugugauuuaagugcuuuuaaauuuauugaggcuuguucaguggccugaaauuugaucuguccuggagaauguuucaugugcacuugaguagaauguauacucuguucuugcugcauggaguguucuguagaugucuguuagaauauauguguucguuguguucaagucuucuauuucuuugcucgucugccuaguugucuauuauugaaagcagaguuauuaacguguccaacuuuuauuuuuaaauuaucuguuuccuucauuucugccagcuuuuguuucauguauuuuugggcucuauuguuagguacauacauauuuguaguuguuauaucuuucuaauggauugacccuuuuaucaacuauccuuucucuccguagaaugaauuuuuaaauacaugcuuauuuuaaacaguuugugcaaaauuguauuaaaguauguaaaauaaaaaacacaugcauauaacccccaaaccuguagaaaucaguguuaacaauuuaugguguaucuuuugaguccuuuuaaaauaaacuuacaaauguucuuuaaacagaagaaucauaguaauaauguucugcagcuuuucagaaauuaaagccgcauuagaucccagagauuaccuaaucuaaaauacuucuuuucaaaaaugagaaagcugaggccagagaagggcaaguagguggccaagcugggacuagaaccugggucuccugacuugcugcagucaggagccuuacugaaccuuaacugccuccuggaacaaaagggucuuguaauacugugacagauacaugggccaugaaugguuauggcaaaaucauuuuauaaguuauacuuugaauuaauuuugaagauuuuaucuaauuuuuuuuauagcuucuuguagaaauucuuaugaggccuacgaucucuauccggggacagaaacugaaaaguaaguauaccuauuagcuacugguccuuguuuuccaaccugccgauacgguggcaguucccagcagcugccuucuuccuucccuuccuaacucuuaauaguaaggacaugucuuacauuuagcuacagguugcucucuccucccccagcuaagcagcugucuuuauucauucuguacugcguagaaauucagaucuggguuaagagaaugcaucuuuguacuuuugauaguccugugauccagcuucuauguuuccuugggaaauucuucuuucucacauauaacuagcugagagaguaagaucacucuguuuuauuuuuuuuaaacuauuuuuuuuagaaaggugauacaugcucuuuguaaaaaguucaggcauuaccagggugugaaugguaaaaagucagaguguuuugguaugcacuauuucuuaagcugggugguagauauauggguaauauucuauuauuauuuuuuauaacuuacacguuacaaauaauucuuuuuagguauucaauuuuuuuuuuuuugagacagucucucgcucuguugcccaggcuggagugcaguggcaugaucuuggcucacugcaaccuccgccuccugagcucaagugauuuuccugccucacccucucaaguagcugggauuacaggcgcccaccaccauacccggcuaauuuuuguauuuuuuuuuuuaguagagaugggguuucaccauguugaccaggcuggucucgaacuccugaccucaagugaucugcccaccucagccucccaagugcugggauuacaggcaugagccaccgcacccagcuucgguauuuaauuuaaaauaaaaaagugaaugcacuuuacucugguguuaaaagccagagaugacuucaguuaauguuuggugaaugcccuccuaccaacuuugcguuuuuuuaauuuaaaagauuuuuuuuuuaccccaauacgacauacuguauaaggccucauuugugcaugcaguagugguuauuaagaggauuuauauucauuuuuaaugucucagcuguguauucuaacuuggucuuucauguucucuauguacccucauagcaaguagcauauuguaauuauuuguuggugcacuuguuuagucucucuucuucccacuagauuuauagguuccaugaaggcugagacuuuuuuucccucaccacuguaucugcucuagaguagaugcugaacaauacuugaugaaugagugaaucccaauuccuuuuaaaaauggaggaucuagaaauagugagauauauagugagacaugcagagcaguguuucacccugcucugaagucguuaaauaaaucaaucacagagccccaguagguugaaagguggugauaagggaugcagagcgucugcguugucucaggauuaugagacaacccaucuagucaagcuagcuuggcagggcugcccauugggaucugagaaggagaccuagcauuuuagcauuccuagcagcuuaggagugaauggaaacaauuuuaaaaaauagaagcaagugccaaauaaagcacuuuguccaugguucauacucaguuucaucaucuuuugguuuugggcucaugaaaauuaaguuucguuuuuaugcuacuuuccuguuccugcucacagggaaguaguaguuucuuuauaagaauuaguaauagaucagacauuaagagccauuugcccaacacagauaacagcaacaaaaaaagaaaugcucaguuaaugagucugauaaaaaugguauuuuuguuugcugcaguagaacuuucaauggaaauuuauaacaagagcaauugagaugcuuauacuuuuaacuuuuagccaggcgugguacacgcgcaugcaguccuagccacucgggagggugaggagggaaaauugcuugagccuaggaguucgagacuacagugagcugugauugugccccugagugacagaguaagaccucauuuaaaaaaccaaaacaaaugaacaaaaaaaagaugccuauacuuuagauucuaguaguucuacuuuugaaaauguaucuugaggaacuaguuuaauacaaacaugaaaaggauacacauauauauuaaguuguucauuuguggucuacuuaaauagccaaaaaacacaaaaaacaaaaaaaacaaauccuagauauauccuaagcaagacauuaagggaaaauggcuuuauuaaaugauggcacaacaacagguugaaauuaugaagacuguggagcauaauaagaaaacagcugcuguaucaaaccaaaagcaauaugcaaaugggcuuguagguucugaugggcacuaugaaaaccuuugguagacaggggcuggaagaaguauauuaaaggaaaaauaaucaucuuggaggggauuauaacaguucuuaugcugaaaaaaaugugguaacuguuguacuaucuuuucauugagaaaaauaaccagucauuacccuuucacuuucaguaagugaugaaauguccaaggacugcuugaguauccuguauaauaccugugucuguguaaguaccccugccacuggggcucuguuuaucuccccuaccaggucugcaauguuuaagaugggaauauucgaguagaauggcagacauaagagcugcuuucagacagugggggaaucgggcuuauuuuaugugugccugaaaaucaggacuaacugguagaaauuacggggaggcagaauuuuguagcaguuguuaagagccaggacugcugcagcagguaguaaacuccuuuggccuuagagcuguccaaguagaaacuggacacuugucaaaaggugacaaguguuggcagacugugaccuuuaagacucauuuuaacuccauuaugccuauuucuucauuuuccuuguuagaaaacaaaaugagaaccagaagccccgcccauauauugagcaggacucuacuagguugaccacugagccaggaagaauggugaauaaagaaagcaaucugguagaaacaaaagaggauggcacuuaguguuaggaccugauuuuguguucuggcccuuggcuuaguacaccucccaagccguaguuucuuaccaauagaaugcaguuagcaguuguauuaacaucauagauuuauugugagaaaugagauaguagaugugaaaacacuuuguaaaacaauauauaaauguuaguuuuuaaaagauacaguaccugucuuuuagaaacuuaugauaaacuguguaaacugugaaucauaauacauggcagaaugagacgagcgcuauuauaaaugugaacccuguaugcuguggaaauaaaaaaaaaaaaacauuuagcuccauuucauuucuugccucauucaaaauaagauuucugacaucuuguggguguaugcaaaaucuaccaagaucacgaacuuagaagcagguaagaaagaagaagauaaagguggggacauaacguauagccaggaauugggcugauauaaaaaugaagaccauaaaaucaucuguauuacggaugggcacaaauuuggcuucaagcuucuuagcagccaacacaaauaggggaauauguuugaacacuuacguaauucagcaucuauaauagugcugugcaauugaaauauaaugcaagccacuuggguuauuuuaaauuuccuuguagccacauuuuuuuaaagaaaaaaguaggaagaaguggugaaguuaauuuuaaugauaaauucuguuuaacacaguguaucaagaauauugucauucuaacauguaaucaguauaauuaauuauuaaugagauauuuacuuguuuuucguauugagcucucaaaauccaauguguguguguguuuuguuuuucuuuccucuuguuugaacacccagagcacaucuuaguuuggccuggccaccuuuuaagugcucgguagccauguauagccaaugacagagauaggcacagggagaucuauaagauaaaauuucaaauuguucaggaaaugcacaguucuugcaacuaaggccaauaagaaauuguccuuauagaagaagacaguguauaauauaaugacuccaucuuuggcaacuccauauagucacuaguuuuaugaggccguuuuaaaaucaugauaccuaauguuaaucagugacauuccaauaaaacaguuaaguuaaaaaaaugaaauguaugaagagaaguugauuaauggguacaaauauaugggaugauaaauaagaccuaguguuagauaaaucaguaagggugacuuaguuuauaauauucuguucuguuuuacauuucaaaauagcuagaagagaauuugaaugguucuuagcauaaagaaaagacaaguauuuaagcugauggcuaucccaaguacauugauuugauuuuuauaaauuauacgaauguauuaaauuauaugcucccugaaauuauguaccuuuauuauauaucaacuaaaaguauuuuuaaauaaaauuuuuuaaaaaauuugaggaacauagggcgauaugguucaauuaugugcuaucuggcugaauuccauguuaauguagagaaccuggggcucucaggguugcaaacaccaaugccuccagggaucaggcagaaaacaggaaauguuuggaauugcugguguuggaguggggacuuguguaaacugugacuaaacuggagcaaguauguccugucuaaagauguuugaauucaaaaguuuaaaaaguacuguuggccgggcacgguggcuaucaccuguaaucccagcaauuugggaggcugaggcggguggaucacuugaggucaggaguuccagaccagccuggccaacauggugaaaccccgucuguacuaaaaacacaaaaauuagccagguguggugguacaugccuauagucccagcuacucaggagaggcaagagaaucacuugaacccagcaggcagagguugcagugagcugagauugcaccacugcacuccagcgugggugacagagugagggucucucaaaaaauaaaagauaaaaaaauaaacaguacugcucaccagaaaaagcuuggccuacuggaugcuaguuuguagcuccucauuuagauacuugacagauacuaggucaagagcuuaugauuaggcugggcgcaguggcucacaccuauaaucucaacacuuugauaggccgaggcaggagaauuguguguguccaggaguucaagaccagccugggcaacauagaaccugucucuacaaaaaauaaaaaacuggcuggacgugguguuauauaccauagucccagcuccucaggaggcugaggugggaggauugcuugagccugagagguuaaggcugcggugagccaugauugugccaguguacucacucagccugggcuauagagugagacccugucuccaaaaaaaaaaaaaaaccaaaaaaaaaccuaugaugaauguuacauggaaaaaacucucccccgaaaaauguaguugcauacaaccuuuuauauauuguuuuagugcuuuuuggccucaguuaagaacuugugauauagaggaaaggaaggauugugauggccuuuuggguggccacuguugacuugggaagguuuuccaagaggagucauuuuagucagucuguaaaaggaguagcacuuugauaaauugaagagaggagaaagguggguagucaaggguagcuaguuagagcagcaggguuguguauuugacagccuggagauagauuuuuaagcuuugagaaaguguaaauuuaguucucuuuuuguucuguuucuuuggaucuuccagaacuuuugcuugucaguaaaacuagagucaguccuguuucacauaucauagccaguguagguacuguauguaguucgggaauaacaaccuuuuuuuuuuuuuuuuuuaaugugucagugcuacgacugaagaaccgaaauguauuaauacagauggagauugcuuucuuuaguguccuauuuaaugugaucgucaaagauuuauauacguggcacaucuuuauugaugccuucacuuugaaaauuaaauuugccaggugcgguggugcacgccuguagucccagugauucaggaggcugagguggggggaucgcuugagcccaggugauugaggcuguagugagcuauauucguacuugugaauagucauggccucagccugggcaacagagugagacccugucucuaaaauuaaaagaaagaaaauuaaauuuguugcaacauaucucauuucacugauucugaaaugccuccuagcuugggguucccauuuaccaaacugugugugucugcacucuugauuauacuuuuuaaggagaagucaaguuuaucgcaguaaaccuuggaauuuuuucagcuuagaggcuaaaaaaaagaaauauuaaagucacuaagcucuaguugccuuaaggcaguaggggugggauauauauguguguguguguguguguguguguguguguguguguaagcuauagcaguacugcaguuucuuucuuuuuagagauaggguuucacucuguccccaugcuggaaugcaguggugagacagauuguagcucacugcggccucacacuccuggccucaagcgguccucucaccucagccuccgggguagcugggauuacaggugugagccacugcacuugacaauacugcaguuuuaaauccaaacucuugaaccuaaguuuuaaggucuuuuaccagcuaguuuccuuaacuuccuucauaccccuuggggguuuuguuuuuuuguuguuguugguuuuuuuguuuuguuuuuuuuuuugaguuagggucucccucuguugccaaggcuagagugcauuugcacagucuaggcucacugcagccuccaccuucugggcucaaaugauccuuuuaccucagccuccugaguagcuaggacuacaggcaugcaccaccacacccagcuaauauuuauauuuucaguagacaggguuuuggcacguuggccaggcuggucucgaacuccuggccucaagugaucugcccaccuuggccucccaaagugcugggguuacaggugugagccaccacgccuggccucaaagacuuuuaagaugaucauuuuacugaugaaaaaaauggaguuccaaaggugagaagugauuugcucaggaucacacagcuggaauuagaacuuaggucugacucuuaaguccaugcuucggcacuguuugauuucagauuuaagaauggccuucagaacucugagauaaguuauuuuaggaaauaccaucucauuguguuauguucucacaagugaguucccacuuguguagccugcacgucaggagacuuuuuucuuccauagcuggggaguuaacgagcguuucccacaguuaagccaugccauuccuguuuuguugacucaugccaguuuucagaggugaaacugcuuuucagugucuguaaaggaugccuuguacuuucauaauuuauuuuguacuuacaaccuauucugccuuuucuucuugugacagacagagggaguuacaaagcguuuggcagaaaagaaugacuuugugaucuuccuguuuacauugaugacaaguaagaagacauucuuacaaacagcaacccucauugaagauauuuuggguguuaaaaaggugagcuguguccucuagcugaccagauggggaagggugucucagaccauuggauucucaaaacugaauaauauacagagcuuuuuuaaaagaaaguguuaaauuaugucuuguuacucagauguauucaaguauaaaacuugauuaccccuuauacuagugguucuuaaaugacuguaaaaccuaaacagacauacauugaaaucaaacuaauucuaaaacucagaacuucagauugacucugugaauguagggugaugccucauguuacuuugcugaaaucaaauugccccucacucaucaccguuggggcaaguucuuuguagcauguaugugcuauuguaugcuaugcagugacuccauucucuuaccacuuuaccgcuaucugaacuggugugaagccuucauucauuaggauauguucuccuugguaguaauguuuggcuuucacuuaugaaguccgccucuauuuuuucucauuagucuucaacaauuaaaguugguuaauuggcaccagcgcaguaggagacaaaugggagcucugaaauccugccacuuggucauaagguuaauauucggaugacccauaacuuuaaaaaaaaaaaaaaacagcuaugaucgaaaugaaaacuaaauuaaaaauuucaagaauucacagauacccaaaaauacauucauagaucucuguuagagacuuacuguguuacauuuuugguguaaugcuuguuaggaccuggagcucaccuccccaguccuaaucuguccugagccuccauguugguugcugguuggcagauuucuuucucuuccuguugagcagccuccuagagguugcuguugcagggagguggauguucaugugcacuguggugaacccagcguucauuucuucuugcugugcuuuccccaggccuugcuugucauugcccagcacaaguggccuauugucuguaggaacacauuggagaugugugcaggccccagacagacccuuugugcccuuugauaaaaaggcuuuguuguuauuccaguaauuguguguuccagccagugugugaaaggggaccuccagaguggaaacuccagacuccuuagcagucucagcauaggagucuagaagugcuccuucacaacuuuucccacuugccucucacucccucucauuccuuuuuguguaccccaaaauggcgagguguuccaccaaacauuauggguaucuuggugcaguuugaaagggggauagauaccauaaagaaaguggaaacaccauaaacugggaaaagacauuugaauucagguaaccaacaaaggauuuguuguauucagaauuuaucaauaauucuuacaggccaggcacgguggcucaugccuguaauuccaacacuuugggaggcugaggcaggcagaucucuugaggucaggaguuugagaacagccuggccaucauggcaaaacccagucucauuuuguacuaaaaaauacaaaaauuagccaggcaugguggugcacaccuguagucccagcuacuugggaggcuaaggcaugagaauugcuugaacccgggaggcagagguugcagugagccaagauuaugucacugcacuccagccugggcaacagagcaagacucccucucaaaaaaaaaaaaaaaaacagaauucuuacaaaucagcaugaaaaagagaaauagcccaguagacaaaugggcaauguuaugaacaagcauuucacagacaagaaagaaaugguccauaaacauaaaagagaagauguuuaacuugauuggcaaucaaggaaaugcaaaucaauaccauagugagggagagagugggcaaauguuggugaguguguguaucaguggaaacacuuguauacuacugauaaauguuuaucagcagaauauccucuuuuuuuuuguuuuguaguugaacaggcacauaucuugugccccagcaccuagggaagcuuuacccugagggcugaggcaucaguauuuugccauggguuaccuauaaccugugccuggacacacuuguggggaagcucaguccuagaacagugauucuuaggauugaaacccagaagguuguaaagucaguccaucgggucuaccagccaaguagaaaagaucaaacuguauuguguaaggguauuuuuugaauaaguuuuuguuugacauuucuauauacauuccaauauguauguuuacugguggucguucuuggugauagcuaaaaaguuuagaagccacugccccagcaaaaacuucuccaccugugcaucaagaaacacauaagaacauuuguagcuucguuguuucagaacaaaaaacugaaaccaagucucugauccaugaauaggagaagggaugaauguacuuucuucacacaauggaauauuauauaguagaaaugaaugaacuguugccauaggcaacaacauagcugaguaauugaaauaaucgagugguagaagccaguugcagaacacuguagguaguauaucauuuucauaaagcucaaaaaagcaaauuauuuguugauaaaacuaguuuuuaaauggcaaggcaauaauaauuaaugauggugguucccagaggcagagagaugcaauaggaaaggcacacacagcuagucauuuuguugugcugcauaauacguauuguacauaucaaaaauuaaaacauaagaaguaaauucuuggccagccacaguggcucucaugccuguaaucccagcacuuugugaggccgaggugggcagaucacuugaggucaggagaccagccuggccaacagggugaaacccugucucuacuaaaaauauaaaaauuagcccagcaugguggugcaugccuguagucccagcuacuugggaggcugggacagaaaaauugcuugaacccaggaggcagagguugcagugagcagagauugugccauugcgcucuggccugggcaucacagugagacuccgccuuaaaaaaaaaaaucuuaaaauuuaagacaaaacaaaaaaccauaagaagugggcuggggguggugggaccuguuuugggaaccauauacugaguuagacagggcuagaggaacuggugagcuacaaguuacaguugccaauaauaguaguagcuuacauuuguuuuguacuagggaaaaggaaaaguggaagcaguuguuccccaaugcccccugcacagcaaauuccuguccuccauuacuagaaauagaggcgaguaugggauucaugagagcuucuaggaaucaugcacucguuuugggcacauucacugauacccuugcuaccagguccugugcauugagucucaggagaaaggguaggauauaugccuucaucaaaguauggucagauuauuugggaaauagaugcaggaacagauuauuaaaaguucaugugaucugugcagugaaagagaaacacccaauccaguggaaguaaauuagugggaugaaggauagcagguguuaucugaguagcacggggaugguucaaaaugagaaaaguugauguaguacaugccauuuacagauuuuaaggaguaaugagugagaauagaaccaaauagcacaaggcauuccauaaaauuaucauucuuaauaaaagcuagcaauagaaggaaaacuuauaaacuauauauaggguauuuauuaaaauuuaacuuauaggauauuaaaauuuacagcaaauauugaacuuaauuuuaauguuuuggaauuauuucugguaaagucaagaaaaagacaagaauucuugcucucacucuggauaaauggucacauacauguguacacagagaguaccuguaagaauguucauugcaacauuguuuaauagugaaaaacuguaguuuaccuaaauauguauuaaaagaagaaagggucaggcacaguggcucauacauguaaucccagcaguuuaggaggccaaggugggaggauugcuugaguccaggaguuccagccugggcaacaauagugagacccugucuccauaaaaauaaaguauuggccaggcgugguagcucacgcuuguaaucccagcacuuugggaggccaagguggauggaucaucugaggucaggaguucaagaccagccuggccaacauggugaaaccccaucucuacuaaaaaauacaaaaauuagccaggcgugguggcgggcgccuguaauccccacuacuugggaggcugaggcaggagaaucacuugaacccaggagguggaguuugcagugagucaagauugcgccacugcacuccagccugggcgacaaugagauaccaucucaaaaaaaaaaauauuaaaaaaguagccagguguaaugacacgcaccuguaguccuagcuacuugggaagcugagguaggaggauugcuugggccuaggaguuugagucugcaguaagcuaugaugacacuacugcuccgcagcuugagcaacagagugagacccugucucuuaaaagagagagaugauuaaacugugggguaaaacggcgggaagugauugaaucagcugcuuguaucaguguagauaaacuucaaaauguuggaugaaaaguaagguauaguaugguaucauucacacugugcaugcagagcaguaacauguauuuuaauggaaauauuuguaaguauaaaaacaugcacgggaauaauaaacacagaguucaaaauaauguuuacgucugcagggagagaaaaaaaugcgacuggaugggggauacacagaggccuuuagcuauauuugaaguauuuuauuuuuuaaaaaagcaaaucuguagcaagaaugguaauuuaugauuuccaaaacuugagugguaggcauuuccuuuuuuuuuaaauaggcaaaauauaccacaagaacaauugaaaacaguggugcucaaaagguaaauuuaguccucagacuaauccugugagguagauuaguuccguuuuacagauaaacaagcaaagacucgaaagguuuuuguaacuuaaccaaaguuucagagcugcaaguuacagagcugggauaggaaccuaagugaucuagccacuaagccccguauguaaggggaugcgaaagagaggcacauccaaucucuugagugaauugagcauggggauuguuucauuuuugucuucuguaggaaaugauccgacuagaugaaguccccaaucugaguuccuuaguauccaauuucgaucagcagcagcucgcuaauuucugccggauucuggcugucaccauuucagagauggauacagggaaugaugacaagcacacgcuucuugccaaaaaugcucaacagaagaagagcuugaguuuggggccuucugcagcugaaaucaaucaagguaaagucuccaaguucucagaauuuugagauuauagcucugaggcccuuacuaaaucaucuaguuuuuuuucuuuuucuuuucuuuucuuuuuuuuuuuuuuuccuuuuuugagaugggaucgucacuaugucacccaggcaggagugcaguggcacaaucguggcucacugcagccuugaccuccccaggcucaggugauccucccaccucagccaccugaguagcuggaacuauaggcaggugccaccacaccgggcuaauuuuuguauuuuuuguagagaugggguuucgccauguugcccaggcuggucuugacuuccuggucucaagugauccacccaccucaucuucccgaagugcuagaauuacaggugugagccaccacaccuagcaccccuuuuaaauaucucuagagauggauccaugugaaggcuccuaguauguaaauuuuguguaucuguucauuauuuugggaacugaguuccauaccuuucauuagauuuguuaaugggcucagaaccacaaaaaaaguuaagaacuacuuuuuaucagaauuacaaaugcauauacuuuuugaucuacuaagucucuccugggccuucauuuuauagauaaugauguauagacacuaaucuccucuugucugcaguuucacuuucugugguuucaguuauccguggucaacugcaauccgaaaauauuaacugaaaaauuccagagagagaccacauucguauaacucuuauuacagcaucuuguuacaauuguucuauuuuaucauuaguuauuguuaaucucuuaguguaccuaauuuauaaauuaagcuuuaucauaguuauguguguauauaagaaaaaacauaguauauauaggguuuggugcuaucugccauuucagguauccacugugagggucuugacuaagggaggacuacuguacaagauuauucacugaggccaggcacgguggcuuaacgccuguaaucccagcacuuugggaggccgaggcaggaggaucacuugagguucagaguuugagaccagccuggccaacauggcgaaaccccaucucuacuaaaaauacaaaaauuagcugggugugguggugcacgccuguagucccaguuacucagaaggcugaggcaggauaauugcuugaacccaggaggcagagguugcugugagcccagauugcaccacugcacuucagccugggcgacauaauuagacuccgucucaaaaaaaaaaaaaaaaauuauucauugcaacauuauuuguaauaacaaaagacuagaaacccagauguucauuaacacuggacugcuuaguguauucaauauuuauauaauggaaaauuguguagcuuugaaaaaaugaagaucucuauguacugcuauagaaaaaucuccaagauauauuaaugauaaagaggaaaauacagaacaguguguauaugguauaguuuuuguauuaagucagggggagaauaagaccauacguuugcccacauauaugguaugccuaaagaaacaaaggguacacaagaaacauaaagugguuauuaauaggaaguagcugguaagggaagguaguagcagugggagugggacuccuuacuguauacuuucauauauuguuugauuuuagaaccguguaaauauauuacuuaaaaacaaaacacuauucuaaccaaucuagcccaccuauuucuguucaguagcaaaagaacuguguucuaucuaaaauguuguugccugcacagauuuuggagaaacuggcauagauguauuuuggucauaagaguguagauaauucauauuugaacugaaacuugugucuuaaaagcuaguuuuucaauguuaacaggcuggaaauauuguuaauacaaaaaccuaucacuguguaccuuaugguacaccaaauaaacaagguaaaauuauacaaauguaucauuaaaaagcagcaguagaaaaccaugaccaugcagagguagcccuaaucaugcucugaaaacaguucuuuguuucuaaaguccaguugugugcauuccccaggcuggcucugcagaguuaucaagugcuucagagcagccuccucuccugaggcugaauaugaaccugccauucacucuguuauugucuaguuuuaguuaggaacaugaggugaucauaacuauacuuuguagguuauuagggaauauaauuuuacauguuguagucauauguaaagguagaaguuuguggacuccaaccccaguuuauucucucucuagauuugcuuuuccuccugugucacuagauacaaggucuuccuuggucuguguacgguuuucuucccacuccuuuaugauuuugggggaguucucauuuuaggaaauuuacauuuuuaaaaaauaugugacuuuccaacauggcacauauauacauauguaacaaaccugcacguugugcacauguacccuagaacuuaaaguauaauuuuaaaaaaagugacuuucauuauaacuaaauuauaccucagagcugguguacacaccuccauauacauugacaaaagguaguauuugcuaagcuccugguauguggcaaacgcuggguaacugcuuuaccuagaagugauuuuauuuaauccuucaagugcccuguggaauagagauuaguauccccauugcacaugugaggaaacugagggcuagaaagguucuguauuggaugccuguguaugccgaggcacuaaguaacuuucaucuuuuaguuucccauuuaaggaaucuauucuggcagaugauuuugauccuguuaguauugauugcuuucagaugccuauuuguaaacugacuuaaguaaaaccagcauuacccauuauucuugaggaaugaacuguucuggucagcugggcuuuuuugauuaacugagaacggaaagcccaguuuuuguuuuuguuuuuuuauuugggaguuuuuucuuaaagucucuauaaaauaaucuagauucacuuucauaucugugugacuagccuaguagacagucuaugugugauucugcuuguagcuuuugggauaaagccuaaaaguuguaguuccacacaugagguugugcaggaucugacccuucccaacccugaccauaauuccuacuccauucccuuacccgcacgauuuucuccauucaaaugcccugggaaggccaagcugguggacauaauuaaaucacgaguggaugaggaaagucuuaguccucugaauguuaucauucuugaauugcgcuccaguagugaaugccuuuaucucagguguguguaucagucagcuugagcugccauaacaagguaccguagacuagguggcuuaacuaacagacauuuauuuuucucacaguucuggaggcuagaaguccaagaucaaggugcugucaggauugguuccugguugaggccuuucuuccuggcuuguagaaggccaccuuuuuauuguauccacauaugaauuuuccucucugucauugaggagagacggagaucucuggugucucuuccucuucuuagaaggacaccaguccucucgguuuagggccccacacuuuguaaccucauuuaaccuuaauuacuucccuguauuaggcagcagucuccagagagacagaagcaguaggauuuaugaggugggauuuguuaggggaauuggcucacacgaucacaggcggaggagucccaugauaagccaucugcgacaaaaauuagcugggcauggugacacgccuguaaucccaacaaccugggaggcugaagcaggagaauugcuugaacccaggaggcagagguugcagugagcugagauugugccauugcacuccagccugggcaacgagugaaacuccgucuccaaaaauaaauaaauaaaauaaaagauaagccgucugcaagcuggagaaccugagaagccauuagcauggcucaguccaaguccggaaaacuuagaaccaggaaagcuaaugguguagcuccccggcuggaggaccccagaaacugcuggugcaagucucagagaccaaaagccaaagauccuggagucugauauccaagagcaguaggagaaaaacuucccacuccagaagggggagaaucccuuuuuguuuuccuccaucgccucccacugcucccccaccaauuggauggugccugcccacauugagggcagauuuucccuuaguucacacacucauacaccaaucucuucuggaaucaccuucacagacacacccagaaacagugcugugccagccauguaggcaucccauaguccagucaaguugacagcuaaaauuaaccaucacaccaccgcauucccuaaagggccuguuucaaaacgcagucauauuuagggcuagagcuucaacguaugaauuugugggggcgcgggggguggggacacaguccauaacuguauggaaagcugaaauauguaggauguugccaaaaaguuuucguuucguuuuuaauaaacuguggcugugaggucauuuucuugucuagcaaaaauaaugauuuacacuaucuuccuggggcucagauaauuuacauguaauuaucuaauguaaauuaucugagccccaggaagauagcguaagucauuauuuuuugagauucauuuuaaaauaaauaauuauuuuuugaguccuuuuugagauucucagaacuaccaguuguucuucugucgauuuagaagagaacagcugguuuccuucugggggaaaguaacgucuuucaagauucuuagcagagauguaaaugaagcuauaggcuagauaauugucaauuuauaagugacacuuagcugagaggggcugaauuaugcagcacaugaagcuggaaagcaggaggggaaacuacaggaguauggggggaauacugauguuucaacagugagaagagagaagaggccugcuucugcagaaauucucagggguugugagugauuuaguugucaguuuaacauuaaccagccaggugugguagcuacugauaaagcugugagaauuacaaggacuggauaugcugggaugucagcccaugagauuguguaugaguugcuagguaugauugguccagugaauuuuuuucuggggagaaggucuuagcuuuuauuagcuuuucaagaggugagugacucacaacagcucaagaaucucaggugggaagucagacuuagaacccugaguaccgggcacuucccaucuggaggaguguguugagugugcaggaauggggaagacuagcuccuacaugcuguccugagaggagcaggucaagcagcaggagcuauuuuugcugagaacagaaguauaagaguaaaaauccagcuaugugaagauuuucauguagaauacaaauucuuuuuauuucuuuuuuguuuuuuuugcuuuguuuuauuuugagacacagucuggcuauguugcccaggcuggaguguaguggcacaaucuuggcuuacugcaaccaccacuuucugguucaagcgauucucgugccucagucugcgaaguagcugggacuacaggcaugcgccaccaggcccgacuaauuuuuuuguauuuuuaguagacaucgguuuugccauauuggccaggcuggucuugaacucccaaacucaggugauccacccaccucggccucccaaagugcugggauuacaggcaugggccaccaugccccgccuacugauuuguuuuuagaaaaaauaauacacaccuaaaauuuuuuuuaaaugauacaaaaaguacagcagagaguuuguuccccucccugugguaacuuuuuaccaguuucuuaaacguccuucgaaaaauauucuauacaugcccaaucaugggacgggggaaggagggagggacagagagagauugacuccuguuuguacagaugguaauguaaauagguaauauaaaauaagugcugcucucuuuuuauuaaacuuaucuugccaaaaauuacacucuaguauauauagaauuauaugauuccuuuuuguaauuauauaauauucuauuauacaggcauacuguaauuuaauuagucccccauuaauggaaauugguaaguguugacaaauuaacccuccaaagaaauuacuuguucaucuuccccaccguguugucuguagccuuucccaguacagagcauuaucaaacuuuuuuauauuugccaagcugauauguuaaaaaaaaaaauggugucucaaacaaaaaucuauuucuguguaauuauuuuauggagauggaagucacguaacauaaaauuagccgucuuaaagugaacaacucagcggcauuuaguacauuuacaguguugugcagcuaccaccucuaucuaguugcacguuuucaucaccccaaaaggaaacgccguacacauuaagcagcuucuucccauuaccccuucuccccaacugcuggcaaccaccauucugcuuuuuucucuguggauuuaccuauucagauuacuucauauacagucauguugucacuuagcagucucuauccuucugagaaaugcagugaggugauuuugucauugugugaaugucauagaguguacuugcacaaaccuagcugguauagcccaugauacacuuaggcugcaaaccuguacagcauguuucuguacuaaauacaguaggcaguuguaccauaaugguaaguauuuguguaucuaaacauagaaaaaagguauaguaaaaauacaguauuauaaucugauggcaccaccgucuucuguguggucguuguugaccgcaacagcguuaaugcagugcauaacuguaaauggaaucauauagcauguggccuucugaaucugguuucuuucacuuggcauaauguuuuugugguucauuaauguuguagcaugucaguacuucauuccuuuauauggcugaauaauacucaucauguagauaccacaguuuguuuaucccuucaguuaauggacauuugggauauuuucaucuuuuggcuguugggaauagugcugcuaugaacauguguguacacauauuugugugugcaccuguuuucaauucuuuuggguauauauguaggagugaaauugcugggucauaugguaauuuuauguuugacuuuuuuuuuuuuuuuuuuuuuuugagacagagucucgcucuuucgcccaggccggagugcaguggcgcgaucuccgcucacugcaagcucugccuccuggguucacgccauucuccugccuuagccucccaaguagcugggacuacaggcgccugccaccgcgcccagcuaauuuuuuguacuucuuaguagagaugggguuucaccguguuagccaggauggucucgaucuccugaccuugugauccacccgccucggccucccaaagugcugggauuacaggcgugagccaccgugccuggccaacuuuuugaggaaccucaauguaguuuuauuuuauaacuaaggucaaacaucaucuuauagccacucacuaauuaugggagggguguguguguguguguguguuugugugcgcacgcguugagacagaguaucacucuugcccaggcuggaguacaguggugcagucucagcucacugcaaccucugcaucccagguucaagcaauucucaugccucagccuccugaguagcugggacuacaggcgcacgauaccacgccuggcuaauuuuuguauuauugguagagauggaguucgccauguugaccaggcuggucuuaaacuccuagcuucaagugauccacccaccuuggccucccaaagugcuaggauuacaggcaugagccaccgugccuggccagcuugucuuacuuuaucucuacucccauucacuauacccuacuucaccuuggguuauuuugaaguaaaccccagacaucguauaauuucaccugcauauauuucaguguuucuacaugauaacgacuuuuaagaaacguaacugccacuguaucaaaaauuaauaguaaucccuugauauccugaaauaucuaguuauuuauuaauuuuuaauuagguguaacauucacaugguuccaaaaaaucugcggauucaaaaagguauuuauugaaaaguuucaguuccacuguuacucucagugaccuaaauccccuuuuccacuugacggacauuuuggcuguuuccaucuuauggcuguuuacuguggcagccacugcucuuggcuucuuuucuguccuuccagggagacuuaaugcauauacaggcaaacaugaucaggcauuagucucauuuuaaagaagguuaaaugauggagucaggauuugaaucuggaucucccugccuccaaaguuuaugauguucuaauaugccgaucagaauuuccaccucacucauugugaauaaaaugagauugguggaaagaaaaauugggugauuauucaguuuuuuucuuuaccuuaaaaaaauguuuaucuuucauccugcuaguaaauguuacaggaaaauuagaaacuauagaugaguaauuuuaagagaauuguuuguauucucuccugcuuaggaacagccacaguaaauuccuugguauauaugcuuucauuccuuguguauuuugaagaagcaaauauuuaaauuuuugaagaaaauuaaauucauauuguuuaauaauuuacucucuaacaaguaaacagcuguuuugagucacuauauaaagauguaugugucaucauucuuagugucuaugcaguauuccauuguauaaaugugucauuguauuuaauuaaucagcuguugaugaacauuuaguuaccuucaccuuuuugcuguuacagaaaccacaucagugaaccuccuuauacagauauucucguguaauaugacugguuauuucguuaugguaaauucccagaaauugaccucuuggcucaaagacacacacauuuaaggcauaaagauuauucuaauuuauauucccaguagauaaaaagccuguuucccuguaccugcuaaaaacugagcuuaugccuguaacauaauuacuauuuaccuugguuugacauucauuuuaaaagaguagcuuuagcuacuaucagaguaagaauuauuccuaucaugcagauuguuuguuagggcuuuagggguaguuuugcuggucucuauuuugaaaauuuccucgcuuguucuuucccuggcagcggcccuucucagcauuccuggcuuuguugagcggcuuugcaaacuggcgacucgaaaggugucagagucaacgggcacagccagcuuccuucaggaguuggaagagugguacacauggcuagacaaugcuuuggugcuagaugcccugaugcgaguggccaaugaggagucagagcacaaucaagguauggaaggauggguccccugagugaucgggagcuuuuccuugggcgccugggaccauucuugcucuucuuuccaagaaggauuaauuugagauuugcucagaguagaauuguccucaaggcaauucuagaccaugacuauuaagacucuuuugacagcuuguuacagaaacuucauugaacuccccaaaguggaccugauuucagggagaagggcuuuguugcagaccugagacagcugugucucagggacuaacaagaaccaguaaccagagcauucuuaggaaccuagaaacuucucuccucgucucuuuuucuuucuacaguguuucuuagucuucucucucacuguacccuaccuuuuccugguccccuugaugggacuaggcagaagacugccuauuaaauaagaagacucccagucucagcuccagcuuccugguaaagaacucuggcccaucuuugguuaggugcccagccuuaaagcauuugacucuggccagcagguucagaauauacaaacccaggaauucucagcucccaaacaaggaauagguuucucauugggaguggggggccaucagcuuuucuucuucccuccagcuccaaauugaagagacuaaguucucggugaguauggcaaagaggucagaggcuuccuuccuccacccagcuccauacuguacucacgguguggaagcucuaucccacauacuugaggccaagaauucuauggcucugaucaccuuugcccuagcuugcucauguacagagguuuuacacugggagaggcaagcccggaagacuagaggcuacugacccugcucugagaauuugcccacagagagaggcaguuaauaagaacagaguccagggaaguucaugccugaggagauuuugaugguaagcaaauaaaaagagguaccucuucuuuuuuuuuacucuuuuuuuuuuuuuuuuuuuuuuuuuuugagacggagucucgcucugucgcccaggucggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccuuuacucuuuuauuuuuuauauuuucucuuuuuugaauagagacggguuuugccauguuggucaggcuggucucaaacuccuggccucaagugauccacccuccuuggccucccagagugccagguuuauaggcaugagccacugugccuggccagguacccucuucuuaauuaagaacagggugaucuacaggccagcuaguucaccagagaaccagggaaggagacagcugagaagaacucucccaaggucagaacaaagcucaauuucaaaaauuaccccuuccugaauuuaauugaauuagacuuuggagcaguguauacuccagggcauuaucaaaaacagucgagaauucagucagcaguuaguagagccuaacagcuggaugugauaccagaagagguagaaagcuuaacagagagaucauggaaagagcuagucaaagacagccuggcucaaugucaucccagggagacucuguacaugcccaagguugcacucucugaggcacaacaugaaaaucuucaccagucuuuggggaaggagacuuuacgaaaauagucuaaccaagucacuaaacuaauaaauaagcaaauaacaacaacaaacccugaaggagggggaaucaguauccagaguugcuacaguauauuacuuaaaauguccuuuuuugagauggagucucuugucgcccagguuggagggcaguggcacaaucucggcucacugcaaccucugucucccauguucaagcaguucucucucagccucccgaguagcugggguuacaggugcaugccaccacacccggcuaauuuuuuguauuuuaguagagaaaggauuuuaccuaguugcugguauugaacuccugagcucaggcaauccacccaccuuggccucccaaagugcuaggauuacaggcgugagcuaccacacccagccuaaaauguccaguuuuuaacaaaaauugagacauacacacaaaaaacaggaaguguaaccuauacacaagaaaaagcaggcaacagaaauuuccugugaaaggguccagauaccagauuuaacagcagccauuaaaaauaugaucaaagggcugggcgcguuggcucacaccuguaaucccagcacuuugggaggcugaggcgggcggaucacgaggucaggagaucgagacuauccuggcuaagacggugaaaccccgucucuacuaaaaauacaaaaaauuagcugggcgugguggcaggcgccuguagucccagcuacuggggaggccugaggcaggagaauggcgagaaccugggaggcagagguugcagugagccgagauccugccacugcauuucagccugggcgacagugcgagacucugucucaaaaaaaaaaaaaaaaaaaaaagaucaaagaacuaaaacuaugcuugaagaaguaaaggacuauuugauaaugugucguuaaauagagaauaacaauaaaaagauaggaaguauuugaaaagagcccaguggaaguucuagaauugaagaguaguauaauaaucaggccaggugugguggcucacaccuguaaucccagcacuuugggaggcugaggcgggcagagcauuugaggccaggaguucaagauuggccaggccaacauggcaaaaccccaucucuauuaaaaauauaaagguuagauggccaugguggugcacaccuguaaucccagcacuuugggaggcugaggugggcggagcacuugaggccaggaguuugacaucagccaggccaacauggcgaaaccccaucucuauuaaaaauacaaaagcuagauggccaugguggugcacaccuggaaucccagcuacuuggauugcugaggcaugagaaucgauugaacccggggcagagguugcagugugcugagauggugccacugcaguugcgccugggugacaaagugagacuuugucucaaaaaaaacuuuuuuuuaaguaguauaauaaucaagaugaaaaaaucacuagaaagacucagcaguagauaugaacuggcagaagaaagacucagcaaaauagguugauagagauuaaacauucuaaagaacagagggaagaaagaauaaagaaaacagggccuuaaaauaauguggggcacuauuaagcacaccaagauaugcauaaugggaguaccagaaggagauaaaguaacagaaaaauuaucaaagaaauaaugcugaaaaucucccaaauguaauguaaaucauuaaugcacacauucaagaagcccaaagaauccaagucggaauacucagauccacaugcagacacaugguaauaaaaacgcugaggccuggcauguuggcgcacaccuguaaucccugcacuuuaggaagccaagaaggguggauugcuugagcucaggaguucaagaccagccuggggaauguggcaaaaccccaucucuuugaaaaaaaaaaaaaaaaaaaaaaaaaguuaaccagggguaguagugcacaccuguaaucccagcuacucaggagacugagaugggacaaucaccucaacccaggaggaugaggcuguagugagcugcaaucacagccugggugacagagcgagacccugccuccaaaaagaaaaaaaaaaaauccugaaagauaagaaaaucuugaaaguaguaagagaaaaauggcucaucaugcccaaggauauuccaauaagauuaguggcugacugcucaucaggaauaauggaaggcagaaggcaguagggugacauauucagaaugcugaaagaaaacagucaaccaagaaucuuguauuuuacaaaacuauguuucaaagaugaaguugaaauaaaaacauucuuagaaaagaaaaacugaaagaacucauuaguaacagacaaacaucuggaaauuaagcagcauaccgacuuaugagaaauaccaaaggaaguucuucagguugaaagcaggugacuucagacaguaauuugacuccacaugaaaaacaaagagcaccuuaaguaaagguaauucuguaauuguaagagauuguguaaaugcauauuucuucuccuuuucuucaguuaaaaaacuuacacaaaccaucuaauuauauuguugaaccuauaacauauggaaacauauuuugcaauaacuguacaaagaaaacgggugguaccaaaguuguaauggaguaucaugacaccaaauugcaacuugaaucccuaggaaucggugaggagaaccaaaaugguaauaagaggguaaauauaaaaacuccauaaauguauacuugcucuucauuccuuuucucaguuucucuaacauaaaauuauuuaaaguaacaauuagaacaaguauuguugggcuuuuaacauacauagauacaauaugcacaauuacagcacaaaaagaaugaagauggaauggagcucuaaguuagaauaaauccgaaaaugcuugcuucagcaacacauauuccaaaauuggaacaguacagagauuagcauggccccugugcaaggaugacaugcaaauuccugaugcauuccauauuuauuucuaauuuuuaaaaaaaaucuggaaaagauuaagauguaugugguaagcaacuucuuuuuuuuuuuuuuuuuuugauauggaguuucgcucuuguuacucaggcugaagugcagugguaccaucuuggcuccccgcaaccuccgccuccuggguucaagugauuccccuaccucagccucucuaguagcugggauuacaggcaugugccaccaugcccagcuaauuuuguauuuuuaguagagacgggguuucuccauguuagucaggcuggucucgaucuccugaccucaggugguccacccaccuuggccucccaaagugcugggauuacggguaugagccaccgcgccagccagcaacuucuaagaaaguaacuuggggcugggcgcgguggcucacgccuguaaucccagcacuuugggagucugaggugggcggaucacgaggucaggagaucgagaccacccuggcuaacguggugaaaccccgucucuacuaaaaauacaaaaaaauuagcugggcgugguggcgggcgccuguagucccagcugcuggggaggcugaggcaggagaauggcgugaacccaggaggcggagcuugcagugaaccgagaucgcgccacugcacuccagccugggugacagagcgagacucugucucaaaaaaaaaaaaaaaaaaaaaaaaagaaaguaacuugggaaauauaguaaagaaauaauugaaggagauauaauguuauacuagaaaauauuaaucaaaagaaacacuaaaggagauauagaggaacaaaaaaacacacaagacauacagaaaacaaaaaguuaaauggcagaagucaguccagccuuaucaauaguaacauuaaaugugaauagauuuaacaauucauucaaaagacagauuguuauauuggaucagaaaacaagauccaguuauaugcagccuauagaaaacacacuuucaauucagagauaaaauagguugaaaguaaaggacagaaaaagauguaucaugcaggcagcauccacgagaaagcuggagaggcuguacuuuuaaaaaguuggagggacagagucucacucugucacccaggcuggagugcaguggcacgaucagcucacugcaaccuccaccucccggguucaagcaauucugaugccucagccucccaaguaguugggauuacaggcggggagcccacgcccagcucauuuuuguguguguuuuuaguagagaugggguuucagcauguuggccagguuggucucagauggccucaggugaucugccugccuuggccucucaaagugcugggauuacaggcaugagccaccaccacccagccaaaaaagcuggagagacuuuaaaacaaaaacuguuaucagagcaaaauagggauauuugauaauaacagggugaaaccaucaagaagauacaacaguuauaaacauguaugcauccaaaaacagcccccaaaaaauacaugaagcaaaaacuaacagauuggaagagagcaguaguucaaaaacaacagcuggagaccuuaacauacuacuuuuaauaauggauaaaacuaagcagaagaucaacagggaaacagaagacuuaaauaacacuguauaccaacaaggacuaacagagaacuguagaacccuccacccaacuacuacagaaugcacguucuucucaagugcacaugaacauucuccaggacagaccauaugcuaggcuguuaaaaaaaaguucagcaaauuuaaaaggauuaaaacuguacaaaaguauguccucaaaucccaguggggugaguuagaaauaaauaacaaacuugggaaauuaauaaauacaugcaaauuaagcaguauacuucuaaauaaccagugggucaaacaggagaucacaaacaaaauuaggaagugucuugaggccgggcgcgguggcucacaccuguagucccagcccuuugggaggccgaggaggcgggucgcuuaaggucaggagguccaggcaggaaaauugcuugaacccccgaggcagagguugcagugagccgagaucacacuacagccugggugacagagugagauuccaucaaaaaaaaaaaaggaaauauuuugagacaaaugaaaaugauacuauauaucaaacuuaugggaugcagcuaaagcgugcuuagagggaacuuuagagcuauaaaugccuacauuuuuaaauaaaucuaaauugccuaaacgucuaccuuaagucauuggaaaaagaacaaacaucucaaaaggaaaaggaaguaauaggauuagagugaaaacuggugagauagagaauagaaaaacaguagagaaaaucuguaaaaccaaaggugauuuuuuuaaagguaaucuuuaaaaagaucaacaaaguugacaaacuuuuagccacacugaccaaaaaagaaaggcucaaauuacuaaauuagaaaugaaagaagguacguuacaaccaaccuuaagaaaguaagaggacucuaagggaauacuauaaacaauauaagccaauaaacuaaauaaccuagaugaaaugagcaaguuaaaagacacaaacuauugcagcuaacucaggaagaaauagaaaaccugaaguauaacaacgagauugaauaaauaaugaaaaacugcccacaaagaaaaguccuggcccacauggcuucacugguuaauucuaccaaauguuucaagaagaauucacaccaauacuuuccagacucuaauagaaaauaaaagaggaaggaacaguucccaacuuacucuuugaggucauauuaucaugauaccaaaaccagauaaagacaucacaagaccaguaucucuuaugauuauaggugcaaaaaucuucaacaaaauacuagcacaccaaguauagcaacauacaaggauuguauaccaugaccaaauggauuuaugcaaguuugguucaacauuugaaaaucaguuuauguaauacacuguguuaauagaauaaaggacaaaaaccacaugaucguuuccauaggagcaaaaaagcauuugacaaaauccaacacccuuucaugguaaaaacaaaaacucaggagagaacuuccucagccuguuaaagggcaucuacaaaaacccauggcugacauaccuaauggcaaaaaauugaaagcuucuaccacuaagaucaggaacaagacgaguuccugaucguuucuggaaguggcagugccauugccacuucucuucagcaucguauuggagguucuggcuagggcaguuaggcaagaaaaagaaauuaaaggcaugcaaauuagaaaaguagugaaacuguucacagaugggaugaucuuauauguagaaaaaucuaaggaaucuacuauaaaaaccaguaaacuaauaaauagguucaacaaagguucagaauacaaggcuaauauuaaaaaaugaguaguauuucuauagaguagcaaucaacaaaccaaaaauuaagaaaacaauuuuauuuauaauaggaucaaaaaaauaaaauacuuaggaacuuaaguguaaaacuuauacucugagaauucuaaaacaucauugaaagaaauuaaacccuaaauaaauguaaagacaucccaugucuuugaaucagaaaauuaauauuguuaagauaaugauagucccauucugaucuauagaucagccuuacagauucaacacaauuucugucauaacucucagcugacuacuuugcacaaauggaguagcugauccuaaaguucauguggaaaugcaggagacuuggauuaacaaaaacagucuugaacuaggccggguacagugacucaugccuguaaucccagcacuuugggaggcugaggcaggaagaucacuuggccucaggaguuugaggccagccuggguaacauagugagaccccugucucuauaaaaaauuuaaaaauuaggcaagccucgugacacccaccuauagucccagcuacucaagaggcugaggugggaggguagcuugagcccaggaguuugaggcugcaguaaccugugauugugccacugcacuccagccugggugacagcaagacucugucucaaaaaaaaaaaacaaccuaagacaacucacauccugacuugaaaacuuacuacaaagcugcaaucgagacacuaugcugcuggccugaggauagacauauugaucaauggaauauuguugagaguucagaaauaaacccucaugcuuauuaugaucaauugauuuucaguggguaccaagaccauucauugguggaaacaguaguagucuuuucaacaaaugguauugggaccauuugauguccacaugcgaaagaaugaaguuagauccccugccuuaugucauauacaaaauuaaaagggucaaagaccuaaauguaagagcuaaaccugugaaacccuuagaagaaaacauaaggauaaagcuucaugaccuuggauuuaacaauuuagcugucauacacaaugacaucugaagcacaagcaaccagauaaauaauaaauuggacuucaucaaaauuaaaacuuuuuguucuucagaaaacacaaugaggaaagugaaaagagaacccacagaauggaagaacguuuuuuguggguaaggcagggugggacaucuuugcaaauaauauaucuaauaagggauuuguaucuagaauguauaaagaacucucauaacaauaauaaaaaaacccauuucaaaauauagacaaaggaucugaauagauguuucuccaaagaagauauauaaauaauuauuaagcacgugaaaaauguucaccaucauuagccgucagggaaaugcaaaucaaaaccacagugaggccaggcacaguggcuggcaccuguaaucccaauacuuugggaggccaaggcaggaggauuguucaagaccagcucaaacaacagagcaagaccucaucucuacaaaaaaaaauuuuguuucgguuagccaggcaugguggcacgugcccauaguccugacaacuugggaggcugaggugggaggauuguuuggguccagaguucaaugcugcagugagcugugauccugccacugcacuuaaguagucuagaugauagaggaaaaaacaaaccccacaaugauauaguacuucauacucacuagaaugguuaucaucaaaaaagguggauaauaaggguuggcaagaauauggagaaaucagagcccucagucacuauuagugggcauguagaauagugcagccacuuuagaaaagagucuagcaguuccucaaaggguuaacauacaguuaugucauagggccuagaaauccuacucccagguauauacccaagagaaaugaaaauauauguuacacaaaaauuuguucagguauguucaucacagcauauucauaacagccaaaauauggaaacaacgcaaaugacugucaccugauuaaugaauaaacagaauuuuuuuuuuuuuuuuuuuuuuuuuuuuuugagacggucucucucugucaccuaggcuacagugcaguggugugaucacagcucauugcagcccugaccucccaggcucagccauccuucuaccucagccucccgaguagcuggaaacaggugcacaccaccacgcccagcuaauuuuuuuauuuuuuguaauaaaaagagacaggaucuugcuguguugcccaagcuggucucaaacuccugcacucaaaugaucuucccgucuuggucuuccaaagugccggaauuacaggccugagccacuguaccaagccagaaugugauauauuuauacuagcggauauuauucagcaauaaaagggaaugcugauaggggcuacaacauggauaaaccuugaaaacauuguacuaggugaaagaagcagucacaaaagauggcauauugcaugaguucauuaauaugaaguguccugaacaggcaauugcauagagauggaaaauaguuucaugguugccuagagcuaaggaguuuggugggaaauaggaagugacugguagugaguacaaggcugcuuuuggggggugaugaagauauucuaaaauugauugugguaauggcugcacaacucuaugaauguccuaaaaaucacgauaccaugguuaacuaaaugggugaauugcaugguaugugaauuguaccucaaagcuguuaaaaaaaaaaaaaagugagugugcauguccgcagaaaacagugcagugcagacagagaguggugaccgcuccaaucggugugguagagcugaagagacucaggggagcacaggccucgugagcugguuuucccauccucauccuugggacugaccuuguugcuaagcucuggccauugcuuuggagacuguuucuugaaaauauuuaucacagaaagucuugucaggccugcgcaagccaggcaccaaaaguugguggugacuuggagaggggucaggcugcccugucucuuucuucgcagacguucauuucucaguaggacuugugugccccacacugugcccacugcuugcauaaacauccuucccugcaggacucccuagagcaccaugggcugggugccgaggaugccaagcacgcaaggucucacagcagugcacgacagaggcaggauucugcgugauaguucuucagguucacuucacagauuagcugacacuuaacuguucuggaagcugggccaaggagugcuaacauggaaauugaguaacuauaguuuuuugcccaagguacaggagaauaaauaugaguagauagaaucucuuaaauuaaaaauuucuccaguaaauuuuuccuaagucuuugccuccugccuguuuaguucccauuaaaagcuuggagaugaaaaagaauacaaaguaacaagcaagcauucgcagaaaaacucaguuuucugagaacuuaacuucuauuuaguuucuaauuguauguugcuuacuuggggcuauguuccaggcaccuucaguauaucccucuacuccuuacaacauuaagggguagguaugguugucaguauugcuguuuuacaaaggaggauggauacugaagcacagagagguccacugauuuacugaagaccacccggcuagugaaugggguucaaacccaguagucuggcuucagggucagugcucuuaacuaccgugucacacugugucucagucacacuucauucagcagcuugucgucuuccaagguugugauuuuaacaugacggggaaagauaguuccaagucuguaggauagaguaaguuagauucucucuuuuuuuuuuuuuuuugagacaguccagcucugucgcccaggcuggagugcaguggcacgaucucuguugguucacugcaaccuucaccuuccaggcucaagcgauccuuccaccucucccucuugaguagcugggacuacaggcgcaugccaccaugcccagcuaauuuuuuaaauuuuuuuauagcaaugaggucucacuguauuguccaggcuggucucaaacuccuaggcucaagcaguccaccugccucggccucccaaaguccugggaucauaggcaugagccaccacaccuagucggaauaaguuagggucuucugucuugauacuuuaaagaguaucacuguguuuucuguaugagccuuaccugaauauaucugauaaccacuccucuauaacacauagaggccuuugcaaaaggccucuagggaagcaguuccuguaggaacuugagaggaccuuggcaguuacugauucaucuguucaccuuuaaaaugaggaaacugaagggaagucacucugcuaagaucaccuagccucuccugacucugaccaaugcccucuuaaaauaguagggaucuacgcugggcaccguggcucacgccuguaaucccagcacuuugggaggcugaggcgggcagaucacuugaggucaggaguucaagaccagcccggccaacauggugaaaccccaugucuacuaaaaauagaaaaauuagcugggcgugguggcacaugccuguagucccagcuacucgggaggcugaggcaggagacuugcuugaaaccagcaagcggaaguugcagugagccaaggucaugccacugcacuccagccugggugacagagcaagacucuguaaauaaguaaagaaaggaucuaggagugaaugggggcuuccuaagaaucagaugcugggcuucucuuacguucccauucagucugcacaguaacccuagcugucugcugcagagcagucuaaggccuagugaggaggugacuggcccaaagucauaaagccagcaagucugacacauaucaagugucccauaaauaucacuuagcugcuguugauguuagcaguaaugacauuggguaaaaugaaaaucugccuguagauaauauguucaucugcaucaguagcaucaguugugauacccagucugcuuuagaaaguugaaccuuagaaaaauuuagaugguucuucuuuuaaaaaacggggaauucuucaaaaagaaucccucuugggcuucagcagugucccucauggagucucagcagaagaaccaaguaagcagggccauuugcgacuugaagagcgguccccauaauuugcugucauacaucugccugggcacuuccugggggucugguugguggcaggagaagggcauaagcagggagggaugggucauguuacuguauuggcuguguccgaauauuuuuacuuuauguuaaaguugaugaggcacaacuauugcagaguccauuuuuccgagucucugcgcucaccuggcuccugggauuguggagggaguuuugcagcuuucagagucuguguuuugggcucauggcccagccgaauggccaugcuacaagucuguucagagcagguucgaggggcagaaacguguuuccucacaagcugugacucaauccugucuccgguggcugugucagccuccauuguguucccuccuccaggggcuucugaggagaauggccugccucacacgucagccagaacccagcugccccagucaaugaagauuaugcaugagaucauguacaaacuggaagugcucuauguccucugcgugcugcugauggggcgucagcgaaaccaggugggccccucuccagcgucucaggacacggggagcaggugcugcccgggugcucaugguaugccaggugcuccacugggccuucuguuagaauggcucucgcuuuagccuggcaaagcauagggguauuucuccuucuguucuaccuauaaggaaaccaggcugauuccagaaccgggagucuuuucacugugccuugcuguauggagcguuucuaggcagucuugguuggugcugagggcagaagcaggcaguugccucugugaggugaagacuaaagaguugaaagcuggcaagccuggcccuguggacaugcuagaggaguugccaaccugaugugggcucagggcagugggacagagcccagagcugugucugcuuaggaaaacugggcaaguacagggagcuccagaugugcaagguucccugagccuugaaguaguuccaagacggaggaggaggggcccauaaccuacaguggaggaaaaagggcuuggaacagugcggcccuccucaagacuauugagaaguagccuuuuccugcagaccgcgcccuucuagggaggaaaccaagcaugggggcaggagaggcuggaggcucagcaguccuuccacaucuuucugagucagacacuggacugucacaagucugggcaacagaggugcaguuacccccauuuuacaagugaggaugaaaacguccagaagagaaugaaagaguguaccaggugggagggggcagugcccuggggaggagugugcauaguugcuggaacagugaggcagcgcgggacagccuggagcaaacagccaggagaggagggcugagggcucacagggaccaggucaugucaagcugucacaggccauuuuaaagacuuugguuuuuacucugagugaagugagaagucauuccucugacugcuuuuggaaagacuggaaacagcaaggaagggaauagggcgaccauuaggggcccucauaauagggccaagagaugauagcagcuaggaccagcacauugauggugggacuggugggaggugguugcauucuggauauguuuugaaagauaggauuugcugaugguuuggaugugaacuuaagagugaggagaggaguuaagggugacucccaagguuuuucgcccaaggaaguaggagaauggauuugccagguauugaggugguuaagacuagcagguaagggguggaggagcaggcuuagggaggaagauggggaguuguguuuuguacaagguagauuugagguguguguuagaauugacacuuggauugauuaccuacaccugguguuggggagauggcaaggcuggagguaucacuuugggaguccucagcauaugguuguauuuaaaaccaggacacuggaugagaucccacggugauagccacagcauuggugucccuuccuucaauacggaacauguuuuuaauaaaaaauaauaguuuuagggacagcuuuuaugcauugagugcuauuacuuuuuugaggcacuuucgcaguugcuuauaugugaaauaauuguagggacagcuucugugcauugagugcuauuacuuuuucgaggcacuuucacaguuguuugaauuuucagguauuuaguaaguuacacaacagguggugacucuguguccccacacucgauucuugagaaagccagggcauaaacugggcugugcgcucaggggacaggccuggauagagccaggauuuaaacucugcugcccugucuccucuuucugcccucucacagcaguucucuguucccugagccuucuuguugccagguugcuaugaguuguugcggucuugaguuaaacuguaugauuacagugcugguuccuugggaagggaccacuaaugaccuugaaauccuggccccccaaaaccacuguuucacuagcguguucucauuugcacagucagcauuuccuggguuucugcugugugccgggcaccgugaggaucuggauucccagauccugccuacacuggguagcaaggggaaggguuuccuuggccaggccucacagaaggcuuccuccuuaaagaggccuccucguuaaugagcaguugggccaaguucucagaccaaucuuggccaaauugaaaucucaggacuggaaaggcuccccaugugcugucaaguuucaucccucuggugcuaaugaaaaccauccauauagcagucguuucuuuuagugcccccugaguagcuucuacaguaccucacugagccuuuucaacagcuccaucgucccccaucgccuuuucuaucaagggacuuggguucaaagaauguugcccagggucacagagcuaucuugugaacccagggcugucugacugcagagauaaaugccugagccuguacccgcugccuccucugguagaguggcacuucaucucgcccaccugccuaccauccugcuauagagcaggcuacggggcuggaccugagaguaggaauaaugcauucuacaaguaaaauuuguuuuacaaauuuuacacaugaagaagcugcuauuuucuuucuuucuuuuuuuuuuuuuuuuuuuuuucuuuuuuugagacagucuugcucugccacccaggcuggaguggugcagugacaugaccucggcucacugcaaccucugccuccccagcucaagcgauccucuugccucagcccuccaaguagcugggguuauaggcacacaccaccacacccagcuaauuuuuguauuuuuaguagagacaggguuucaucauguuggccaggauggucugaaacuccuggccucaagugauccgcccgccuuggccucccaaagugcugggauuaacaggcgugagccaccaugcccggccgagaagcugguauuguuaagagaaaagggaaaugauguaguagaaaccucaaaccuaagcacuggccugaacuuaggagacccagggucagguccaagucugccuuagaaggccccucucuucccagcugugugacucaccccuaaucucuuaagcuuggguuucuagucugugcagugaggcaauugcacuggaugaauuuuuuugggccauuguuggaacauuuuauagcugugugaccugggccuggcuuagggcccuuuggagugagacaggaaggcacauggcuuggugaacaccauagaugucagccguaccuccccacccccaguuaagcagggcaagguagauccaggcuggguuuuaguaaaggccugaguggcagaacaggugucauuuuacaucagccucagucuaacagauucugggcugcuuaugagucuuaacacuggccagaggcugugauuucuaguaggaagagaauagucaccucuauuacuuucaguggcaaaaaucgcaauuacuuuuacacaaccuaauauguugaaggaagagguccauggaaauggaggcugccagggaugucuuugucagcuucuggucucccaagauaaaugcauaccuguagugggcuagaaaggggcagacuuaagaucugaacaccugaguuaggugccguugcaaucacugaccuuacccaggcuggucuugcugaacuucucccccuuguaaaauagcaauaagcgagcacuggugcugugugcagagcuuuacaucugcuuucugacucgauccuuacaacagccccgagaagggcuaguaauagccuuauguuauauaaacaaauuuuaacagggaaaucauuccugcaguucuguuuuaaaagauauaaauuaguauaagugaagccucucuccccucugauccuugacauucuauucuaaugguuccaugaagcagcuaauuuuaccaguuauuaguguauccuucuagagacauuuuuaugcuuacaaaggcgaauuguauuccucuuuuuuuacacaaucaguaauacagcaugagcacacuugcuuucccaguauuaucucucggcaauuguucaguucacgacauauaaaauaccuugauucuuuuuuacuggugccuuguaucccauugaguggcauaccauaauuuauuuugggguauuacaaauaaugcuauagugaguaguguuguaaauauauaucauuuaguguuuauauggaucugucugaguguaaauuccuaaaguggaauugcugguuuaaagggauuauggauuugcaauuuuagagcuacugccaaacacucuucccugugcaggucauaccagugugcccucccaccaacagcgugugaauguacccaaugcccaagucaccaacacggucuuauaaagcuuugucaucuuucccagucugaaaaagugaaaaaucagagacauuuguaggacuccuuauagaggaauuucuuugccuguggcaugaauugccaauguauguucucuguuugucauauuuggcuugugacuuugcuugaguuuugccauacagaauuuuuaaagguuuaggugguugaugucaacaagcuucuuuuugagcuucuagguuuauuauaauccuucagaaaggcuuuuccaacucuuagaucauuuuuuuuucuuugcagagauuuuucuagaucuuagaguuuuuuaauaauuguaucuuacuuucagcugaaauuuauccuagugcaaagcaugaggaacauuuugauguuaauacgaggagacaaaucuuaaggaauuuguuuaagguuacaaaguuugcacaugguaaagcuaagagucaaacccaggacucuugcaucccaaaggacucuugaaucauaugcaggacucucugaaucccaaacucaugcuucugugauaggaacuaccggacauuaugccuuguaggauuauugugagcauuaaugagcaaaguuagaaaguggguuugugugugcugggcauaggggauacacggauguuuucuucagacccuggcccuccuuacugacaguacugauacuuguccugaauaucauuaucguguguacugagcacgagguuuugcuagauuuuucaagcacauuugucuuaauacuuuuuccuuccuaucccauucagguucacagaaugauugcagaguucaagcugaucccuggacuuaauaauuuguuugacaaacugauuuggaggaagcauucagcaucugcccuuguccuccauggucacaaccagaacugugacuguagcccgguaagcaggagacccccggggacagauggggccucacuggcuuggaguaguuguuucaagaccugcugcugacccuuugaccuuuuuuccuuugggaguagagcagaaacuaaaaucauaucuuauaguccccuaauuggaagcuaccuuggaguaggaucugagugaacuccacuccccaccccaaccuaugcagaaaucccuuuuaagaucuuccuaggcugggcacagugacucaggccuguaaucccagcacuuugggaggccgagcgggcagaucacuugaggucaagaguuacagaccagccuggccaacauggugaaacccugucucacuagugugagagacacuugcgucucucacuaaaaauacaaaaauuggccagguaugguguugggugccuguaaucccaacucuucgggaggcugaggcaccagaauugcuugaacccaggaggcagagguugcagugagcugagaucacgccacuggacuccagccugcguaacaaagugagacugugucucaaaaaaaaaaaaaaaaaaaguuccugccugaggcccucuagccaacuuccccuuguaaucucugugauagggaucucauuucacuccaggcaggggcugcccacugcaugagcuagcagccugcuuuuccuuauuugcuguuuuauccuauuguaauuuucauccaccuauagaaccgugcucccgggcgugguggucacacccguaaucccagcaguuugaaaggccaaggcgggcagaucacuugaggucaggaguucgagaccagccuggccaacauggugaaaccccgucucuacuaaaaauacaaaaauuagccaggcauguugguggggcaccuguaaucccugcuacucaggaggcugaggugggagaaucacuugaacccgggagguagagguugcagugaacuaagaucaagccacugcacauccggccugggugacagagcaaagacacugucucauacaaaaaaagguggcuuugguuuuuugagcccaagcacucuccuuuagcuugugucucucacaguccccuugagagagcucugaacaggacauuggaaggcuuguuggaagagcuugaaugaaucacugaaucucugagccucuguuuucuugcaaaagaaggauaauacucuuuccccuauuggccccccggcuagucggcacccugccuaccagcaugagaaggaaagugcucugggaccuaaaagugccacccagccaucggccuggugccauggggcccucuucucuucacugcacucuggggacuucccucagcgaccugucuucugcuuuaucauuugaguuuuuaauuucaagcaaauauauuuugcauuucuagauguucugucuggcucaauucggaaacugcuuagccaugauguuaauaucuuuuuucugcugcauauucuguuuuuaaucauuuuuaaaauacuuucuuaaggucucuuucgauugcucauggggcacuaaugcuuguguuugggucuucagaccucaggguggaguguugccucguguuuuguaaugucuguggagcggccaccagaauugcuugaacccaggaggcagagguugcagugagcugagaucacgccacugcacuccagccugggcaacagagugagacugugucucaaaaaaaaaaaaaaaaaaaaauucugccugaggcccucuagccacuuccccuuguaaucucugugauggggaucucauuucacuccaggcagggagggggcugcccacugcaugagcuagcagccugcuuuuccuuauuugcuguuuuauccuauuguaauuuucauccaccuauagaaacgugcucccgggcaugguggcucacacccguaaucccagcacuuugagaggccaaggcgggcagaucacuugaggucagugggguuaguuucccccuuggauaccuguguagccucagcccuggaggcauuucuacagggcacuuuugcuuuugucuggcagcugucccagggccaguuuucuuauuuaaugucuuggcccuacugccccagucguaugagcccaggguuucugcugcucuugggagggcccccuucacccaccagcagcaccauggcagagccaggcucccugggcuggugggucaggccuuucuaacccuucuuucaccaaguguacaugcuccccaggcuuuacugggaccugacacccugucuagucccugcagggcauuaaaacccaagccuuagugugacuaggucuugucuccaccucuccacacugcccacagcugcugaguaucaguuccuuggcucacuauuccaaacuccucgguccuuucuucauuucuaacuccuauggacuucccccgcuccuccccacacguguuguuuuguuuguugguugguuggauuuuugggacagagucuccaucacccaggcuggagugcagucaguggugcgaucucggcucacugcaacuuccgccucccagguucaagugauucuccugccucagccuccugaguagccagaauuacaggcgcagcaacuaugccuggcuaauuuuuguauuuuuaguagagacaggguuugccauguugcccaggcuggucucaagcuccugaccucaagcgaucugcccgccucggccucccaaagugcugugauuacagguguaaccaccacgccccgccuuauuuuuuauugagugugauggcauguuuuuagcaggaagggggccacauuagcuuaaucugcuguugaucagauguggaagugaacagaugguuuucuaacuaaagaaaaguccucaugguacaugaggacagaggcuuagagaagcaggcucccaccagagugucugcuuguguuauuuuggaaccuuguggcugugguccuaacauugaggcugugcauguguuucaggacaucaccuugaagauacaguuuuugaggcuucuucagagcuucagugaccaccacgaguaaguacaagagugucccugcaaggagaguuguugggcugucuucggaaggccucgaucuccuugucuggucccugaccucagcucgagaggaggcccuggagcugguggaagcccacuguccccucaguguuagcaggugugacacugcagucggaccucccgucuuuccagacuuccuuauggcaggcacugccccaagcuuucuucuaacccucauagccaccccaggaacugaguauggaagucguuggccccuuacuaccuuuggaaucaauggauuucucaaccuacugccccucuaaagcaagaguggacagcguggcuauucccaggggccggcaggaacuucagacaggcaaagccgacugcuuacugagcagcuggaggauucuucccuccacaaggaggugugcucccauuuuucuugaaagacauucugcgcucauuuauuuuuuaaccuucgauggagaauguacaaggaaaauuacucucugcuguaaggaaaacagugcaggaagggggugacuagcagcugacccuugaccuuggcauuggggaggugauguggggaccuuagugaacaagaauuucagugagcucagcuccagccagcugcgugugcacaggaaacugggcccacuguugcauaacuucugauuuuuucugccaagcaaaggcagaaauuaagauuuaugugaaagguccugauuuuaaauguugguuuaaauauuuuaaaaaccuugcauuugagcuaacagaacaugccuggagacagcuguggccccagggcaccuccaucauaugcacccauccucugugagagguuuuccggcugaaagccauagaagggcuccaggaagcauguuaaccuucugaaaaauggcaccacauauguuauggaacugugcuguuuucccugaggaagugagucucuggcuuucaucagacucuucagucugaguacucugugggauaucaggaugaaugcaaacagccauggccccugcucucaugaagggcagagucugaaaacagagacaguuguucauccaaggauuccaccguugagcauuagugauaaguggagaugguauucaggaggagaggaacggggucugugagagacauuugacaggguccaggacuggccagaggacacucaggaacucuccccugcagaaguggcuugccagccaagaccugaagugucagcuuguagugaauugagugaacaggcaugugagaggguguguguucuagccagaagccccugaacgagggaagaccauuguggccagcugaugggagugaugugggcuuggcucugggcugggcugcacaggacguugugggucacagucacaggguguugugggucacagucacaggccuggauuuuauauacagaugguccacuuagaauuuuucaacuucacaaugguacagaaguagaauuuugaauuuugaucuuuuccugggcucaugauaaacaguucaauacucuugcaaugcugggcacugagcugcagcugcagcucagaauguauuucaagaaaaauggugaccagcuacacgaucaccaagguagacaaccaguacucugugcugugccugccguguugccagugauuauggccaacuguaggcugaagucaguguucugagcacauuccagguaggcuaggcuaagcuaggagguucaguggguuagauauauuaaauguguuuucuuucuuuuucuuuuuuucaagacggaaucuugcucuauugcccaggcuggagugcaguggcaugaucuuggcucacugcaaccuccaccuucuggguucaagcaauucuaccucagccuccugaguagcuaggauuauaggcgugugccaccacgcccagcuaauuuuuuauauuuuuaguagagaugggguuucgccacguuggccaggcuggucucgaacuccugaccucgugauccacccgccuggaccuuccaaagugcugggauuacagacgugaaccaccgcgcccggccucaauauguuuucaacuuaacggcauuuucaaauacgauggguuuaucaggacauaaccuccuccuaagucaggaaaugucuguucuaaaugcagugggaagcuguggaaguguuuucaccgggagugacaggaucagaguccugauucugaagaucacuuuuggcaccgugugaugacucaguuccugugggauaccuuuuaguaaagggagcugguguccugggaacacaggacccagcagugacaggccuggauggcaagucgggggaagugucacaguuaaccaggccucugugugaugugugaccguggugcuuggugggacugcugcagcagggccaggcuugagugugauuggaccuguugagguguuggugccuuugagaaaacaaguggaaauguaggcaaagagaaaggcccagagcugcugagggaaggggccuugucgaugaauguggcaggcaggggucggggauggggguggggccagggagagauuccacugccugagagcccagaguucccuccugcaggugcuggcuggagugagaggugcuagaggaaagugccugguggcuucucagauucuguccacaggaagugggcaggagacucccuacacuagccuggugcugacccagcagccccaguuccuguccuuuaccuccuccaacccauuuuguuucaggaacaaguacuuguuacucaacaaccaggagcugaaugaacucagugccaucucucucaaggccaacaucccugagguggaagcuguccucaacaccgacaggugagugcaggggugcagcuuuucccucagcccaucccggcugcccacguuccccgggggcucaccggugagcacauccagguaugcacgcguguccucucucacaugcagcuacaguguccugagggcuccugugugccaggcauuguauucaugucaccugcauuuucucauuggagccucacagcagcccuaggaggggagccccaucaguaccugcacuugacagaugaggugagccucagagaggucaccugccagaagucaugugugcuccgcacugccccaccgccuugucucgugcauucagccccuuugcuuaugugcuccuuucuugccugguggcaucugcagccaagcaggacagacagaagccucuuaccugcugccaaguguuagguugcauuaccuggguuagguuugccucaccuggagccaggcaguggggggcuagucucacaggcgucagaauacaguggacuuuauccaacaagagccaugauuucccaaccuuuuuuguuuguuuguuuuguuuuguuuuuuagacacaaggucuugcucuuucucucaggcugcagagcagugguguuauagcucacugcagccacaaacuucugagcucaagugauucuccugccucagccgcccgaguagcugggacuacaggugugcgccaccauucccagcuaguguuuuuacuuuuuuuuuguagagauggggucucacuauguugcccaggcuggucucgaacuccuggccucaagugagccucccaaaguccagggauuacaggugugaaccaccucuccuggccucccaaucuuuuuuuucuaagguagcagaacucuucauucaaauaaaauuguacccaguccugcccugaugucugcaguggaucacagcagagcugcucuguuugaagggcccagaccccugcgugccuggccgucuuccuucccccaugacggggccagagucauuuccucaucuccugccuuugcuucauagacugggaagcugaggcuuggaguuguggacacuugcccaaggccagcuggaagugaaccucaggcacggaguacgcugggccucacccuauuggcagagucuuuccccaucuggcagacuggcaugaccuguuucaacacacuuuugguauaaacagcucuccucuggcaguucuaagccaugucugauucuggauauguuucuggccugggaaggaaagcuggccugagauguggugggaaugcacuuggcaguuuaauucuguggcugcaggggucuccggggcucuggacccaguuggagcaggaaggcauccugcagacuuggaaauguccccaugguuuuucaccgccuaagccagcagaaugacccauccccagggccccugucagccucucagaucugucaccaauaucucucuucuauuucaggaguuuggugugugaugggaagaggggcuuauuaacucgucugcugcaggucaugaagaaggagccagcagagucgucuuucaggugagucuggggaaaaguaccugccgauucugcggggcugcagagccagguguuucucaggagguuaggaauaccuccuuuagucaccagcguccaugccuccugaagcacaauuacuguuggggagaggugguuugacugccaucuuguguaguuuugacucgacagguaugugagagcuucuucugcagcccacagugaccgagcauucaccaagcaccuguucugugcuggugccuuaugggugggagagaacuaggauacgggcccugccaugaauucccuagagcugugcuguuucaaugcagugugggaaggaauggagccaggguuggcccaggagcuauagcagcaaaggaaagccucuuccgcugcuagggcugggggcugggugaauacagggagaccuucucugagguccuuagauacaucuaagaugagucuugaagucaguggacagguagaguuccaucagggccgggcgugagcugucaggaggcuucaugcccacaugggccuuugucacuucagugccuuguccaaacucccugucguggauacccgcugugcccucugggucccucggucagcaucaaccacuacuucccuaggccagcccaucgucugugagcccaguggccugucugcauguguucguccgcuucccacacacauuccuggccccucaauugcacguccucccauucuugugaaagggcaaggccuagaguauguuucacgggggcucgcaggagccagcccuucgaucccagauguuacccuuucugugacacagccccuuccagacagacccagauagaagacuucuccacugagcuggcucucugugaggaugggggcacugcuguguccccaggcccaggaugaagccugaugcuugguagauguucaguaaauguugaguacaugaaaaggcaacaaacaucucccaaccccuuggagaacugaacaugggccggaagagggcagccuuagccaccugagccaguauuugggucgcagguuuuggcaagcucgggcuguggagaguuuccuccgagggaccaccuccuaugcagaccagauguuccugcugaagcgaggccucuuggagguaugaucuggagcagccagugucuuggguuccgucuccccccagcccacgcguugcuguguccuguccugagccccaaacaguucaucaggagcagagcagaucucgugacuuccaaaugccugugcaggcugccuuagauuuugcccuggguuuccaacuguggguuccccaugggugcuuacggggugacagguuuagaggguggccaggccaugcaggagggugacaguuugguuacccagcaaggcauuuugacccugaagauauuuuguacuaaaaguuaauuuuccuuuauugaauaauggucuucagaaaaaguaaaacuuagagcagaauggccaaaguuauaauuggucuuucagauuuuuucauauggacaagaaacugacccacgaauuauaaaauccauguggaaaagaauugauccaaaucaauguaacuucaagaaaauguagaaaacuuuauaaaggaguaaauuggcuuuauucucuugaugaaaacucaguauuuugguguaaacucuauuuaaacaauuucguucauaaacacaaagacaaaccauggggucaaaauguguccuuugcuuuuaaauucuguccuucauuuacuugaaugaccucagugcuuaggcaguggccuguguuuuagaccuggugaugacagcuccccucaccuaggagcugagcaccccggccaucuuggugaccacagagcaggucacaggcuucagcuguacgcccugggcaggggagagauugugcugcauucccagucugcuccaccuccuggugaggucugucaggccugguccuguccuuggagccaccagcauccucagacaagaaucuagacaguguugccaguuccauccccaggaugcuugcucaaagccaaugcauggucugagcuccaugccaggcccuggugggggcagccacguugacaccuucacccugucccuccucacccagcacauccuuuacugcauuguggacagcgaguguaagucaagggaugugcuccagaguuacuuugaccuccugggggagcugaugaaguucaacguugaugcauucaagagauucaauaaauauaucaacaccgaugcaaagguaaaguuaacccagggcucuguggagugugcuggguuguccagaaguucaccuggaguccuggucugccaggcuuuaggcacagguuuuacguuagagacgacgggggagucugggcagucuuuggcaaacauucauuggaaccugcucugucuggcuuugugcuagacccugggaaugcagggaugaaaaccggggcugcuuguggguagggagugagggugggaauggguggcuugugcgccugccgugacgcagcauggugggugccacggugggagccgcuguagggagggacugggccugguguguuaggcucaccgagugugugugacagaaacccagcucaggcuagcugaaguaaaauuaaaaguaaaaauuaaaggaauccagcacccuugagcguaaaaccacuggagagagugucggaucugugcugaauuccggggagugccucuuaguaccuggguggugaggggaggucccucagcuuaucugagccucugucuuccuaucugaagcaguggggcugguagaggucgcugaugccccuuguagugacuauccccccgggccauggccauaccuggccagcagcccacugccugcugugagcuugguuucuguauaguuccagguauuccugaagcagaucaacagcucccugguggacuccaacaugcuggugcgcugugucacucugucccuggaccgauuugaaaaccagguggauaugaaagguacaugaaaggcaggcugucaaggcaagucaugcaggguaagaaugcuggcaucagacacccugucuccagcagggagacaagaaugacugagggagcugcaccagaugcccacguggccggccucaagguggcggcuuccagggcaauuggcuuugcugccuuguucaacacuuuaauaaggugaaaauccauuguugcuagcaagaugcaaagaaaaccagaaaaagaccuuccucuucugggcugguauugccuggcacgaugaguuggcccccucguccucagugugcugugcguggcaucgcaggugcccuguggugcagcaggcaucugaacccuccuggacuugcuaacgcacuuccauguguaugcgcacgcguuuccuuuuuuuccuaggagagggcuuguggcauccagcagauucuccugaggguuugugacccccccacacccccaaaaagucaggcacuuguuccuugucacggucacugucauugauagcaagaaguaucccgguuguugguaauuuagccguuugcuuccuuuuucugccccagagggucuguuucaggggaacagccacacagauuuugguaccuucgguuauugcccugccucccaguugugcgggaagcaguugcuccgacacuaguggacggagcagaaccugugccuuguggucucagcacugggccggacucaccugagagcugguguggaaaaccaguugcgcuaggaccucugcagaaggaguggaacuuuugcguuguuuuucuuaaugcagcgucauggauccaucuuccuguggagggaacucuucugugugugauauggagggcacgggucuggagccagucuggggagggcugagggagagcugcccugagcuugguucuggaggaugagguggggugcuccugggcacucugagaacauggcuuugccugguagcaggacagcuggagguccuucuuucugccacagucagcuuucguugaagcuguuuugaugaugagcuccuagcuucagagucaggacccaagcggggcuccacgaaaggccugggcgacccagccacugggccuaagccugaccugcugcaccccugccucccuccacaguugccgagguacugucugaaugccgccugcucgccuacauaucccaggugcccacgcagauguccuuccucuuccgccucaucaacaucauccacgugcagacgcugacccaggugagaggccccggcagacacacagcagggaaggucgauuggaaaccacuuccuuuguccuggugcccagcagguuucugucccccacuccagaagugcgucucuggagacccagcucuucugaggacugugcucaggaggaaucagugucccauuguacagacagggccuaaggaaggagggcucgcaagugcccucaggucacaggcugacuugcaggccagugcucuccccgccucccccauguccacgucccucacaccuucugcccugcugggcuuuggaaucggaccugaggcugcccaacucccucacugaauagucaugcagccuucccuucucugagccuccugccccucuuuucuagagugagggugaucuuagcaccucucagagguggucuuugguuccguucugaggugaagcaccaggugggagugcauggugaguggggcagaacucuuuccccaccgaggcgcgcaggcuagugcugaauggcacuucugaagcgggauaaccgccccaacacacgcacccagcccugccugggacggaccuuccggaaggagugaugcuugagcccaggucuggacagggacagguguuguugccucagguggggugggaggugggcguggggaagaggaaggugcucagucaggaaacuggggcugcugggggcccccuucccccaguccuaucucaccucugugcagggagagcucuguggguggcccgaggccuggggccacucuccucccugccugauggcuacccagguucaccaggggccacuggggcucccaccagccccugacccugugggccuguggccuugcaggagaacgucagcugccucaacaccagccuggugauccugaugcuggcccgacggaaagagcggcugccccuguaccugcggcugcugcagcggauggagcacagcaagaaguaccccggcuuccugcucaacaacuuccacaaccugcugcgcuucuggcagcagcacuaccugcacaaggacaaggacagcaccugccuagagaacgugagugccccacccucaagggggugaugggugggccgcggacccagggccucucagaggggugucccggugcugggcuugaccuggguccuccaggcgccccccagccccucccucuuugcccagagcuccugcaucagcuucucauacuggaaggagacaguguccauccuguugaacccggaccggcagucacccucugcucucguuagcuacauugaggagcccuacauggacauagacagggacuucacugaggagugaccuugggccaggccucgggaggcugcugggccagugugggugagcguggguacgaugccacacgcccugcccuguucccguuccucccugcugcucucugccugccccaggucuuuggguacaggcuuggugggagggaaguccuagaagcccuuggucccccugggucugagggcccuaggucauggagagccucaguccccauaaugaggacaggguaccaugcccaccuuuccuucagaacccuggggcccagggccacccagagguaagaggacauuuagcauuagcucugugugagcuccugccgguuucuuggcugucagucagucccagaguggggaggaagauaugggugacccccaccccccaucugugagccaagccucccuugucccuggccuuuggacccaggcaaaggcuucugagcccugggcaggggugguggguaccagagaaugcugccuucccccaagccugccccucugccucauuuuccuguagcuccucugguucuguuugcucauuggccgcuguguucauccaaggggguucucccagaagugaggggccuuucccuccaucccuuggggcacggggcagcugugccugcccugccucugccugaggcagccgcuccugccugagccuggacauggggcccuuccuuguguugccaauuuauuaacagcaaauaaaccaauuaaauggagacuauuaaauaacuuuauuuuaaaaauga

SEQ ID NO: 191258 - RNA, 109577 nt, Homo sapiens
gcagggagagcgugcccgggcacgacagccuggugcacagccgagaaaacaacagcgcgugcgcguagcgaccucuuugcgccugcgccccccuugccagucuuucgccggcaaaaggaggacguagaaaaggggacaccggaaacucacucuucacccggaaaugguuauugaggaacauggcguugcuggugcgaguccuugugagugaaggaguaauuuucuacgguagcucucugggucccggguuggaguucgacaaggcagggcgggaggaauuggaaggaaucgcaggagggaagccuguguuauagcuaggcugaguggccgcuuuuccguggggaaacugaggcagcuuccgaccucuuccuaccccguuuugaccuuagcucccccaucuuucgagaaggggaagacugacaucuggccuuuauuugaugggguuuacuuuuccuucccucccccauguaccugcuuccccucagggagaggagcauguaggacacugauuggaguuucaggaggccuggguucuagucccugacugucacugaugcauagugacuuuaagcaagucacuuuugggccucauugacccuaugugaaaaacgaggacauuuaucuccugcagucccuuuagauucugagauucucaggguuucuuucauagguaauaagucaguucuuaacuguacaguuaaguggaauauagauuauuagauugaaagcugcgugagaauuggagucaugucugucuccgucguuuucacuuugccuagcauggugucuggcacaucauagguguuaaaugauuacuuguugaauaaaugaaugaaguaaggaaagacuaccagacucuuuagcacccgugugugaaacuacugcaccucuugagauuuaguccugacccuucuagcauacucuuuucucuagcaauuaaaggagaaaagaaaguggcagcagaaaaaacguuaggauacagagcuuaguuuuuaaucauggagggaugggagaguguauaguuuuagcgagucuucaaaaacugggucaaagacacuguuuuucauaguagacauggucuauuccugugucuagguaacuucugaauuguuauuuuacauuuguguuuuugaucuuuuuauauaugucuuacaaggacgacaguuuuacuucuuguauuccuugccagccuagcagagugagguacccucgacugcuguucaguaaauauuuauuuguagaguagccccuguaacugccagaaagauucaccuggugaagugauuguuugauuucaggccagaaauugauucagaaaugaggacugcuggggaaauggcaauuagaauguucugaauuuagugguuuuuuuuuuuuuuuuuuuuuuaauccuuccccugccacccuuuaggguuuuguuuuuuuuuuuuuuuuuuuugaggcagagucuugcucugucgccgaagcuggagugcaguggugccaucucgggcucacugcaacuucugcucccggguucaagcaauucuccugugccagccucccgaguagcugggaugacaggcaugcaccacaccacaccugacuaauuuuuguauuuuuuuuuuuuuugagauggagucucgcucugucacccaggguggaguucagcggugugaucucggcucacugcaaccucugccuccuggguucaagcaguucuccugcuucagccucccaaguagcugggauuacaggcgccugccaccacaccuggcuaacuuuuguauuuuuaguagagauggaguuucaccauguuggccagacuggucucgaacuccugaccucaugauccgccuccugcggccucccaaagugcugggauaacaggcaugagccaccgagccuggccugacaacuaucauuuuauagggcacuuacuacgugcuaagcacuuuaaaauacuuaccuaauccuuauaacaucccuuuggaaaggagggcguguuauuuccucuauuuuacagauaagaaaacugaaccacagagagguauuccuggccaggugccguggcucacaccuguaaucccagcacauugggaggcugagguagguggaucacuugaggccaggaguucaagaccagccuggccaacguggugaaacccugucucuacuaaaaauacaaaaauuagccaggccugguggugggcgccuguaaucccagcuacucgugaggcugagacacgagaauugcuucaacccaggaggcggagguugcagugagcugagauugugccacugcaguccagccugggugaaagagugaaacucugucugaaaaaaaaaaagaaguauuccugaaacauucuuguuagucuugcuuuauuuuuuccucuuuuugucuugucagccaauauuuucccuucuccagugaugguuuugggaaggaggaggaaacuaaaacacugcuauuguugaaugacuacagcagagagccuggacauuugaucaguggaacuggacaugcuuaugguuuuuaugaguuguccugggcauugcugaucauuucugcuuuucuuuggaaauaguaaaaauugcagaaagccacccuguacuuuagaaaauuaaaaaaaaguugugguaaaauacauguaacaaaauuuaccuuuuaaacuuuuuuuuuuuuuucugagacggaguuuugcucuuguugcgcaagcuggagugcaauggcgugaucuuggcucacugcaaccucugccucccggguucaagcgauucuccugccucagccuccugaguagcugggauuacaggcacgugccacuacguucagcuaauuuuuuguauuuuuaguagaaaugggguuucaccauuuuagccaggcugaucuugaauuccugaccucaggugaucugcccgccuuggccucccaaagugcugggauuacaggcaugagccacugugcuuggccaccuuugaaacuuuuuaaguguacaguucugugguauugagugcauuuacauuguugugccaucuuuaccacccuuauccacagaauuauuuucauuuuauaaaacugaaacucugaaccuauuaauaacucucuauagucuuuucuccccagccccuggcagccaccauucuacuuucugucuccgugaguuuaacuacuuuguguaccucauauaaguggaaucauacaguauuugaccuuuugugacuggcuuauuucauuuagcguaauguccucaagauucauccauguuguagcaugugucagaauuuucucuuuuuuuuuuuuuggagauagggucucgcucugucaugcgugcugaaguguaguggcucaaucauagcucacugcagccuugaccuccugggcucaagugauccucccacuucagccuccugaguagcugggaccacaggcaugugccaccacgccuggcuacuuuuuuuuuucuuuuuuguagagauggggucuccuuauguugcccaggcuggccuugaacuccugggcucaagcaauccauugucucggucucccaaagugcugggacuacaggcgugagccacuauguccagccuguuuaauuuguugaggaauuguccuacuguuuuccacagcagauacacuguuuuacauucucacuagcagugcacaaggguuccaguuucaccacauccuugccaacacuuguuauuuucugguuuuuguuuguuuguuuuugagacaaggucuugcugugucaugcaggcuggagugcaguggcccaaugacagcuuacugcagccuccacuucugggcucaaguaauccucucaucuuagccucccgaguagcugggacuacaggugugugccaacacacccagcuaguuuuuaaauuuuuaguagagaggaguucuugcuauguugcccaggcuggucucaaauuccugaguuuaagugauacuccugccucagccucucgaaguguuaggauuacaggugugaaccaccacacguggccuuauauucuguuuuuugacaauugccauucuaaugaguaugaaauggugucucauuguauuauugauuuacauuucucuagugacuagugauauugggcacuucuucaugucuuuuuucuuuuugagacagaguuucacgcguguugcccaggcuggagugcaauggcaugaucucggcucaccgcaaccucugccuccugaguucaagugauucucccgccucagccucccaaguagcugggauuagagaccugcaccaccacaccuggcuaauuuuguauuuuuaguagagaugggguuuccccauguuggucaggauggucucaaacucccaaccucaggugauccgccugccucggccucccaaaauccugggauuacaggcgugagccaccacgcccagccuuaaauuuuguauuuuuaguagagaugggguuuugcuauguuggccaggcgggucuugaacuccugaccucaggugauccacccgccuuggccucccgaagugcaaggauuacaggcaugagccacugcaucuggcaaguuuuucauauauuuugaauaucaaucccucaucagauauaugauuugcauguauuuuuccuauccuauggguugcuguuucagucuguugauacuauucuuugauacacaaaaguuuuaaauuuucaugaaguccaacuuauuuuuuuuucuuuuauugcccacucuuuuuuuuuugacagggucuugcacugucacccaggcuagagugcaguggcacaaucuagacucacugcagccccugccucccagguucaagcaauucuccugccucacccucccaaguagcugggauuacagucaugcaccagcacaccuggcuaauuuuuauguuuuuaauagagaggggguuuucccauguuggccaggcuggucucaaacuccuggccucaagugauccgcccaccucagccucccagagugcugggguuacaggugugagccaccaugccuggccuauugccuacuuuuuugauaucauguccaagaaaucauugcaaaauccaaugucaugaagccauucccguaaguuuucuuuugaaaguuguaucauuuuagguccuacauuuuggucuuuuauccauuuugagcuaauuuguguacauguuacaagcuuuuacuauauuuuaugagcuguuuucuuaguggcugcccugggauuacaaugaacaucuuaauucauaacagucuuguuuggauuaauacgaacuucauuucaguaauauguaaagacuuucuuucuauauagcucuguuccuucccgaacauuguguuauugucaucuaaauuacaucuuuaugcauuauaugucuaccaauguagauuuauaauuauuucuucuuguaguugucuuuuaaauuaaaaagaaaaagaauuacaaacaaaaaauccauuuguacuguauuuuuuauuuaccuaaacaguuaccuuuaccagucuacuuuauuucuucauguagauuugaguuauucuguaguuuccuuucauuucaaccugaaggucugccuuauucuugcagggcaagucuacuacugacaaauucuuuccauuuuguuuaucugggaaaucuucauuuuuuccuucacuuuugaauaauaguuuugcuggauauagaauucuuguuugaaaaucuuugucuuuccuuguuuugacuauuuuaucccacugccuucuggcugcuacaguuucugagaagaaauccacuguuaauguucuugaggauacuuuguauaugaugaguuucuucucuugcucauuuaaagaaucuuugucucuuggcagcuugcauaugaugugucuguggcucucuuuguguuuauccuauuuggaguuaguagagcuucuuggauuccuaaauuaccauuuuccauuauguuugggauguuuucugccauuauuucuucaaauauuuuucgguccuuuucuuuccuucugagacucuaauuauacauauauugguguguuugauggugucccacagucugaggcuguuaaauuuguucuuuuuuuucuuuuuuuguuuuugcuuuucauuuugaggcuacuaauuugucuuuauugcuuuuucuuucuguuccuuggacuggaugaucuaaauugaccuaucuucaagaccacugauuauuuucuucugccuguucaaaucugcuguucagucccucuaaugaguuuuucauuuuaguuguuggacuuuucaauucuagaauuuauuuugucuuuaaaaaaauaacuucucuuucuguugauauucucuuuggugccaucuuggcucacugcaaccuccaccucccggguucaagcgauucucccgccucagccuucugaguagcugggauuacaggugccugccaccacgcccggcuaauuuuuguauuuuuaguagagaugggguuucaccauguuggccaggauggucucaaacuccugaccucaggugaucccccugccuuggccucccaaagugcugggauuacagguguaagccaccgcacccggccacuuucuuauaguucuuuagacauauuuucauuuagaucuuugaacauauuugaaauaguuaaaaaucucuuugucugcugccuggguuuucuuagagacaguuucuauugauugcauuuuuucccccuguguaugggccauacuuuauuguuucuuugcauguuuuauaacuuuuuguuguugaaaacuggacauuuuaaauaauguggccacuccggaaaucagauuguuucccuucccaggguuugcuguuguauuuuuguuuagugacuuuucugaauugauucuguagucuguauucuuuguuguuuguggcuacugaagucucugcuuagauagcuuaguggucagguaaugauuaaacaaauuucuuuaaauuucuguuaaauuucuuaaaauucuguucucacugccuggaagcagugaguaucccaguuuuugcuuuggggcucugugugcacguugggauguaccuauaacacucugccaggcauucgauaacucugccuuaacuuucacuuccugcuaugcagaaccucaaggucaaccacaaguaagagacauucuuaggucuuuccugagcaugugcacagcuuuggguauaugcacagaccuggguauguucauggcuuccuagaugcccaggaauauauuggggcuuuucuaagccucuguggacaucuuauuccccagcuuuuccuuuaaaccuuuuugguuagccuguuguuuucuccaccuguuaaucacugccucaggaagccaugaagucaaacaguuaccucuauuuguuuucaaccggugcuccuggggaaaagguuuuuucacacugggugaguucuaagacagccuugaaauagggccuucuaaggaacugucagacagguugaauaaugccaguucuuuuuuuuuuuuuuuuucagagucaagcuucuuuuuuuuuuauacuuuaaguucuaggguacaugugcacaacgugcagguuuguuacauauguauacaugugccaugauggugugcugcacccauuaacucaucauuuacauuagguauaucucuuuuuuuuuugagauggagucuugcuuugucacccaggcuggagugcacuggcgcaaucucagcucacugcaagcuccaccucccggguucacgccauucuccugccucagccucccgaguagcugggacuacaggcgccugccaccaugcccggcuaauuuuguuuuuuuuuuuuuuuugagacggagucucgcucugucacccaggcuggagugcaguggugcaaucucggcucacugcaaacuccgccuccuggguucacgccauucuccugccucagccucuccgaguagcugggacuacaggcacccgccaccacgccuggcuaauuuuuuguauuuuuaguagagacggcauuucaccguggucucgaucuccugaccucgugauccgcccgccucggcuucccaaagugcugggauuacaagcgugagccacugcgcccggccacgccuggcuaauuuuuuguauuuuuaguagagaugggguuucaccauguuagccaggauggucucgaucuccugaccuugugauccgcccuccucggccucccaaagugcuuggauuacaggcaugagccaccacgcccggccuagguauaucucuuaaugcuaucccuccccgcuccccccaccccacgacaggcccuggugugugauguuccccuuccuguguccaaguguucucauuguucaauucccaccucugagugagaacaugcaguguuugguuuucuguccuugugauaguuugcugagaaugaugguuuccagcuucauccaugucccuacaaaggauaugaacucauccuuuuuuauggcugcauaguauuccaugguguauaugugccacauuuucuuaauccagucuaucauuguugggcauuuggguugguuccaagucuuugcuauugugaauagugccucaguaaacauacgugugugugugucuuuauagcagcaugauuuauaauccuucgggcauauacccaguaaugggaugucugggaauaaugccaguucuuuguaaggcuuugaugaacaucauccccauucuggagucaacuugucuccugaggagacuaguuccuuuagugguuguugcuauuuagaaaccacaucugggugcuacaugugcuuauugcuacuggagugucaucugcaggcccuaccaggacguggguaggaaauauauauaugucuauauauacacauaaacaugcauauaucuuuuucuuuauauauuaaaagcccacaccaguuauucuaaucuauucuaauaccacaggguuuguucuacucuuuugccuugccauauuuguuaacuccuuucucugauagaaaccugaccccucacccuuaauguauuuauugauuuauucaaaucuuuccuguauguaaucaaucuuuugaaagcucagauugaaaacucccaaaaaagugggaggaggcaguguauagguaauuuuuuuuuuuuuuuuugagacgaagucucgcucuuguccccuaggcuggagugcaauggcgcgaucucaggucacugcaaccuccgccucccggguucaagcaauucuccugccucagccucccaaguagcugggacugcaggugcaugcccucaugcccagcuaauuuuuuuguauuuuaguagagaugggguuucacuguguugcccaggcugguugcaaacuccugagcucaggcaguccgccugccucggccucccaaaguacuggaguaauuuuuuguuauuguuugagauggggucucacucugucacccaggcuggaguacagcagcaugaucucugccuacugcaaccuccgccucccggguucaagcgauccuugugccucagccuccugaguagcugggauuaccagcaugcgccaccaugcccggcuaauuuauauauauuauauauauauauauauuuuguuuguuuguuuguuuguuuguuuguuuguuuuuugagauggagucucgcucugucgcccaggcuagagugcaguggugcgaucucagcucacugcaagcuccgccucccagguucacgccauucuccugccucagccucccgaguagcugggacuacaggcgcccaccaccacacccggcuaauuuuuuguauuuuuaguagagacgggguuucaccauguuagccaggaugguuucaaucuccugaccucgugaucugccugccucggccucccagagugcugggauuacaggcguaagccaccgcgcccggccuauauuauguauuuuuuaguacagacggguuucacuguguuggccaggcuggucucgaacuccugaccucaagugauccacccaccucagccucacaaaguguugggauuacaggcgugagccacuaugcccggccuguauucaguaauuuuugaaggaaugguuaaacauucucuucuucccucuguggaaauauccuuuuguauuauagcaugccacauuguaacuggaaggaaaguuuguuaccguaguaucuguucuuuggacuccggaauugaguuaguauccauggcauuuggaauauaggcaccaguggugacuuauaaaguggauuucggcugggcaugguggcucaugccuguaaucccagcacuuugggaggcugaggcugagggaucaccugagguugggaguucgagaccagccugaccaacauggagaaaccccgucucuacuaaaaauacaaaauuagcugggcgugguggcgcauaccuguaaucccagcugcucgggaggcugaggcaggagaaucacuugaacccaggaggcagagguugcggugagcugagauugcgucauugcacuccagucugggcaacaagagugaaacucugucucaaaaaaaaaaaaaaaaaaaagguggauuucauguuuauaauugauuuucguuauucacagauucuauauuugugaacucaccuaguugcuaaaauuuauuugaaaccccaaaaucaauacuugcagcacuuuuguagucacuuguggacauuugcagagggguaagaaauuugagcugccaauguguguguuccuggcugagaugggucaacauuccgccuucuuguuucaguuuucauacuguaacaaguauucuuuucauggccuguuuagugccauauuuuucguauuuuugugcuuuuguuggugaaucccaucuuuaaaaugucacccaaguguaguauggaaacgcuaucuagcauugcugagugcgagaaggccacaaugugccuuaugggaaaauauguuuguuagguaaauuuugcuaagugaguuauagugcuguuggcugugaguuccguguuaaugaaucaacaauguauauuaaauagggugucuuucaacagaaaccaauaaaacaagguuauauauugauugguugaugaauguugugaccagaggcuuccaggaaccuaagucuggcauuuccuuuagaagcaaugguucaguauuugcuaacucaguguuuguggugauuuuauggugaauaacuagaauccgcuacaccuguaaauuguuuucuagcucaugaaugagccaaggaaaauacuauguaucuuaaaaaaccacaugcagaaacaggccugucaguggacugauuaaaggguagucaguacaagaggugguaugucagaauguuuugaaauacugauguaaaaaucacugcaauuaacaaugugcacgggaaacgaaaacaugaagccuaucuuaaaaauuuugguuuuggccaggcaugguggcucacaccuguaaucccagcacuuugggaggccgaggcgggcggaucacaaggucaggagaucaagaccauccuggcgaacauggugaaaccccaucucuacuaaaaauacaaaaaauuagccaggcgagguggcgggcgccuguagucccagcuacuugggaggcugaggcaggagaauggcgugaaccugggaggcggagcuugcagugagcugagaucccaccacugcacuccagccugggcaacggagcgagacuccgucucaaaaaaaaaaaaaagaaaaaaauuuuuuuuuugguuuugaaguguuggaaaggcaaaauggcaauaaaacuaguucucacuuaguaacagugcauuuaucuuaaguuaaaggaauaauuuuugccauugggaguggcuaugaaugucuuuugaacuugggagaaguugagaugugcuaauuguuauaggccuaauauauuaguaccuuaagagagagauaaguacuuccacagauuuauauuuauagaugaagugguggaagagguggaaaggaaaaaggacgaguagaggucgacacgguggcucaugccuguaaucccagcacuuugggaagccgaggccgguggaucaccugagaucaggaguuugagaccagccuggccaacauggugaaaccccgccucuaccgaaaauacaaaaauuagcugggcgugguagcgcgccgcucuagucccagcuacucggcaggcugaggcaggagaauugcuugaauccaggaggugaagguugcggugagccgagauugcgccacugcacuccagccugggugacagaguaagacuccaucucaaaaaaaaaaaaaaaaaaggacugaguagagccaguagaaccagaagcugacaucuagacagauuucuuuucuuuuuuuuuuuuuuugaguggagucuugcucugucacgcaggcuggagugcaguggccugauuuuggcucacuguaaucucugucuccccaguucaagcgauucuccaugccucagccucccgaguagcugggauuacaggcaccugccaccacgcccggcuaauuuuuguauuuuuaguagagaugggguuuugccauguuggccaggcuggucucgaacuccugaccucaggugaucugcccgccuauggucucccaaagugcugggauuacagaugugagccacugcgcccggccuagagagauuucuugaagcaauugagcuuauaguuuggguuggagugaagaggagagucccaaaaaauuacuacaaggaaauuagcauguguggagugaagcagugauucccaaaccagagaaucugagucagguguugaaacuguugaguggaaaacacaguaaguauuaugaguuuagagggguccaguugguaaagaccaguaaggaccagguguuuaaguuucaauaaagagguccuuggaaaccacugcaagcuuuugagaaagggaauaaaugccagauuccaaacaauauuuuaagaaaacaguuuuugcuucucuggcaguuugcuggggaaagcagggcuuguauaauucgguaacaguuguucauaacagugaugccuuuaguuguguuuuucuguuaucaaagugcuuuuaggaauguuccugggaacacuccugugagauagcuuuuauuauucccauuuuucauaagggaaaauggaggcccagauuguugaguaaccaguucacagcuauuugauggcagacuugggauuacccuuucuguuacacuucagugguuucaauuaaggauuuggacaagaauuguuguaggauuggcgaaggaaagaacagcugauuguuccuuucuucuaauaagaacugauuuaaaaguauuggccuaagaccaaccggagccaaaauuacagagaaaaguuuuguugacauuggaaauuacaugaugaaauucuucagaaaaucuuccaaaaguuugcauuguuucaacuuguaauuuccucuugcucccccugcaccgccccccccccccccccaccuuuggcccugaaucugaagcaguuuccucuuaucccauaguuaacauuuuuaguacaggaacaucugacauugaauguuucugguaaaucugucaguguuuguaaaacaaaacaccaguaacugucucucacuuggaaaaccauuucaacugauccaaccacagcucaaauaaaauauuuuuagcuccacuuuucauuugaaauuuaaggugcuguaaguggcaauuauacaauuuuagaacugugagacacuuuagaaagcaucuguagguuuaaaaauuuaaugccuuucuccaccccaccucaaccuguuucuacucgaggaaauggagauucagauucaacuuaauauugugcugaacauacugcaagguacauuuguuaauuuuaaagaaaauccugagaaguggggauuuugucuuuauuuuugauaaaaagagacaaccaaggcucacagaggugauuaucuaauauguagcuucugaacaguacuuccugccuuuaguuauguggcacuuuccacaauaugcuguuuuaauugguuccagaccaggucauauaguguuagagcuagaagguaccuugcagauacucuacccuuucaucccauaaaugagcaaggauucuagaguuggguugucuggguucauaucuuaauccugcuguuagaacuaugugacauugggagguugcuuauccucuccaugccucaguuuccuuuuuuguguaaaugggauaaugauauaccuacaugaguggugauugugaaguuuaaaugaguucauauauguaaaguaccagaaaagugccugccaucaaaugcucauuaaguguuccucauaauugcuaucaggaaacugaaugucacagagguuaaauuacuuguaaagauaauguuagaguagcugaauuuaaacuagaaucuuugacuccuaguacaauuguccccaaguaucccugguccuuugguuccaggaccucccucggauagcaaaauccguggaugcucaaguccuugauacaaaguggcauaguauuugcauauaaccuauauauauucccccauguacuuuaaauaaucucuagauuacuuacauuuaauacaauauaggugcuauguaaauaguuguuauacuguauuauuuagggaguagugacgagaaaaaaaaagucuacauguuuaguauggcauguuuuuuuccugauuuuuuuuucuuuuuucuuuuuuuuuuuuuuugagacagucucgcucugucacccaggcuggagugcaguggcgugaucuuggcucacugccagcuccgccucccggguucaugccauucuccuaccucagccuccugaguagcugggauuacaggcgcccaccaccacgccuggcuaauuuuuuuguauuuuuaguagagaagggguuucacuguguuagccacgauggucucgaucuccugaccucgugauccgccagccucggccucccaaagugcugggauuacagaugugagcuaccgcgcccggccugauuuuucuuuuuuuuuuuuucuuuuuuuuuugagacagagucucccucucuaucgcccaggcuggagugcaguggcacaaucucugcucacuugcaaccuuugccuccuggguucaagugauucucgugccucagccuccagaguagcugggacuacagguacacgccaccaugcccgguauuuuuuuccugaauauuuuaaucuguggguggcugaauccauggaugcagaacccauggcuguggagggcugacuguguuauacauuaugcuuggcaaaggauuuucaagcaauuuauguaucugguccucauuauggcccuauaaggucuacaggucaagugaagaaaacccucagaucccuagaguugguuccuaaaauuaagauuuccagugcuguguacauggcuaucauuuauacaguggaauguauuucagguucauaaaauaaagcagacuucuuauuuagcaagagagagcuaucccuuucuccagccuagccucucacuuuggccaagagaccuuucugaagugagcuucauguuagagggaaaacgugaaucucaguuuuagcuugaacagccauuuaaucucucuugucuuggaaaucaaguugcccacguguguuuucccacugcaaaacuucuacccuaguuuccuccuccuuuuggggaugaugaugaucucagcauugcuuacuauaaagggauucuaugaagaucagguaaguaagucaguguuuaugaaaacacauuguaagccaggcacagcuaugcaagccuuuagucccagcuacuugggaggcugaggugggaggaucacuugagcccaggcaucaggcauuugaggcuguagugugcaauguuagcaccaugacuaggcacuggacuccagccuggggaauguagugagacccugucucuuaaaaaaaaaaaaaaaaaaaaaaaggccaggcacaguggcucacaucuguaaucccagcauuuugggaguccgagguagguagaucacuuaaggucagcaguuuaagaccagccuggucaacauggugaaacccugucucuacuaaaaauacagaaauuagcccuaugugguggcucaugccuguagucccagccacuugggagucugaggcguaagaaucgcuugaacccaggagguggaaauugcaaugagcugggaucauggcccugcauuccagccugggugacagagcgagacucagccucaaaaaaaaaaaaaaaaaaaaaagacauugcaaaccguaauuugaauuauaaucuaaucauaaaaugccagaagucugcuuauuuuguuucucuucccagagggagcccgugcccacugcuugagucaccuauuaccagaauuauuuuagucuguggaaucaguaguaggcagugguuuaucuuauccuuggagaaaugagcauguggaggcuuggucuuggucccauuuuggaaguucuucauucaugugauaccccauucuggcaggauuuuuaaacuuagguacuaaaggccagaucuggaaugguccugaguguaguugcuucugucccuguggaauuagagugugccacccuccuggccuguggcugcaacccagauaugauauugugagagaagaaauauauauuuggucuuuaucccugguuccuggcacagagcucuugaaacccuugcagagugauuggggugagaggaaugguuuuuuuuuuauuuauuuauaauaagccccuuucaaccauacaugaguuuauggguuuuuuuuuguauagcugggggucucgcuuuguugcccaggcugguuucgaccuccuggcuucaaguaauccugcuucagccucucaaaagugcugagauaauaggagugaaggcaugagcugcuaugaccggcagugaguuuauguuaauaaggugacucuuggaggguagaggcugguugcuagaggaacaaauauguguguagaagguuggaacuuguagcuucucccacuccucccugacuuuuggaaggggagaggggcuggagauugagcugaucaccagugaucagugauaaucaaucaugucuacguaaugaagccuccauagaaaucccuggguuuggagagcuucuagguuaguaaacacaucaaaguguagggaggguggcacacccggagagcaagcucccaccccguacccugucuuuugcaucgcuuccauuuggcuguuccugagguguaucccuuauaauaaacugauaaaaguaagugaagugccuccccgaguugagccaugcuagcaaauuauugaaucugaggaggcagcugugggaacccccaauguauggacaaguuggacaaaagugugaguaaccuggggacccacuacuugugaugggagucugaagugggggacaguccuguuggauggugcugugaggucucugcuaacuccaggcaguuaguuuaagaauuaaguuaaauuguaggacacccaguuggugucugcagagaacuagagaauugcuugguauggagaccccuugccccugcacauuugguaucagaaguggaguguugaguauagaaaaaagaguuuuucaucuuuaccggaaguucucugaacucugucauuuagaauuuuuguggaggcuuauuguuggcaugauugauuaaaucacuggguaccagugauuggcucagucucuaaucccucuccucuccuggagguggggaugccuugaggaguuggggcugaguuccaacccucuacuccugugguagguuucucuggcaaccagccuccauccugcaugaaucaccucauuagcauaaacucagguaugguugaaaggggcuuauuaugaguuacagacaccccccucacucagaaauuccaaggguuuuaggagcucugugccaggaacuagagaugaaggccaaauauauauuucuaauuauauuacaguaucacagguacacucuuugccuuccauguagggaguaugauuuagauuccugacagauuauuauuuucuuucuuuagaggaaccagacuagcauuucucaguggguuccaguaugcagccgauugauaccugugucuccuacccaaggacagggggacagggcucugucucgcacuucccagguaagauuuguuguucuuuugcuuaguaugaaaaccuuaguguuuaugugcaaaugucauguauuuauagauuagccaaccaaauugugugauggaaaaaccucaugagaccacucugggucucuguggugccaacuuaggacugauuccuaaaguauggugucuagggcguugcuucuaaauacccuagcaguggaacuuagccuaggauaccaugcuacagucugaugauuuuuacuguuagggaauuuuuccagauauucaucuccgaguuaaccuuuuucaauuuucuuuuuguggccaucuugugcuacuuuuauuugggcgugauaauuauuucuuuuuccuuuauaugaauauaaaauccaagaaacaauuauuugagguauucauuuaccauugaccaccuaaucauuauaauguaguuuaccuuggaccuugugucccuccugauuuuuguuaauaauacaaauaauuuaguaauaagggaaauaaaucaucuaugacuucaaaucugaaaacgucaguauuuuaucucugcugguucuuuuucagccuguguguguguguguguguguguguguguguuuguguguguuuguguguguguguguguguauguauauguaauguuauuccugaaguacccuaacaaauguccacagaaguuuauauucugguaccuuuucacuuauuagaguggacauuauucauauuguuuugauagacuuuguaauuaaaaauuuaaugaccauauaauauuuuauuuacuuagccuuugauaugaaaaucauuuccuuuuuuuugccauuauaagcuuuaauuuucuuaccauugucuuagcacauauuuuuucuuacuuuuaauuacuuauuaauaauuccuaggaaggcauaccuugggucagaguaugaacaguuugccucuucaaaagguuguuuuaauuuaugcugccaccagcaauguauguauaaguaguuuuucauuauuaccucucucaaguugaguuuuuuuuaacuuaaauaaauuggguaagaaauguuaccuuguuuuaccuuguauuucuuuguuuagcucucaggguuauguauuuuuucuguauugaucaguuguuuuucaguuugugaaaauuguaugcuuauggcauuucuccauucaucuauugggaacucauuuuucuuaccaauuuaugauuuuuaucuguagucauuaacuuucuuuuucguauucgaugcaauuaaaaauauguuugcuauauguaauuauauauauuauauaauuuauguaacauauauaaucuacuuaaaaauucccuccaauuaauguguaagcccugcccuucugaggacaucuugcuuuuuucuuguauuuccuggucuuuucacuaugccuggcacagaguagucacuaaguauauguugaaugaauggagaauaugccugugcagaagaggcgucuacuuuggguaguuaugcagguauuucuuuucagagcuugggcuguguucuguuacuuuuuguacaaauuuuuaauaguauuuguuauuuguauguguguagaugguaggggaaaauaacucauuauaugaaucucugacuugugcccuacucuuugggucaguaaacguuucuugagcaccuaauaaguaccggguacuguauuaggcucugggacaacauuauagcaaagcauuuauguaaauaacugagggugguuuaucucaugcugaccagauguaauuuuagucauuguaaaucaacuggaccuuuugucguaucgacuguaacuuacuggaguaucuuccuaucuuugagguccccugguuggaaacuucugcuucagaauggcauccucagguacaugucucacagggaggaagauuuggcucagaaugagaaagaguuuuguuaauuagaauugugcauaaugggaugugugagcugcguuuucacauaguaaauuuacucuuacuggaaauauucaggcagugguaggaugaauguaugucaagggccugacauaaaggaauccuuccuucgaugagugguaguaucagguaucuguaagguaauguccagugcuguaauccuauuauuguuuucaaagagcuagagacauacuuucagcuuugucuuaauuagccucuugaaguucugucuacuuaaaaauauuuuuuaaauuuugaaauaauuuuagacuuauguaagaguuguaaaaguaguagcauucccaaauagccuucaucuggcuuccccuaauguuaaccucuuacauaaccauggugcaauuacugaaaccaggaaauuaacauugaaauaauacuauuaauuagucuauuuguuccaauuuugucaauuuuuuuuuuuaugaauguccuuuuuugaucugcgauaacaaauccaguugucauauauucuuagucgucuccaaucuguuaaauuuucauuuuuuuuuuuuuaagacagagucccacucugucguccaggguggaugacacuaucuuggcaguggcacuaucuugcucacugcaaccuccaccuccuggguucaagcgauccucccaccucagccucccaaguagcugggauuacaaguaugugccaugacaccuggcugauuuuuguauuuuuaguagagacgggguuucaccauuuggugaacaggcuggucucaaacuccugaccucaagugauccaccccugugggccuccccaagugcugggaauauagguaugagccacugugucuggucacauuuucuuauucuuuuucuucucaagauuuagacacuuuugaagaguacuagucaguuauuuguagaauguuucucaauuugaguuuguguaauauuuucuuuucuuuuuucuuuauuuucuuuuauuuuuuauucauuuuuuugagacagagucuugcucugucacccaugcuagagugcaguggugcgaucuuggcucacugcaaccucugccuccuguucaagugauugucuugccucagccuccccaguaacugggauugcaggugcccgccaccacacccagcuacuuuuuguauuuuuaguagagaagggguuuugccacguuggccaggcuggucuugaacuccugauccgaggugauccgcccaccucgaccucucaaagugcugggauuauaggugugagcuaccaccuauaauauagaaagcccggccuuucuaauauuuucuuauaaugagauugagguuaugcauuuuuggcaaaaaugauguuauucccuucucagugcaucauaucaggggauacauaaugcuaguaggucuuauaacuuuggccacuugguuaaauugguguuugucagguuccugaacucuaaaguuaguauuuucccuuuguaauuaguaucuugucaggagauacuuggagacugugcagauacccauuucacauuauacuuuugcuuacuaauuuuagcagucauuggugguuuuuuuuaaugauauguuaacauuaaauuuauugucauaaccauuauaaguguacaguucaguaauguuaauuuaagcauauucacauuguuuugcaacagaucucuauaaacuuuuucaucuugcaaaacucuaugcuaaacacuaauucucuccccacccugcuuuucuacuuucuguuucuaugauuuuuuuuuuuuuuuuugagacggaguuucacucugucgcccaggcuggaaugcaguggugcaaucucagcucacugcaaccuccgccucccagguucaagcauuucugccucagccuccugaguagcugggauuacaggugcucaccaccacgccuggcuaauuuuuguauuuuuaguagagacgggguuucacuguguuggccaggcuggucucaaacuccugaccucgagugaucugcccgccucagccucccaaagcacugggauuacaggcaugagccaucacccuggccuuguuucugugauuuugacuacuuuaggauacuucaugugaguggacucauacaguuuuuguucuuuuauaacuggcacaugcuuauuucacuuagcauaauguccucaagguucaucuauguuguagcacaugacaggauuuccuucuuuuuuuaaggcugcguacucuucuauuguauauuuucuuuauccauuuggaucaauggacauuuggguuccuucugucucuugcacacauuauugugaauaaugcugcagugaaugucaguguacaaauaucuuagagauccugcuuugaauucuuuuggauauauacccagaauuaggauugauggauuauaugauaauugcauugaugguucuucacugcagugaucauuauugugguguuugucuaaugauuuuuuauuuccaucauuccuacauuuauuaacuggaacucuguuguaagaaagagcugucacuucuuccccauuuauuuauuuauucaauuauuuauuuauaccaguaugagcucauggauauuuauuuucuucugaguuauaauucauuuucuuuucuuuucuuuucuuuuuuuuuugagacggagucucacucucucacucaggcuggagugcaguggcgagaucuuggcucacugcaaccuccgccucccggguucaagugauucuccugccucagccuccugaauagcuugauuacaggugcgagcucaccacgcccagcuaauuuuuguauuuuuaguagagaugggguuucaccguguuggccaggauggccuucaucuccugaccuugugaucuaugcgccucggucucccaaagagaggugcaaauuauaagcacccggcuuauaauucauuuuccaauuaguuauuuuguugauuagauugucccagcuugggcuauugggaacgccuuucuacaugccccccaucauuuuuugaauacucucuuaauugcuggcaccacaagauguuucagguucaugcuguauuuucuuugcccuggcccuagauucaaacauuacuccaaggaguccugauuuuauuuuuuuauuuuuuuuauuuuuuauuuuuagauggagucucacucuguugcccaggugggagugcaguggugcgaucuuggcucacugcaaccuccaccucccagguucaagugacuguccugccucagccucccgaguagcuggggacuacaggcgcacacaccacgcccagcuaauuuuuauauuuuuuaguagagaagggguuucaccauguuggccagguuagccuugaacuccugaccucaggugauccucccgccucagccucccaaaguauugggauuacaggcaugagccaccgcacccagccccgauuccuucuauuggagagcaguauuuagaaaucaagaucuggguauuaagugugcaugagccuguguuguugaacucuacucagacuuuugaaggcagcuugauauagcggacagaacauagcuuugaguauauauccuagucuuuaaugaacuuuacuucuuugagccuuuguguucuaauuucuaaaacaggaaaaaauaguccgggcacaguggcucaugccuguaaucucagcacuucuggaggccaaggugggaggauuguuugaggccaggaauuugagaccagccugaguaacauagcaagacccuaucucuacaaaaaauccggaauagcuggaucucuguguucccagguacucaggaggcugaggcaggaggaucccuugagucugggggggucaaaguugcagugacccaugaccacaccacuguacuccagccugggugacagagcaagacccugucucaaaaaaaaagaaaaaaagaaauagaaggggcaggugugguggcucaugccuguaauaccagcacuuugggaggcuaaggugggcugaucacuugaggucaggaguuugagaccaggguggccaauguggucaaacccugucucuacuaaaaaaauaaaaaaauuagcuggcgugguggcacacgucuguaaucccagcuauuugggaggcugaggcaggagaguugcuugaacccaggagguggagguuguagugagccgagaucaugccaccgcauuccagccugggcacagcgagacuccgucucaaaaaaaaaaaaaauaggaaaauauacuuuauaagauuguugugagauaacauaaguaaaacaccaagcauguagguagguacuagacauacaggagaucuucaguaaguugcaauugcuauuuuuguugcuauuuauguuccuguugcuugggaaaguuuucuccucacuguaugaaaugaaacuuaaaaaaaaaaaaaaaaguuguccuaaaauuaccuuuaccaaauugcaaccucucccuuugucuuaguuuccucaucugugaagugaaaagguuggaccagaauaucucugagauuucuuccagcucaaguguuguuauucugaguuacucuuuaguucuucaguugccuuuucuccaagcuaaacagccuaaauuccuuuugaccuuuccacuaggaccuuuuauucaucccuuugaucauuccugugguucuuuuuuuggacguucuccaaaguuguccucuuugaaaaaaaaaaaaaauccaccuaguuuuuauugaguaaugacuucaugcccagaaugguguugaguauugggacagaaaaugacagacauauaagaugggcugugcccuggagcuuauaguugcuaaaaggagcagacacacacgcccaugguauucaagaaucgcuugaguuugucccagcacccccuuucuacuucucugccucugucauucuuguuuuuuuauuuuuuauuuuuauuuuuugagacagagccuugcucugucacccaggcuggagugcaguggcaugaucuuggcucacuguaaccuccgccuucuggguucaaacgauucuccugccucagccuccugaguagcugggauuacaggcacacaccaccaugccuggcuaauuuuuguuuuuuuuuggagggggguagagauggugguuugccauguugcccaggcuggucucuaacuccuggacucaggcaacccucccgccucggccucccaaaguguugggauuacaggcgucagccaccacgcccagccuauugauauuuucuaaucuaagcaaaggaaaaauugaggucuuuaagggucgagugaauuuuuugcgggaagugcaaggacaagaguggguaguacaaaaaaguaaauguguguguuuauaaguguguagguguggagaaacuagauguccuugauacuagauacauagguacuuuaguaguucaauauagugugaaauguuagcuaaugguaggauagaaauacaguagaugguaggacagccacagaaggaaucuacugguuacuccuagagcugugaggaaaaagaaggaucuaauagaaccuaauagaagaggacccagcccaaagcacagcuuguggaaacugcuguuggcuguguucuuugaaccaguuuaagugcuuuguguuuuagguggaccauugcauugauguaugugauguaauggggagguguucuguguuuagucuguguuuuacaaagccugcuugauacuuaugaauuaaagccuaaguguccuugggacugaccagaagaauccugacuaauuuuuuaauauccucguuuggaaagaaaaguaaauaguaacauuccacaauuagaaauucuauuuuuucuucguuaggguuaaagaaaaaaaaucauuuucauuccauguguuccauuucuucuuggaauaaaccagaauugaagagucagcccucuuccugcucccucucacccuuuuuuauuguaaagguaauauagcauuagugagaguuuggaaacuagauuuuuuuuuuuuugccagaauuauuuuggcuauagauucuuaaauuuauccauaauucuaacuuaacaaaauaacucuuugguuucuuguguguucuuucuaaacuugcccauaugcagucuacgcagucauguuuuaccuauaauuuuauacauauuauaagcauuuaacauuuuucauguuguuaacaauaauaauaaucucugaguaaaccgugcagucugagugaugaugaugugucaguguagguuuguucuuuguaucaaaugcaccacucugguaugggauguugauggcgggggaggcugugcaugugggggaagggguaugugggaacucugcccuuuccaggaaguuuugcuaugagccuaaaacugcuguuaaaaaaaaaaaaaaaagucuauuuaaaaaaaaaaaaaucccagccaggcacccaggcucaugccuguagucccauuuugggaguucaaggcauuuugggaguucaaggcaggaagaucacucacuugagcccaggaguuugaggccagccugggcaacauauggagacacugucucuacaaaaauacaaaaaucagcagggugugaugacagaugccuguagucccagcaacucaggaggcugaggcaggagaauugcuugagccggggagguggagguugcagucagcugagauugcaccacugcacuccagccugggccauagagccagaccuugucucaaaaaacaaaaacaaaacaacaacaacaaaaacaaaacaaaaaacccucaauggauaccugauuuuccacugagugacugaacuuucauuaaccaucuccuuaauggacuuuccucccaguuuucauucuguauaguaucuggcacauaauaacggcuauuuuauugccaaauuguuuuuaaaugcaaugugaacaugaaaaagguggcgauugugauccaaacaauaaugcuggugaugauagugaugauggaaacuucugcuauuuauugagugccuauuuugugaaaggcacuuuauauaucuuaccuucuuucauccuuacugcaacugagguucaguaaguuuuccauggccacugagcuugucguaggcgacagaagcagguuuuaaaccuaaaaguggcuggugucuuuauuuuuuuccccauauacggcacugcugcccauauuuaaauagauagauacuacaguucuguuuccuagaauugacuuagauguaguuccagguuuccagggcugaauucuuuuuuuuuuuuuuuuuuuuuuuuuuugagaccgauucuugcuguguugcccaggcuggagugcaguggcaugauauugguucacugcaaccuuugccuccucaguucaagcuauucuccugccucagccuccugaguaacugggauuacaggcaugugccaccacaccuggcuaauuuuuuguauuuuuaguagagaugggguuucaccauauuggccaggcucucaaacuccugaccucaagugauccauccaccucggccucccaaagugcugggauuacaggugugagccacgccaccuggccuuugaauucacucucucucucucuuuuuuuuuuuuuuuacagacagggucuugcucuugcugagucgcccagguugaagugcaguggugugaugauagcucccugcagccucgaucuucugggcucaagugauccucccaccucagccucccaagcagcuuaagacuauaggcaugcaccaccacacccagccaauuaaaaaaaaauuuguagaaauagagucuugcuauguuccccaggcugagucuuaaacucuggccucaagcaauccucucaccuugaccucccaaaguguuggaauuacaggugugagcuauugugccuggcccaaauucuuuuauuucuucagguauucaacagauauuucuugggcaucuaccauguacuagacacccuucuaggugcugaucuugggucuuccuggugagcugaucacggggaagugggcuaaguaagguuggaaagauccuauagucuuuacuuugaaacagcucuguucagauuaacccuguaagugcucaguguugcauagaucuguguuuuuauucuucaguggccccagaugagccagucccgagcaugugguggaucagaacagauuccuggaauagacauacagcugaauaggaaguaucacaccacacguaaggugagaauuaucagugcauucuguguuuauagagugcuuucacacagguguucuuuggaucucaacaaaauuguuagcuaggugaguuuuagcgaaugcagaaggugaggcucaggggguaaagugacuugcccaaggucacaaggaugguaaguaaguggcagacaaaaugaauuuuuuuuuuucagggacaaggucuugcucugucacccaggcuagaguagaguggugccuucauagcugacuguagucucgaacucccaagcucgagcuauccuccugccucagccuucugaauagcugagacuuacagucaugcaccacuguguacugccaauuuuuaaauuuuuguagagaccagggucucguuuuguuaccuagguuggucucaaacuccuggcuucaagcgauccuccugccucagccucccuaagugcugggauuguuuuuaaaauuuuuuuuaacagaugaggucuugcucuguuacccugguggagugcaguggcaugaucauggcucacuacugccuugaacuccugggcuuaggugauccucccaccucggccucccaaaguacugggauuacugagauuauaggugugagccaccaugccagccugaauauuuggaccuaagccuucugaggcuauguccuauguuucuuccauuguugugucuggaaaacacuuaagaggaaaacauaugaauuuuuuacauguuaaaaauaaagugauauuuaacuuuuggauaauuuuuuauugguuagauagcuugccuuugcuuggagaggguuaacauuagaacagacuuuccuuggagguuauuugcaaacuacaagacucuguagucauuaauaaaauuugugauaccuuuacuaaaaaaugcaagaguuuaaaaacauucagugcuugauugcaguuuugaaugacuuuugacugcuuucaggcaguauuuuuuuuuccuuuuccuauuacaucaauaagcauagaauguuuuacuucucagaauuguucuugggagaugggggucaagauuuccuuuuaaaagucuucuuuuugauagaacuuuuauucuaauaccccacaucugucaucugcuagauauggguuaauagacauacagucaaugagguaggcaugucuugcucugaaauuuggagggcaucuauuagguacaguuccaaauguguuuucacugaaugauaagaugcuuaaaaaaaugaaaauuaggccgggcgcgguggcucacgccuguaaucccagcacuuugggaggccgaggcgggcagaucaugcggucaggagaucuagaccauccuggcuaacacggugaaacuccaucucuauuaaaaauacaaaaaaauuagccgggcgugguggugggugccugucccagcuacucgggaggcugaggcaggagaauggcgggaacccgggaggcggagcuugcagugagccgagaucucgccacugcacuccagccugggcgacagagcaagacucugucucaaaaaaaaaaaaaaaaaagaaaaaagaaaaaaaaaagaaaauuaaaaauuguaggugaaaacaaaaaucuaagcaauaaaaaugcccucagcccaagcaugguggcucacaccuguaaucccagcauuuggggaggcugaagcaggaagauugcuugaggccaagaguuugagaccagccuaggcaauaggcuauggacccccccucuccagagaacaacaggcuguggaccccaccuccacagaaaauuuaaaaaauugacuuggcgugauggcgugcaccuguaaucccagcuacuugggaggcugaggcaggaggaucacuugagcccagaaguuugaggcugcagugagcuaugauugugccacuucacuuuagccugggugaggggaggagacccugacuguauuuaaaaaaaaaaugcucucagaccugaugaggaacaaagcauucuauuaaaaauuuuuugcaacuaauuuuaguuuuuuucuuuuugguuaaucagcuuucuacuaccaaagauuccccacagccuguugaggagaagguuggugcuuucacaaagauaauagaagccaugggauucacgggaccuuugaaauacaguaaauggguaaaguccuuuaaguucuucucauuuuuccuuuugggcauugugcuuucugcuccuaauagauuuuuuaaagcuucugcuuugcuuucauggaauucauacauuauuuuggaugugaggacgaucuagcugcgacaucugucaccccauugaucaccaggguugauucggcugaucuggcuggguaggcggguguccccuuccuccuugaccacucuaugugcgaccuuuuugaagcuguguucuugguugaagaggaugaccuucuccaauagaggaggaccauucuuugaucaaggguauaugaguagcugcacuccccugccagaaccucccaaguaagcucucaagguccauacauuauucugauaacuucuucaaaauaucuuugcccacgugccacaaccucuugcugcuuccagucagaucuauacaacauguggggcugaacuagucccuccaccugauuccuuagaagcaucucauaguagcaggcauggcaacaagacugggcuuuccaggcccuugcugcaugguaugccauauagaugacuucugaggggucagaugggccaaauguucugauuggcaacauucuuaaggaagcauuacuuucugauggacccauauuuuauaagggauuuucuuuaaaauuuuacuaaucaucuuuuuauuaacuaauuaagcccacgaucuauuguaauucuuauuauggagggauauuuguuaaccaugucacucccagucaacucuuggccuagcacauuaucuguuauaauaguaguggcuauaaaugaaugaauguccucucugccucagaugcauacugccccugggcuuuuauaauaauaccucuaaccaauuauagaaauaaaacaucagcgauucaguucuucucagcccacuuaucuccuagaacagguugagcaucccaaauuggaaaauuggaaauucaaaaucuaaaacguuuggaguuuuuagacaugaugccccagggaaaugcucacuggagcauuuuggauuuuuggauuugggaugcucagcugguaaguauaaugcaaagcauccaaaauccccccaaauccaaaauucaaaacacugcuguuuccacacguuucagauaaggaauacucaaccuguaauaccauuucucucuuucacuauggcagaagugccuuuuaaugccuuucaggguugcuggaauauuggguaagccuaaucagucauaagucaaagcaagcccacucaaagcaguagggaagauuuuucuagaaaauauauaagcuuuacugagaacaaccaaguaaugccacuuacaccauuuuaacaaguuggauucaaauuagaauuucaauuuuauuauagacuucuacuugugguuucuucuuauggugucugguucucuuucuaacaauucucacuacagcaaauaugagcuucucucuauaauuacucuuuuaccugaauucugaaaagugaacaguaauuccacaagcauuuuguuuuuaaggagcuuugaaaaaauauagaaagaacacaaauacugacaaugauguucuugagucccuaagguuaugaaguaucuucuuaauugccaaugaaauauuaguuauguucuuuaaaguuguauuuuuuaauaucuuaauuuuugacacuugauaauuguugauauacuugguaauguuuuuaaccagaaucuuuuccccuauuaaaaaaauguuaugcuuauggcauuuggauuuacaaacuuaaaguauauguuuuguuugaaaauuagaaauuaagagggaagucaaaacaaaaaaaagaaaagaaacauuuacaguuuuauucauuucuuggugauuggguuccacuugguugcuaccauauguuuugucuaggcuguuuuuuaaugauucuagagagaaaauuggcuaucauuuggaggauuacuaaaucaucaggaaaauuccuuugcucuuuuagccuaaguuagccucugauuuuucuugguucccuugugacaucaacuaaaucccuaauguuugcauuuuaaaacucuugugaugugaugguguguacuuucuauaaccuucauuuuauuuuauuuaauuuuaauuuuauuuuuuugagacagagucucacucugucacccaggcuggaguacaguagcgugaucucagccuacuguaaccuccgccucccagguucaagcaauuuuccugccucagccuccuaaguagcugggacuacaggcgcaugccaccacaccuggcugacuuuuguauuuuuaguagagaugggguuucaccauguugggccagccuggucuccaacuccugaccucaagugauuccgccugccuuggccucccaaagugcugggauuauaggauugagccacugcgcccagccuauaaccuucauuuuaaaauuuguuacaucacaauaucaacguaugacauucuaguguaauugagaugugaaaauguauguguaacuuuucauuuugaaaaacagaaccguuuucagcaauguugacucaaaucaaugcacuuguauuggauugcacuggcaaaauuauuuguuuuguguuuucacauguauuugauuagggaguaaaauaccugcaugucuguccacaucagcaguaucagcuaucuuuucucuaucuuuuucuuuagguuucauguguuauucccauguuugauaaucauguuuaggaucuuaaauguagcuuucccuuaccuauuugaguaucuuggaaucaucauuuuaaaaaauuaccuuuauaugcaguaucaggugagauaagcacaauauuuacccaacucagccacaugccauagaauagguuuccauauuagcauuaagccaaaaaguuauuccuauucugaaggacacugacaaacuggaauguauucagagguaggcagugagccuuaugaacauuucagaaacuguuaagaacgguugaaggaaauagggaugcuuagccuggaaaagagaagacaggaugauucuucucagguauuugaggggcaaaugugaaaaaaagaagguauuccagugggcagaauaauguucaaugaauguuauaugaagcagauuuuaaguuuagcaaaauaagaaucuaacaagaauuguccucaggugggacagguagccuuacaaggucauuggucuuguuugaacagaggcccagaugguugacugugaaucaagaaugcuguagaaggauuuccaguagacaauagaagguucaaauuacuuaaaacacccuucuaacucuuuuuuaucuuuuuuugaguuggagucucgcucugucgcccaggcuggagugcaguggcgcgaucucggcucacugcaaccucugccucccaaguucaagcaauucuccugccucagccucccgaguagcugggauuacaggugccugccaccacgcccagcuaauuuuuguauuuuuaguagagaugagguuucaucauacuggccacccuggucucuuggccaggcuggucucagaacuccugaccucaugauccgcccaccucggccucucaaagugcugggauuacaggcaugagccaccuugccaggcccuuucaaacucuuacauagcuguuaaugcaagcauuuuacuagauuuguuuuucauccuguaggauguuaaaaaaugcauuaguucgugggagagcagauuuucauuuccuaaagcuguucaaggugccucucuuuuacucaaguaaaagaugacugaugaagucuucuaaaauuaaaaugaaauaaauaugaagucauccaaggaccagaacaacuuguauugacugguugaaaauucagucccccuacguccuuaacucagaucagugcaugauucuugaugagguucuuuccucaaguuauuauuuccagucucugugugauagucuuuagagacuuguuuuagagauuuguccaggaaaauggcucacccaaguauaaaggcuuggccuugcagcaggaaaagugaagaacuauaaaaugcuccugauugccauagcaugagcacugaaaacauacucuggccaaucuggugaagucuucauuguuugugaugaaugcuuuuucacaaacguguuguuggggaagcuuccuucucaaggaaagacuugggccuugggccuugaaggcaagucuccaggcaaggugauuaauuaugaacccaggacuuuauauauaggaaucugaaggagauuacaagauuuaaaaaaaucaagaaauagaugauuagaaauuuuaguuaaaguuacauacuugucuguagcugaacugggccguaagcuccaugagaguagagauuuuugucuguuuugcccacugcucuauucucaucauccagaucagugccaggcacugaguuauguacucagugaauuauuggaugaagugaggagcuagggcagauguccugaacucccugucuuaaggauaggaguaggccugucaaggccaaauuauuaggaucaugauauuauuagauuaucauuaguuugguaauggcacagaccagugcuucccaagauguguucuguggucagauacuuccuagaacugcaaguguuaacaaaauuaaacaggcuuuuuuuggucuguugauauggugaaacugauugauuugucaguguugaauuaucuuugcauuccugggauaaauuucacuugauuaugauauacuauccuuuuaaaaauauugauggauuuaauuuuaaaauauuuucuuaaggaauuuugcaucaaugaucuauguucaugaaggcuauuguucuguaguuuuguuuucuccuaaugacuuugauuuugauaucaggauaagguuggccuuauugaaugagcugggaaauauccuuucuucuuguuuucuggcagaguuuguguagauuucguaacauuuccuuuuuuccuuuucuuuuucuuuuuuuuuuuguuuuguuuuguuuuguuuugagauggagucucacucugucgccaggcuggagugcaguggcgcacucagcucacugcaaccucugccuccuggguucaagcgauucuucugccucagccugggacuacaggcgcguaccaccacacccagcuaauuuuuguauauuuaguagagauggaguuucaccauguuggccaggauggucucaaucucuugaccucgugauccgcccaccucagucucucaaagugcugggauuacaggugugagccaccgcgccuggcugauuucauaacauuucuuuagauguucaguacaguucucuagugaugcuaucugggucugcaguuugcauuguggggagguuuuuaaagacaaauccaauuucuuuaauagauacaagacuguucauguuauuuauuuuagugagcuuuaauaguuuguaucuuucaaggaauuuguccauuucaucuaaguaaucacauucauuggaguaaaguuguucauaggauucccuuauuauccuuuuaaugucuuuaggauaugcagugaugucugcucucugauuccugauacugaaaauuuguaucuuauguguuuugggcuuuucuuuuuccuugaucaguuuuauagguuaucaauuuuauugauuuuuuuuuugaggcggagucuggcucugucgcccaggcuggagugcaguggcacaaucucggcucacugcauccucucccucccagguucaagugauucuccugucucagccucccaaguaacugggauuacaggcgccugccaccaugccuggcuaauuuuuguauuuuuaguagagucgggguuucaccauguuggccaggcuggucucgaaauccugaccucaguugaucuuccugccuuggccucucaaagugcugggauuagugagccgggugggugagccaccacaacccaaccuaauuuuauugauauuuuuaaagaaacggcuuuggcuucaauuuuccuuuuuuuuuuuuuuuuuuuuuuaggcaagguccagcucugucacccaggcuggagugcaguggcgugaucucagcuugcugcaaccuccgccuuccaggcucagccuccuaccucagccuccugaguagcugguacuauaggcacacaccaccauggccagcuaauuuuuguauuuuugguagagauggaaacguuuugccauguuucccagguuggucuccaacuccugggcucagccgaucugccugucucagccuccuaaagugcugggauuacaggcgugagccaccaugccuggccuggcuugaauuuucuguauuuuaucuuccuguuucaguuuuguugauuucugaucuuuacuauaucauucuuucugcuugcuuuuagguuuaauuugcuuugcuuuucuagcauuucaccauggguuuuguuuaaacgugggcuucuaaugcugauuuacuccccagauagggauaucugauuuuuauuugucuauuucuauauguccuauuuuccccuguauuaacuuuagacuggaagcucuuaaaaacaugacagaucucaaguuagcaaauaaaauaucuuaauuacaaucagagacguaaucauucuuuaauuugcuauggguauuucuacccaucagagacacuugcuuuaacucuagagaauuuagaaaaacaugaacauuauauaguuuuggguauaguauguucuuggugacuuuaaaccuuaguaucauagcuccacuaaauucuagauugguuuuucuucaguugcuaugucauucucagccuguacacauuuguuuuuggucuaugcauauuugaguuuauaacuuucccuguuguuauaagaaaaaauaagcuucuagaagccuuguugaagugcucauuuauuuaguuauauccuuaaugaaauguuuugaaaguccuuaaaauaccuguuccuagagugcugaguuggucuucagacccauaagucaacucuuaaauaauuuauuuuuagauuuauuuuuauuaaggcauaauuuauauacaguguaauauaaaaaucuuaaguauacagcucagugaaaaaauuaaaaccaccacucauaucaaaagccuaagagaauuccuagugcuuugggaauaguaaaaguuugauucuuauauuguauuuuacagucauuagaaacccuuauuuacagacacaguguuaaucagcaaacuauaaaauuaaagaucuggaaaaaagauaccgcuuacuccaucccccgagauuuauagaauagauaguagugccucugaggaaagauuaaaggcuugaggguuuuuguauauuucuuugauuuuggccagaagaauguguacuuuuuuacuauaaaggauuucagauucuaaagaguuaauguggauaaugcugaacagugauuuagaggcacaaauguggugaaguagguuggaauuaaaugagagauuucauuuaaauauuggaaaagccuuucugagguuuucaugcuaaaguccuaaaauaugaaaauugugugaagucuguaugaauggcuaagcucuaagaaaacaaaaaaaauuuauauugguuuaaauuaccuagagagugguuuggacccuuccuucuaguugaagaaauauaagauuuugugacccaugucuaauggaaguagaacauccacuuggucaugucuugaguuugguuuuauucucuuugucuagaagauuaagauugcggcccugcgcauguauacuagcuguguggagaaaacugacuucgaggaauucuuucuaaguaaguuauuguuugauaguacugaaaaggagaacaaaucuacauuucauuuuuaugguuguguuuuaauaggauagguuuuuuuagucccuagugaaacaguuuuuccugcacaaagcauauaauccaaacugucuauuugucucuuuaaaaaacuucuuguauauauuucuuuagagacaagggucuugcuguguugcccgggcuggccuaaaacuccugggcucaagcaguccuaccaccucagccuccugaauaguagcugggacuaaaagcacauggcacuguacccagcugcuuuucuuuuuuaauagaguaaacagagagcaaaaggauccuauaaauaaaacauuuugcuuauuuugaaaaaacaaacaaacuguacuuugacauuaucucccuuguccacacaugcaucuuuuuacauaagaguauucauaucauaguaaacauauucuguuuuacagucuggaugguuuuuuuuuuuuuuuuuuuugagauggagucuugcucuauuagcccaggccggagugcagugguacgaucuuggcucaguguaaccuccaccucuccaccucccagguucaagcaauuuuccugccucggccucccgaauagcugggauuacaggcaugugccaccauacccagcuaauuuuuguauuuuuaguugacaugggguuucaccauguuggcuaggcuggucucaaacuccugaccucacgugauccgcccuccuuggccucccaaaaugcugggauuacaggcgugagccacugugccuggcccauucuggauguuuuacuuagcauuuugacauggacguuuggccagcuauuccuguuuuuaauuuuuaauuguuuuaauuaauccuggauuaauuaugauuuuucucauguuaaaagacuauugggucaaaaggcauauauaauuuuauuauguauaucucauugauaaauugcuuuccaaaaggguuuugcugguuuagacugucagaagcaguugauuguuaucacaguauuaauuuugaugcuguaaacaguuauauuauuaacaaaguuaauuaaagcagguacuuguaauugggagagauuaaaucauuuccaguuccacagguuuuggaaggaaauguaugcuguguacuucugugguaauagucacauccucaaagcagcauacaccuaacuguauacauuugagauuuuucucuagcagcaaauauuuguauauaauuguguucacaacaaugaagaaagcugggugcaguuuugguuauuuaauaacuauuuuuuuguugcaucguguuuuuugagacuugcuuugagucuugcucuauugcccagauuggaguggaguggugccaucuuggcucacugcuaccuccaccucccaguuucaagugauucuuguuccucagccuccugaguagcugggacuacaggugcacgccaccaugcccagcuaaguuuuguauuuuuuuuaguagagacaggguuuggcuauguuggccaggcuggucucaaacucuuggccucacaugauccaccugccuuagucucccaacccaaaguuccggauuacaggcgugagccaugggaccuggccuauuuugguuuuuaaaaaucaaauaaauacaaaucauuuuauuuuacugucucagcagauugacaccaaaaacugaaauaccauacugaauuauaauuccaauuuaguguucaccuuuccuuucuucuuuauucauaaccuggaaagaauauuuuccugcuucuuuguuagucuaggauaaguuaguccaaaaggaaaaaauauuuuuucucuaucugaugaagcuauuaauauuagaaacugcuuuuuuucuuuuucuuuuuuuuuuuuugagacagaaucucaaucugucacccaggcuggacugcaguggugugaucucggcucacugcaaccucugccucccggauucaagcaauucugccucagccucccaaguagcugggauuacaggcaugugcuaccaugcccggcuaauuuuuuuguacuuuuaguagagacgagguuucaccauauuggccaggcuggucucgaacuccugaccuugugauccacccaccucgaccucccaaagugcugggauuacaggcgugagccaccacacccggccucuuuuucuuuuuuuuaagagaugaucuugcucugucaccuaggcuggaaucaguggcucuagcccuuuuacugcauccuuuuacuccugggcucaagcaacccucccaccucagccuccugagucgcugggacuacaaagacaugccauuaugccugggucauuuuuuuauuuuuauuuuuuguagagacagggucucacuauguugcccaggcuggucuugaacuccuggucuuaggccuuaagugauccugccucagcuuccugaagugcagggauuacaggcauaagccaccaugcccagccuguuuuuuuuuuuuuuuuuuuuuucuuuaagugccuucuugaauccaugugugaaguauuuuucaucaggucuuuuuaaaaccucauccucaggcugggcgcgguggcucacgccuguaaucccagcacuuugggagucugaagugggugaaucacuugaggucaggaguuugagaccagccaggccaacauggugaaacccccacccucuacuaaaaauuagcugggcaugguggugggugccucuaaucccagcuacucgggaggccaaggcaggagaaucacuugaacccgggaggcagagguugcagugagucgagaucacaccacugcacuccagccugggcgacagagcaagacuccaucucaaaaaaaaaaacaaaaaaaacccucauccucagaugucuauuuaaugucuauuuuauauuugauucaauaaauaacucagaaauuucuuagaauuauuuugaaaggauguuuacuagauaacuuugucuuggccagcuguucauuauugaagguucuucaguuaauauuguaguauugaauaauaagacuuuuuacguauuuaacauaucauguuucaauucauagccugguguaaacuacuuauaaaacuuaagaaaaguuuauaaauaacuguuuuauacuauuagcucauauaguaugguuuuauauuugucucauuuaggaguuacaaaauauugugggcuaggaagggcuuguauuacuguuuucauuuuguuuuauuuuguuuucagaaacaguugaggcucaaaggggcuaagugacucacccaggguugccuagccaagccuugaaccuguguugucugguuuaaaauccagggauuucuccacuauaacauauugucugugaaugaguguaauugcaaauuagaaaauguaauucauuuuaauauuuuuuguauuuuguuauauuuaaaugcaaacuaccucugugagauuuucuauuaguauuggaaacugauguuuauacuaauuauagugugaaucuauuggugagcuuugucuuagcuuagucuuugaaguaguuaccuagggagaaaguaaauuuuuuaguaacgcuacucuucagguuuucugagacucaauuugagaauuuccuuuugagaccuauagcauguucauuuuuauuacauucuguuguggcccaucuuugucauuuguggguagauuaaguuuucauaucaaaccaaagugcuuccaaacuguggcuagugaauaaaaagggaacaaaucuggaauauaccuucuggaugcagaagaugacaaauaucuuucaaauaauuacacugacuuuccuguggcuuggauucuaaagaguaggccagacagguuugaaauaagagaaaggggcugggugcaguggcucacacguguaaucccagcaguuugggaagccaaggcaggaggaucccuugagcugaggaguucaagaccagccugggcagaaaaaaaaaaaaaaagaaacaagagaaagcaguauauauauauugcuucccaagauuguacuuuuuaaaguggucauugcucacuuggacuugugguauuuuagggcuuaacuuuuggaguccugagaauucagcagcccgcuguuucuuagauauuuugaggaugucuuuugucugagcauguugcacugaugaguacacugcgguuugcugacuggucuuuuagagauguuugcugugaagagcacuuuggagcagagguggucaaucaguagagcuccuguugaauuccacaguguugucugcagacugcuuugucuuuaacccuuaagagacuggaggccuuggagaggaggcuccuuaaugaauacauucugagucugugguugagguuuaucacugauacaaucugaaauaauuagugggguuuuucaaagauaauuucaauucuacuauuuaaauaauuugcugaaaaccaacaauagugaauauuuauugaguaccuacuaacuuaauacuaaccauuuugcuaaacauuuuauaggccuuaucucauucucacaaaaaucuuacaaggucaguuaucuuguuuuucucauuuuuacagagaagaaaauugaguaauuuuacccagugucacauagugagugagagguagagucaaagaauugaaucaggcagucugaccccacauuaaauguacaacuguguuaugcugccaccccauaacaguaaugaacuauuuaauuguauccaacuugaugucaagaaagaaagugccuagcuucagaaacuaaagcacugaaugugcauuggagcaagagugugaucauggcaaaauacuacagcagguuuuaacuuugaaguguuuaaaugcauuucauugaacuaaagaaucugcuguauuuuugcauaguucacagucaacagucaaugguguuacuuuuuagggcuuuacccuguggguuucuguucugacaccaguguguauagggacucaaucauaugccagcacuuuucccacccucagcccugaggugaccccagaaggggaaauggugacccaaguccagcugcuggccugucugucugugcuuuccagcccaagaacugauucccucucugagaaaauuggaaaggcuccuggaggcugcugagaagcuuugauguagagguagcaauugaacagauuguccuuuagaagcagccaaauuucauuuuccagauugaaagacagacuuccaagaaaauuuuucuuuuuaauguuuuguucuagcauccaaaaaagacccaacuucagauccgggcuucagaguuucucagggcuauucuugucuagguggagggugguuggcccauucucagauggcaugugucuuaauagcuguauggcuggccaggccagccuucagcucccuccugcugggcucugagaggaagucgacuugacagcugcuaggcaccucccaguaagcucaccaaaguauuuuggugucacuuugugacagacuuggauucaaacugcagcccugccacuagcuuguuaauauuguggcugcccacacguuacuuaguuugagucuguuuccucaucucuaaaaugaggauuauaaugcuucccuccaggguuaaagugaggauugagugagauaauguauugacauggcuugcaguagaucugguaugcagaugggcccuuagugaguuaguuucugauagugguauuagagaggcuguuagagcaggauuaagaacacaguguuuggaaucaaguagaucugaauuugaucucaggugucucuuuucauagcuguaugaccuugaacagcaauugucuuggucucucugagucaguuuucuuaccugucaauuugggauaauaucaaugccuaccucaggguuauugggaggauucauugagcucauggauguaaagaacccaguagaacaucuggcacauaguaagcccgcagugaauuacagcucuuuauuauuggugcuguuaauguaccucauggggguccgggccuauguguuaucuccuaguguccccucuuuguuaucauuuaguacaucauguaccuugaugguugcugaaaagcagaggauagcgcuucuuucuugagucauugccccaaaggacagauucuaccauaagggcccaaauuccccacuuauucucuuuuugcaucuuccucuugcucuggcuuuucucccuguuauguaauaaggcgggcacauucagugggagaccccucauccagcaggaggcuuuucuuagcugagugagaauugagaggcuuugaugucugagcacagaacuaauuugugggaucugaaaccaaggagaagcccuucccaguuuugucauuucugggggggugaugaacagccuuucaguaaguacaauaugcuuucuuauucagcugcagcucccuagagcccugauuuuuuucgccugaucuuuucuuuuucuuuuuucuuauuuuugagacagggucuugcugugucacucaggcgugaguacaguuaaaugaucuuggcucacuguaaccucuaccucccuggcucaagugaucauuccaccucagccucccaaguaacugggacuauaggugcaugccaccaugccuagcuaauguuuguaguuuuuuguagagauggggucucacuauguuucccaggcuggucucaaacuccugggcucaagcaauccacccaccucagccucccuaagugcugggauuacaagugugagccacugcacccagcuccuggucauuucuuuugggcaaaucauuuagcacacccauauccauagcacauuggguaccuuagagaaagaagacaggaaaaggauacuagaaagacuuaagcuucucaguggagcccaacugaaaaaaguaagggaguguuugccuagcuuuucagaauucaagcccauggagggaaaauacuguagaagcacacggaagcuggaaggaaccauagaaaucaucuaggccacauucugcaaagugagaaaaccaagacucaaaggggagaagugauuuguccaaggccacauaacaagcugguaacagggcuggaacuagaaggcugguggucugacuaaauucaauggguuguuuuuuuguuuguuuuuuuuuuuuuuuuuagacagagucucacucuauugcccaggcuggagugcagugacgugaucuuggcucacugcaaccuccgccucccagguucaaguaauucuccugccacagccucuucaguagcugggauuacaggcgcccaccaccacgccugguuaauuuuuguauuuuuaguagagaugggguuucgccauguuggccaggcuggucuugaucuccugaccugaggugaucugcccaccucggccucccaaagugcuggaauuacaggcaugagccaccgcauccauccuuuuuuuuucuuuuacuccuggcgugcuaugauucaaaguucuuuuauccuguggucucgcccuauuguucuacuggacuuuucugcaauagcauaaucagagagcaccauaagugccgugccugccaauauuuaauauauggucaauaugcuuccuuuaaacccucacauacuuauaccuuauuguuauuuucuagggugucagaugccugauacauucaauucaugguuucuuauaacccuacuccacgucugguaagugagcaauuuaaaugaagucaccaaauguauuuuuuuaaacacugcugacuuguaagguauagccuucaggagggcugauuauaugaaauggcaguuguucagguguuaaaaacuguuccuuucauuuuaauaacuggugucuugaagcacauuuuuauuaaaggucaaagcauaagcccagaaggaaacuaauauuuguaggauuuuuucagagaacaccuaacccagugaacaaugcuaucaguaucucuuaacacacucuaugagcuuggauggaaaguuuucucucccuuggcuguuuuaggaaaguucacauuuacguaaaagugguuugaauugugagaauccguggucauuuucauugcuggucaucagaaaccuauaacaaauuauagcacugacauuuacgccuguaccucuaaaaugugcauacaaguuagcuucaugccagguuuguugcauguaaaaauauuuaacaccuuaaacaguauauuuuuucuucagcugugaaauaaguagccaaaaaaaaucaauuuuucaucuaauguuacacaguauuaaaggucagaaggauauaggagagucguugaagucaggggcuggggaauguauuuauugaacugccagaucuugggaaaguaaauucuggagaacuaaguuuacuacuuugaccauagugaguaucugaggaacaugggaauggcugcccugucaaaaggacccuuguuugagacugccuucagcugaaccuuugcaucauacaacugacuacuauauacuuuuugguuuugaucaccucugaaauguuucuuccucuguacucacacaguuacacugaguuuggcuuaggggccuaagguggcaguuuauuuuaugcuuuuuuuuuuuuuuuuuuagacauagucucacugugcugccuaggcugaagugcaguggugcaguuguggcucacuacaaccuccgucucccagguucaagugauucuugugccucagcccuccgaguagcugggauuacaggagcccaccaccacgcccauaugauuuuuuuguauuuuuaguagagacaggguuucaccaucuuggccaggcuggucucaaucuccugaccucaagugauccaccuaccucggcuucccaaagugcugagauuacaggcgugagccaccgugcccagccuaugcuaucuuuuucuaagcaguaguuuaguaagugcacaccauauccugggcacuuugugggaacuagggaauaguucucaagaagcucacagucuagugagggagauaagauguguaaaauggucaauuauaaaucagaaugccuaaguuauauaauaaauaugaguaagaaguacuuauaggaucacaaaggaagcugcaacuaucaaaacccuuauacuucuaccuguuaguucuuugaaaugugccacgcaucagguagcuuaaaaggcacacugccugccaucuuguugucugaauggugaaggguaaggcauagcguucagggaaggaagcugcauauauugaagggaaaaagugcuuuuuuaggagaggaggacuguagagguggcacuguaaaauuacucacuggaaaggugggaggguugcaagaaggcuaggggaacucaaagauaauauucagaaccuguaugaaagacucuuuauugcccauauagcuagagguaucaguguuagagggaguggauggcaaaauaaaauaaaauauauaaucccugugaccacaucccaaggucaauaccugacuaacagcagaugggagaaccuugaaacuacuuauaguucuuuaaaguuuccaaacugugccugcuuaaucuuccuugcugagguugguuuaauuucugaggaguaggguguaccacccccaguucaauugagagagggaagcugucugcuucaaaucuauacuugauuccccuuccacucuuucucucgccuaguucugaugauaugcagguuuugguggaaagaaucuguagcuuuucaguuugaaucagcacucuucuugaggaccuccuaugugugcaggaccaugggauguuggagagaaggguaugacaugcauucuuuucugguaauuucuuuugggcaaaucagauacagacucugugucuguaucuucaagaaauguaagucuaauggaaaacagacauaaagcacgauugccuauaaugcaugccagugaaagaaaugcugugcccaagacacaggcagaugcaguggaagcacaaagugguguaacuaaauccagauuuggugaugggguggaguguuggauaaagaguggcuuugugguagaggugacauuugagaugcaccacgaagagugacuagaauuucugucagagaaagggugggcauuuuagauugagggaauaauaggagcaaaagauagaauguguacaagaacauggaguauuugagggcagccaguugccugaugugucuggggcagguuuauugaggaauguaguggaagggucaccaggaaaguaguuaguuuggggcucaguugugcugugauccuccaagaaucggagaagucuuucuucuaauggaaucgugcaggggcggggugggcaggcuguuaggaggaaugauggauccaccccaagucuguggagaagccauguucuauuggcccugcucucuuagccugaagcuccaggaggguaaccgaaggauagccacaucaagauuacaggacucaguggacuugcuggaggcauagggguugaaguaccucuuggaggugguaguguggggugggggaggaggcuuagaaaacagaaaaguagaaauaaugccuccuccgccaaacaaaaccaaaaccaaacaaacuacuaauaaacaaaaauacccuggucgcugacauuucagaagguuugcuuagguucccaaggguaaggguucccuguugacucuuagaauaaggacaagauuucucacacccuguuaguucccuggaggaaaugguguuucacuuauccugucugauuuuuuuaguuucacaguuuuucugugguuuaggauuuaggacugggacacccuccagcuccuagaggacccuuaucaguuguauacucacuugagcuugcagcugcaaugacuauguguucauugucuuugcugaacaagauuaguauugacuguggcugcugaaaaaaugcugagagaggccacugucugcgcugucuagcauccccacguggacuugauaaaagcaggccuccuccccuauauccugucuuggccacuggcaucaugcccacaccagaaaccugggagcccucauuugucucuucucucaccccuucaccugcucagucaccuaacucaaaauuuuuuugacucugacccaucguaacaaaugcauguuacuuugugaccagaauggacacaugaaucugauacagaaguucuguaaaauuuauccuuauaaugucagguaaucucugauauuuucuuuuguuucuuucuuucuuuuuuuuuuuuuuuuuuuuaguuuuaaggagcaaggaguuuaauaggcaagaaagaaaagaaagaagggggaaggaagaaagaagcagcuccccuguacagagacagagggaggaggcuccaaggcugagagagggaaccccugauauuuucuauuccauuugaauucauuuuaaacagacauugauaaugucacccacuaaauugauuucacugaguugcaaccaacaguacuugaaaaguggucuuuggccucuagcuucccuauccccauuccauuggccuucucaguacaaauggggucaguacacaaacagacacacacacacgcacacacaugcacucacuccuuaauguucuccauuguucucagaauaaaauacaaguuuuggccgggcccaguggcucacgguuguaaucccagcacuuugggaggcugaggugggcagaucaccugagguuaggaguucaagaccagcuuggccaacauggugaaacccugucucuaauaaaaauacaaaaaaauuauccaggcaugguggcgggcaccuguagucccagcuacucaggaggcuaaagcaugagaaucgcuugaaccugggaagcugagguugcugugagccgagauggcgccacgcacuccggccuagacgacagagcgagacuucaucucggaaaauaaaauaaaauaaaaguuucauaucauggcauucacaucugaucaaaugugaccuauggugccuuuacuagucucauuuguugcuauuuuaggcacuauuaccaucacuacucccuucucugcaagaaaaagcaaaacuauguaguagaaauaucaagucuucugcacaaaguuucuucugccuagaaggcccuucccccgccucuccacuugacaaauuccuguuuuuccuucaguauccaauucagguauuaucucugcuuugaaaccuucccuucugggcagggagauuuauguaguuggaauuuguguuggcauuguaaguguuaacagauuuguagagacuccccuuuucaaauugucauggagcacuaguaccuucucagugcagaaauuaauuuuacaaaauggaauggaacaaauaaaauuggaacauaccuaugauggagguacgauggagagggaguaaaauguagucuguuuuuaaagauuauuuuaaagucagguauuucauaaauacaauuacuacuagguguuuuauguauauuaucauuuauuuauuuacauacauuauuucacacaugcucacaacuacuuuauucucauuuuacauaugagggaucaggggcuuagagaagucagagaacuuucccaaagaaguaguuagaaugugguggagaggaaauucaggugcuggucuggcuaacugaaagcauuaaguugcuuuccucuuuaguaauuauaacuacuaaaguaacuaauuaaauacuuaaauuaauguuaauuaauacuaaaguaccuacuuaaacauagauucauaaaauuauggcauuuauucucuugauugaagguacuguguacagcagacaaauuuauuucgugcccucuuaaggcuuaggugagaagagagacauuaaacaaaucacuaauaaaauacaacugugauaggugcaaugagaggaugugacaaggcuaugugggagaagcugggaaccucauuuaguuuaggggugggucagucagggaaggcuucacugaagaggacauuuacauugacaccuaaagggugaguagaaguuagcaagugaaagaguggaugaaaaagccuuccagguagagggaucuagugguuuucaaacuuuuuaucagcagaguccuuuuuaaaaaugaaaucuuaugcucagccaccauauaugauaaauaugaugaaaggaggugggaaugaccugcuugcuucacaucuucacaacauguccacugaaaaaagacuguuaaguaguuccauggaaacucagaauguaguuuaaaaacuacagaucuaguccaauucucucauuuugcaaauggggagacaguuuuggcaauuuuaaggaauugucucaggccacuuacucaguaguggcugacccgagacaacucugaaguuaacuaugguuaccugccccuucuaaacacuuugcuuccuuucugauuguccuauuugguggucaggggauaggggucucuuccccugaguaugaacaugucauaugagcacagcaaacauuuacggaucaccagcuguaugaugggccccguguuucuuggcgcucacuaucuguguccugggagaggccacagguaaaccugaaacuagcacagggugauguacagauuauaugggaucacgggggaagggggguugccuggggauggucaaggaaagcaguugccuuggccuucugggggccagaacagacuauaugggauugaggaguaauuaagaggcaaagaaguuauuguaaacuacuuuucaagaaguuucaaaugaggggaugaucgcuugagggaaaaacaguucagaagggaagcauuaauuguuuuuuauuuuaaaauggggaaacacuggaaugauuucauaagcugaagggaagaagccuuugggaaagaaaagaaggaauuaaaguguggggaugggaaaggguuagaaagcagacuggugccagucucagcgcagccagagaacugcaccggcagacacuggcagccucugcagaggcucuuuaaaaccaccacagcacuuuugauguagcuguagggcauucaggcuucugcuggauuccagcaaccccaggccugcuauacauggugagcccuggccaugugcacauccucuuuugcccucccccagccagaguugcaguguucaaacacccacgcuuguagcuuucuugcccaaaccaaaggccuaugcagcagcauuuuaccagcauugcauacccuaagugcgcugauaccugguacccaggggcuuauucuuuauaguggaucugacaggcaagcugcaggccagguguagcucuuggaggaggcucguugucaggugagauggcuucaggaagugccucacccaacuugucuguuugcccacaggcuguccuguggcccucaugcuccccccagaaggguuaggcuucauagugagggaguuugggaaaccagguggagauagccauguacacagcccuggaaaagggucagugugccagcuuacagaucaauaaacucauucauuagcacacugcuggggcuugaguguagccaucuaggcucugcuuucuuggccucagcuggugacagaguaagggaaacaugcugugugaaaguccccuuugggauuccuucauagcagccagagugacgaaccugcccaagugccugcuagucuuuauuaauucaaaaucagaucuacucuaagcagcuuauaaacuaucaugugggagaaacaaggccaaaacacaacuggcauugucagagggcccaagcagagugagcgagacaggaugcucagagcugccaguaccuggcaggaggucagcaucaggaauaacaagaaucuucccucccagauuuaggcugacaggaggaaaucauagcuaggaaacucuccuauuccuuugaacucuacagacaguguuguugccuuccgauuugucuuauuuagcaggaagagguucuuggugcuaucacagaaugggagaaaaaggggggagcucaggcuucauuccagcuucuuucuucucuaccgugcaaccuuaaguuacuuaaccucuucagaguguguuuucuuuucugugaaacggggacaguuauaauguccugagagacagaaugaauguaaaugcaucuuacagugacaagucucacauuacagaacauaguaaaugguaguaaucauuauuauuauuuucuauaaggcaggauugauagcuucagcccuuuauuauuugauauuccuagugagugacauuuucuuccuuugucccgucuccaugcuugccuuuuagagauauuugcacgccagguuugaacacuccuuuuuuucuuuacuuugcuagcugcguuauuugccuuucuuauauguaaaagagaucaguauuauguaugagccacuggaaucacugagagacaaggauaguacugugaagcuuaaaaccuaaauaauaaauuguggguuuaagaacaucaucaggccaggcgcgguggcucacgccuguaaucccagcacuuugggaggcugaggcagguggaucacuugaggucgggaguuugagaccagccugaccaacauggugaaaccgugucuguacuaaaaauacaaaaauuggcugggugugguggugggugccuguaaucccagcuacucaggaagcugaggcaggagaaucucuugaacccgggaggcagagauugcagugagccaauaucaugccacugcacuccagccugggugacacaucaaacuugggaggagcaacuugaguuugauccuaaacagaguaguagcuucugcacagauucagucuauauucagaguaggugcuuaguaauacuuguucaauaaaugauuaguuaauuaauauaggaaucuuuuucauuacaagauuuuuuuaaguuuauuuugcauuuuuuuuguuuccuggauacagauuggcacacugauacuuugcuuuuuuuuuuuuuuuuuuuuuuuugagacagagucucucacuguugaugccaaggcuggagugcaauggcacagucucggcucacugcuaccucugccucccaaguucaagcgauucuccugccucagccuccggaguagcugggaccacaggcaccugccaccaugcccagcuaauuuuuguauuuuuaguagagaugagguuucaccagguuggccaggcuggucucaaacuccugaccucaggugauccacccuccucggccucccaaagugcugggauuacaggcaugagccagcgcgcccagccugcauucuuaagggcaguuuuuauuuauuauguuuuagcauggaaguguguuauccccuccauaaugcccccugcccuucucaauucccccucguuuccaacagaggucugacauuaugacuuuaaaucaguggcaaaauguaauuugaccucucaauguuaaauuuaggcauuuauuaugaggguauacacccaugaugugaguuaaagugagcuguauugugaaauagcuuacuuaaugacucaacguuauuguuauauggucagagucugugacagguguuggcuuuguuuugcaguggguagcaggaucuucaagucuuuuauuuuuauuaaccauuuugacuuuguuuuauuuauuuuucuuuguuucuuuuucuuucuuuuuuuuuuuuuuuuugagacaaggucucacugugucucccaggcuggaguacaauggcacuaccauagcucacugcaaccuccaccucuggggcucaagcgauucuccugccucagacuguagcugagacuacagucaugcaccaccgugccccacuaauuuuuuuuugagacggagucuugcucuguugccaggcuggagugcaauggugugaacucggcucacugcaaccuccgccucccugguucaagccauucuccugccucggccucccaagcagcugggauuacaggcaugugccaccacgcccagcuaauuuugcauuuuuaguagagaugugguuucaccauguuggucaagcuggucuugaacuccugaccucaggugaucugccugccucagccucccaaagugcugggauuacaggcgugagccacugcgcccggccuaauuuuuguauuuuuuauagagaugagguuucgucauguuguccaggcuggucucgaacuccggagcucaggugaucugccugccucgaccucucaaagugcugggauuacaggcaugagccacugcaccuggccuauuuaguuuucuuuuaccauucaacauacuucagucuuuucugaaugauucaggauguccugauaacucuuaacuguauuuugccagacuauugucucugaguuguaccuguugaaccucaauugcucuguuauuuuuuucgugucucuauuaaauaaauuuuucauuuccucuuuuccuacuaggcugcuagcaguuacucuuguuauagguaugcuugccuccaguuagccagucuuuuuuuuuccugaugugcuauuucuaauaugaugcuaguuuugaagcuuaaauuacuguacuugugaggacugaaugaaaaauagggucaauagauccuggaggguuuguucuaaucauuaaaggaggcaaaaacaacaaaaaccuucguaggacucugggaucagauugucuagguucagaucucaguuuuagcacuuacuagguuuguaucauugggcaaguuacuucucuaggacucaauuuucucaccugugaaaugaggacaguaaggacacaaguaucagcuucauggaguuguuguaaaaauuaggaaaaauaaugcauccaaaucacuuggcauagugccuggcacguaguuguguuaacuguuaauuauagcacuuguccguuuuugcuauuuaaguuuuuuuuuucuuucuuucuuccuguuagucauuuuuagaauaggaaaaauugccagauaaacuaacugguugaauucagcgucaaucagaugucacccuaauaauggucaaauaaguuaguaguaaucuauuaucucugguguccaaaaguuuucacuggggugucuguggaugaaacacagaguuggaguugagauuucuucacuuccauccuuccauuccaauaucagauguaauuuuuucuuaaugucugagaauaauaguauguuggccuggugugguggcucacgccuauaaucccagcacuuugggaggccaaggcaggaggaucacuugagcuuaugaguuugagaccagccucggcaacguggcgaaaccccaucucaucucuacagaaaauacaaaaguuagcugggcaugguggugcaugcuugaagucccagcuacuugggaggcugagguagaaggauggcuugagcccaggaggcagagguugcagugagcugagauuauaccacugcuuuccagccugggugauagagccagaccuuguuucaaaaaaaaaaaaaaaaagauaguauguguagaaugcuagcacaaaagggaagauaaagaagguaccauuuauguaaaaagaauacacacauacauaaacuuguguguguauagguuauauguggaaggauuccuaagaaacuaguagcugagguugucuuugggagaggaacggguuggcaggggaugaagguaggaaggagacuugguuuuuauuacuauguacauguauuaccuuuuaaaaacaguuaucaaacaagcguaaauugaaugugauaggcuucaaggucagguggccuaagaauugguauucagcugcuugucuggacauuccaggcagcugacuucuuaagauuuuggcccagccuucagcucugcuuuucccuugaagaggauaaacaaaaaaguccuucacaacaggacugcuuuucuguccuuaacuaccuaguaaauucgauucacaaacucagggaaagaauuaggugagcauuuaauuagcugaauguuguacuggugauuggacagcccuguggaucagaaccuuauuuucccaguagaacucaugggaaucuucaguaacuuccgguugauaggaagacugauucuuugccuuuggucuuacaacuuuauguguaaugagauuugcgguagaguuuuauauagcauuucuucaaauuacauuguucuguucaaugucacuuuguuauaacagugaugaggagaaaaauaacaauucccaucuggggccacugccuguguggaguuugcauguucugucccugucuagguggguuuucucuggguccuccuguuuccuuccacaucccaaagaugugcacagaaggugaauuagcaugucuaaauuguccuuauuggagugggugugggugugagugugccgugccauaauguaugcauagcucacauuauuucaguguuuaauauuggaagucuuuugggucuuuauuuagaaguuuagugauguuuuugugaccagaaauauacuguaggaauauaacucuuguuuaugucacuuagccuaugguaaaauagguuucguaaguuguuaagcuuacaguuacaguuuccaagaaucuaucugugauguuaaaugaagaguuacaauauuuaguguucugcaucaauaaaaggucuguugaacuuauuggguccaauguuuuaggaguaaugagaauuugcccuccuuuggcugggcaugguggcucacgccuguaaucccagcacuuugggaggccaaggugggcggaucaagaggucaggagaugagaccauccuggcuaacacugugaaaccccgucuccacuaaaaauacaaaaaauuagcccggugugguggcgggcaccuguagucccagcuacucgggaggcugaggcagaagaauggcgugaacccaggaggcggagcuugcagugagccaagauugcgucagugcacuccagccugggcgacagagcaagacucugucucaaaacaaaaaaaaaaaaagagaauuugcccuccuuuuauuuucaggugucaauccaugucuucuaaacuguuaguaucagcaaaauuagguacagguuauaacaaucuuugcugguuguauauuucucaaaaggcagguauaaucuuuaguuuauauuucuggaucagaauauucugaaaaugauguucuauuaaaguaaauucagucauguguugcuuaaugauggggaucuguccugagaaaugcaucauuagguauuucauuauugugugggcaucauagaguauacuuacacaaaccucggugguauagccuguuauauaccuaggauguaugguaugaccuauggcuccuaggcuauagaccuauacaacuuauuacuguucugaauacuguaagcaguuauaaugguaaguauuuguguaucuaaauguaucuaaacauacaaaaaguacaguaaaaaugcaauauaagaaauaaaaaaugguauucuuguauaagauauuuaccauaaauacagcuugcagaacuagaaguugcucuggaugagucagauauuacuguauacuacuguagacuuuauaaacacuguacacuuaagcuaagcuaauuuuuuuuuuuuuagacagggucucacucugucauccaggccagaauuuagugguacaaucacaacucaaugcagccuugaccucccaggcugaagcaauccucccauaucagccuccuuaguagcugggacuacagacgcuuaccaccacauuuggcuaauuuuuacguuuuuuuguagagguggggucuuacuuuguuaccuugguuggucuugaacucuuggccucaagcaauccucccaccuuggccucccaaagugcugggauuacaggugugagccaccacaccuggccauaggcuacauuaaauuuauuuugaaauuuuuucuucaauaauaaauuaaacuuaacuuacuguaacauuuauacuuuauaaacuuuuuaauuuaaauuuuuuuuuuuuuuuuuagguagagucuugcucuguugcccaggcuggaguacaguggcaugaucucagcucacugaaaccuccaccuccggguucaagugauucuccugccucagccuccugaguagcugggacuacaggcacgcgccaccaugccugguuaauuuuuguauuuuuaguagagauaggguuucaccauguuggccaggcuggucuccuaaccucaaguaauccaccugccucggccucccaaagugcuggaauuacaggugugagccacuguucccaaccuaaaaaaacuuuuugacucugacauuuuaagcuuaaagcacacauuauauagcuuucuuuauauuguuauucuguaaccuuuuuucuguuuuuuuaaauuuuauucuacuuuuaaaaauuuuguuaaaaauuaagacauagagcugggcgcaguggcucgugccuguaucuuagcacuuugggaggccaagguagaucacuugagcccaggaauucgagaccagccugggcaagauggugagacccugccucuacaaaaaaauuuaaaaaauuagccgggcucaguggcgugcacccguaguccuagcuacuuaggaugccgaggcaggaggauagcuugaguccaagaguuugagguuacagugagaugugauuguaucacagcacugcagucugggugacaaagugagaaccugucucugaaaaaaacaaaaaccaaacugugacucaaacacucacauuagccuaggccucuaccaggucaggaucaucuagaccaggugauaggaauuuuucugcuccauuauaaucuuaugggaccacucucauauguguggucucuugcugaccaaaauuguuaugugguacaugacuauauucaccaaauuuguccuuuuccagcccuggugauauuuguauauuuaauuauaggauugaggcugggaagaaaagguuaacuucucagagacucaucuccggucagugcuaaggagcgaaucuucuuccaguagcuggccacucucugcugagcaaaguccauacuuuuucuuagcaagucauuucaaagcucuucaugaccuuucuggcuucaguuuucugcauccuauacccuguccuccccacaaucuagguauucauuguuaccuuaacauccugaacucuuccauggcccugccuuugcuuagaacauuccaucagcuggacauucccuuugucuuuugucucaaccucuucaacuucagcuuauccuucuaagauccagguacaguguuucauuuuccaugaagcuuucucugauucuacucagccaaaagucauccuuuuaaacuucauugcacucuucucuugggagaucuauggcauucccuuuuagggcuguugaugugugguguaccuuaucuccccuagaggaaacugcuccauaaaagcuggguucuaguuuuagccaucacuauaauccccacagcauccaaccauacaccuucacacaauaggaacuccuguguucauugagugaauugucagucaccauuuugaaagugucuucauuuugccuuaucuuuucaacuggauaaccauuugagcccacuguuaucuguaagggcuauagaacaaacuguguugugaaacaaaaaacacuucaucccauguugauacaguuagaaaguuuauggucugagaaaaucugugccuuuuaaaccucagagggcagguguauuaacaaacuacagaauuuucaaauaaaugaagaauuccauuaccucacuauugcuguugaugaauuggccucugacaacacuuaagcaucaaaacacacagcgucuuuucaggugagaggcugacaugagggauuugauuaacuuuagaaaagucuuaugaaaaaggacuguugaacuuuuccccaguuuguuucugcuguggaauaggcucuguguccuauaaaguagccaaaucuuuuuucugugaccuguuucauuauugucacaaagugcuuuuuuuuuuuuuuuuugagauggagucuugcccuguugcccaggcuggagugcaguggcgugaucuuugacuuacugcaaucucugccucccggguucaagagauucuccugccgcagugucucgaguagcugggauuacaggcacgcgccaccauaccuggcuaauuuuuguauuuuuaguagaaacaggguuucaccacauuggccaggcuggucuugaacucuugaccucaaguaauccgcucaccucagccucccaaagugcugggauuacagguguaagccaccacacccagccuacaaagugcuauuucuuaagcacuaccuggggucagagguuacagguuuuuuguuuuuuuguuuugagacaagagucuugcucuuuugaccaggcuggagugcaguggcgcgaucuuggcccacugcaaccuccaccccucggguucaagcaauuguccugucucagcuucccaaguagcugggacuacagguuuguaccaccacgcccgguuaauuuuuuguauuuuugggagagacgggguuucaccauguuggucaggcuggucuugaacuccugaccucaggugauccacccaccucggccucccaaaguguuggaauuacaggugugagccacugcgccuggccuacaaguuucgaaucacaucaguaaaucucauuugggaucauguagucagccuucuuuuuauuuucagauggaaucucacucugucgcccaggcuggagugcaguggugcgaucuuggcacugcaaccucugccuccuggguucaagcauuucuccugccucagccucuggaguagcuggauuacaagcgcacaccaccacaccuggcuaauuuuuguguuuuugguagagaugggguuucaccauguuggacagguuggucucgaacuccugaccucaggugauccacuggccuuggccucccaaagugcuaggauuacaggugugagccacugcaccuggucauguugucaaccuucugucagauacccgaguucccaccaagcguugauucacuucuccgugacagacaaauucucuacuuuuugagguugucaguuugauuauucaaaucuucagacacucaggccaggcacaguggcucaugccuauaaucccagggcuuugggaggccgagguggaaggauggcuugaguccaagaauuugaaguuacagugggcuaugauugugucacugcacuccagccugggugacagagcaagacccugucucuaaaauuaaaaaaacaaaacuuuagacauuccuguuaguaagcuuuuaauuuugcuguucaauguugauuauaucuuucucccucuauggccugcccauugguucugauucuaacucuuugguuuuguuuguuuguuuguuuguuuguuuguugagacagggucucacuccauuacccagacuggaguucaguggcaccaucguggcucacugcagccuugaccuuuugggagggauccuccugccucagccuccugaguagcugggacuacaggcaugcaccacggcaccugacuaauuuucauauuuuuuguagaaucgggguccaacuguguugcccagguuggucucaaacaucugggcucaagugauuuuccugccuuggccucccaaaugcugggauuauaggugugaaccaccaggccugaccugauucucuuugguaaacaguuuaauugcuuuucuacaauguuuaagucaacuuuccuguuuuucuccagguuaaauaucuucuggucuucuuaagauacuucuaguccuccuauuucuuaaaauguaauguucaaaacuguggauaguauuccaaauacguucugguuuguguugaguauaacaaaagucucacuuuacacauugaugguauuauauuugcauuacuguaucuaaaaucacauuaauuuggagggcagcauuguuauccucuugauuccuacugagcacauaauaucaacuuaagccuauaagucuuuucacacauagguaggcaugacuuaucugugcuguacuuuuacaguuguucuuuuagacucaaaugcaggauccugaauuuauccccauuagguugaucuuguuagauucaaccuguugaaguauuuuugguucaugguuggaucaucuggcacauuuguucuccugcccagcuucuugucaccugcaaauuugguaaauauguuuucuuuucuccaucuuaguuauuaacaaagauguugagacaggccaagcuguaaucauuucauuguaccauuacuauugcugguagauuuuaauuggcaagaucaauuguguauggauauagaauugucagguuggauuaacuauuccauaauuauaacaggaauugucuuuuaggugaguaauccuauuguagcugcuuaauaagcuauuuaaugagaaacaauaaaaauuauagucugccaggcauggugccucacaccuguaauccccacacuucgggaggcuaaagugggaggaagucuugagcccaggaguuugagaucugcuugcacagcaaauugagacccccgucucuacaaaaaaauaaaaaauuagcugggcgugguggugcacaccuguaaucucagcuacacaggaggcugaggcaggaggcucccuuaagcccgggagguugaggcuacagugagcuguguuugugccacugcauuccggccugggugacagaaugagacccugucucaaaaaggagaaaacaagcacuuugggaggcugaggcggguggaucacaggucaggagauugagaccauccuggcuaacacagugaaaccccauaucuauuaaaaauacaaaaacauuagcugggugugguggcaggcgccuguagucccagcugcuugggaggcugaagcaggagaauggcaagaacccgggaggcagagcuuguagugagccgagauggcgccacugcacuccagccugggugacagagcgagacuccgucucaaaaaacaaaacaaaacaaaacaaaacaaaacaaaaaagaaugaacuauggucaugcaugaaaugaggaacuaguuugaaaaguuggggacccugcuuauauuccuauauauaauaaaauauaauucuuguauguuuagauuaugugaggucuugauuauucagaaagcccucuggacugacuagaggcaaaugugguauaggggaaaagguccuaaacuuggcccuaaccauagguguuuguucauuuauuuauucagcaaguguauauugagugccuacuguacuuaagcccuggaaauaaaauguugacaaaaaccagauuugaucuuuaucuucaguagagcuuaccuucuagugggggaaacaauuggauaauuacacaaauguaaucauaauacuuucugugaucuguguucuggacagguguuguccaacagaaauauaacgcaagccauguauguaauuuaaaauuuucuaguaucuacauuugaaaaaguaaaaagaaacaaauuuuaauagauuguauguaacccaguauaucugaaauauuauuucaacaugaaagcaguauuaaaaauugagauauuuuauauucuuuuucuucaacuaaaucuuugaaaucuuaaacuugugccacaucucagcuuugacuagcuguauuuaaaaugcucaauagccacaggggagccacuguauuggacagcacaguucuauacccaguuuuacggauauaaaacugguguugggcaaauuacuuuccgucuuuaggacuccugcuuucaucaguaaaaugaaggauucagacuuguuugucuucuaacaaaaaaaugugguucccuccagguaugagggagccuucagaggugcccuaaauaaucuguaucucgaucuggguggugcuuguguggguguauguauaauacauaaaaauuuaucaggcaguacacuuaagauuuauacacuuaauaguaucuuuguuauaucucaguaaaaguuuaaaaaaaaaaaguucacuuccaguuugauuuggugcccuuugcuaaacucacucuuagaugaggagaccuucaguggaaaugugugaugugaaaaaugcaaacagccaagacuuuuuuugucuucuucccacccaggaugugucuaguccgaaugaagcaggaaggccggagugggaaguacaugugucguaucauaguucauuuuaugugggaggauguucagcagcgcggcagagucauggggguaagugagugcugucagaugcuuguccuggacaauuccagagaaggguuugaguuuggaguuuuaucuguuguaaaauggcccugcuuuuagauuucugugaaaugcugccuaauaucaaguggcaguuccgcuaaagucacuuuuucugccucuguggaaacuaauacuccacagauacuuuauguguuuguacacauuauagugauuugucagugugaagucauccuguauggagaugggauuguaaagcccaaaucguggugauaggagggauggauuuggugaauggagggaaucaaaugauaauccaguuaaggauacuauaccuuugacaccaguucaauauuugaaccaguccuucuauaaauuaguucugaugggaggcccugguauggggccugcacugucuucaggaacugaaacucaagcuccuugaucacuggcaaccuagaagagucugguaagauaccuccugaaaauguacauuaguacauuuaauaauuaaccugagaaaggggaauauauuauauauauauauaugucacaugggauguaaugacaauagaaaaaugaaaccaaaacacuagaauauagcugguuauacagaucauaguguguccggaguugguuccuugugguggguucuuggucucgcgacuucaagaaugaagccgcagaccuucgcugugaguguuacagcucuuaaagaugguguguccggaguuucuuccuuccaguggguucguggucucgcugacuucaagaaugaagccgcagaccuucacagcaaguguuaccagcucuuaaagguggugcggacccaaagagugagcagcagcaagauuuauggugaagaccgaaagaacaaagcuuccacaguguggaagggggaccugagcggguugccacugcuggcuaggguggccagcuuuuauucccuuauuugucccugcccaugucugcugauugguccauuuuacagagugcugauuggugcguuuuuacagagugcugauuggugcauuuacaauccuguagcuagacacagagcgcugauuggugcguuuuuacagaaugcugauuggugcauuuacaauccucuagcuagacacagagcacugauuggugcaaguauccacccgacccagaagcccagcuggcuucaccucccacuaguaucuucuuuuguuuauguuguguauuuuguguaucuagaucacguuuuaguagcuuguaguucccuguuacugggaagcauuucauugccucccagcuugggagcauccaaaguagaaccaugacugggucaugaaauggguuaauuugguuucuuucauuacagggcaaaguucucccuguggacugagaaauaaacauauuauaaaaguuacauaugcucauagaauagaaaucaaagaguaaaaaguauugaguguaaaaaacaagugucuuuuuuccccccagucuaacuccccagaaguaaccuuuuuuauuuuuuauguuauuuuuucuuaccuucaaggaaggagaaaaguaaccauuuuugaguugaugcguauccuucgccugagagcuaucuuuguaaucauccuuuuugguuccuuuuucauuuuuugcuuucuuucugucguagcugcuguguaauauagagaaaaaaaguauuuuuucagcucucucacucaauuacaauuacacagaagguuucugugacacauuugugggaguuucuccccacacagcaaacaggcagucaauucuggagagaggucaccagguggguguccucuaacccaauucaauuccaacauuguguacucggagauagugucagaucccacagguugagggcucugcccacaagacugcccccaacuugccacaccaauugcaagcuccaggcuguuuuaccugugcuucuggccaaccgauuauaaauugggguuccccaccccuuucuuugguucaauuaauuugcuggagcggcucacagaacucagggaaacacuuauuacauuaccgguuuauuauaaaggauauugcaagggauacagaugaagagaugcauaggacaagaugggggaaggggugaggagauuccauaccuuuccuggugugcagcuguccagaaaccuccaccuguucagcuaucuggaagugccccaaacccaguccuuuuaaggguuuuauggaagcugcauuauguaggcacaacugauuaaaccacuggccauuggaaaucagucagccucucugcccuccuuggagguugggagaugggacagaaaguccuaaccuucuaauccucccuugguuuuucagugaccagccccuacccugaagcuaccuaagugcgccagccaccaaucauuagcauacaaaaugacaccacuuuggaaaggccaaagauuuuaggaguuguaugccaggaagggaguugaagaccaacuauauauuucacaauaucacagcugcccagagugagaucggcagccuuuaagguauucauccagcugaauguucccacaugcccucaaguacuuaccacccaacucuguagcagugcacaguggacauaaggugguguuggcagucucaguccuauuuaaugauggccagagauaccuccuggucagccaaagcccuggcugacugccaggcaguugcgcaguagcucuuccuguagugaaacuguucuucuuaucauuguugacuaaacucuguuggaaguugucucacuagccauaugagccacagcugucucuauccugaauagcuuaaugagccauagguugcugacuccuggacugcaggaaccuuuuaguugccucucgccacaguugaauuuccuucuggaccuccaucucucuucaucacaguugucaacacuugagccuucucccauguuacuucuuaugcagugucccuucuacuuaacuguaaguuuuauaaaagcagaaaaccgucuuauucaguuuuuugcuuaugcaguaaacauugaauaauugucaaaugaauaaauaauugucaaauaaaugaauauauugaauaccagccuuuggaauucuuuuuuaagcuaacauuuauuagauaaaucauaccugcuuuauuagucucugauccaaguguauaucagugcaguccugcaggaauuggggaauuuuuccccuaucgcauuuuauccagccguuuuuucuauuuggauuguuguagauagggugcugccccauaagggaguguuuuagaucagcguuucucauacuuuaaugugccuaugguucaccugaggaucuuguuaaaauacagauucugauucaguaaguuucaggacaggggugagaaaaucuacaguucugaaaagcuuccaggugaugcggauguugcuagugacgcagggugggguaggggacaauagcaagguuuuagguggucccccaauacaggcucuuaaauugccuucaugaagagaagugcccaaauuccgguuuaguuacaaagacuauaacuaaaggaugaugguuuuaaaauaauagagauuuggaagaguuggggaauuacuauuacugcuuucugcuauaguugacuugauaccuucuuucuaaccucauggcauaaauagacaugccuuauauaggcaagacaauuguauauuaaucacuggguugugagugcaugcauggaugagugugagugcauguguguguuugaggggaucucagucuuccguguguguacaaccuauaaaugggacacguggcuagggagaaguaauaggcaguguagagccagucuggccugguucucacccugacuggcaaaucuuuccucuucugugcuucaguuucuguauuaaaagaaagguggggacaggggaggccuaacuacaugagccccaaguuuucagcuuuuuuucagcuugaaaaucuaugguuugaaggugguaauuugcaaaucuaucucuguguuauuuggcaucccagguguaccucuguaagaaaacauauaaaauguagaauuuauaaaaccaaucaauguaguagugauuuuucucaugccaaaaacuuagaggugauugcuuugaguggauugguguguggaagaucaagaaauaagagagccacuuucgaguuagugaugaauaauaaauuugcaucaaaaacuccuuugaaauuagaauucuauucugauuuggugggaaauuuuuuauuuuacaaaaauuugcuuuucaccaacuuuuuggagcccaacuauugugaaaaauggagcagacucauauaucaucgugaagcugguacaaaaagcagguguuaaauuugagguuacaaaaaucacaucaauaauuuagaguguucugacuuaaaaaaacauuauuugggauuuaaacuuauaaauuagcuguggaaauaaaguucauuauaucaccucaucuggucuaguuuuauuucauuaacugcuucuuaaaaaucuuugugagcugaguugcagcugaagagcuuggagaccauuuuuccuugggcccuugccgcacuccugaguguugguaagaguaaagaacuaagucuugacacagcuguaaaaacagacagcgccuuuggccucagcacuuucuccuggugcaggcagauuucagauguaaauuucacucucugccucuccuacuaaugaaguaaguuucuuuugcuggguuugcagccagguguguccagucuuguggcuaaccagggcgcuuuacuuaauuuuuccauuugugacauuucaaccaaacuuaaaaaacaaacauaaaaauuagcucacggcaguggcucaaaguguuaaugguaaccuuaggcuggcuaaacgacuuccucucaguucugcccugccagacaucuccaccuuguggcucacaaugagcaggcucaagcuuuccaagacagagaugggaagggaugggagugggcuguaguugagaaauuacaguuuacccuuaucagcggucccuggcaugccuguugccucagugagacuucuggaauaagaaugcaccuucugucaccucaugguccccugcucacucucuagcagagcugcuugaugggaugaugcagagggccuaggaaaaauggaggaacugugggcugaacuugacucuuguguaauucugccuugcuucucagaaccaccauuuugcuuuguaagguccucuacgaucacacuccagaccaccucuccaaacucauuuccucuaguucuucuugaaccuuaaauaugugaaaccuacuagcacaugugccuggcacuuaguaagcacucagugaacaucacauuccauccuugcuucacauacccuucacuccagccaagcugaauuccuugcuauuucugucuugugucuuugcucacuccaugcauacaccuagauugcccuaacaccccagccucaauuccuucacauccuuccacagcuaacuggaagccaaucccaguuuccccuaaggaaguaccuuaaugauuuauaucuacccuucuuccagcucuuacucuuucuauuuuguaucacuguuauucacuuauguugacugucuuccaggugaauuccuguggugcaggaucacguacaucugucuccaaagugccuguuauugccccuuuccugaauaggugcccaguaacuaucugaagaaugaaggaagccaguccugcaggcccagaaugaguacuggaaaaaguggggcagggagauaccguuuuuuauucugaggauauuuguuugcuguguuagucuuaaauauuggaagaaaaggaaauaaaucguuucccccaccaucaacuguucaguuccuuuuucccauacuuuuccaucuucuaauggaauuacuugauuuuuuaaaaaccccagguuauacauaggguauauuauguuuauuuucuuucuuucuuucuuucuuuuuuuuuuuuuuuuuuuugacggagucucucucugucacccagacuggaguacaguggcgcgaccuuggcucacugcaaccucugccuccuggguuccagcgauucuucugccucagccuccugaguagcugggauuacaggcgugcaccauacccggcuaauguuuguaauuuuagacaggguuucaccauguuagcccgacuggucucgaacuccugaccucaggugauccgcccuucucggccuuccaaagugcugggauuacaggcaugagccaccaccacccccggcugguauuuuaucuuucuaaacuaacaaaggcauuacauuuuaggaggcuuuaguuuuucugaaaauuuccuuucaggccucuguaaucaccaccugucaccaaaucgccucucuuucccuacaaaaauuuucagaccucuucuauuuuacgauauaaaaauuuuacuguuuugcaucucuaggucagaauuaaaacucacugccaaagguauuguuuuuaaagacaaggagcacauuaaaagguauaguuagccuggacaauguagggagaccccaucuuuacaaaaauaaaauuagccgguuaugguggcacaugccuguggucucagcucugugggaggcugaggugggaggaucacuugggccagggaguuugauguugcagugagcugugaucacaguguuacacuccagcuuggguggggggaaaaaagugugaguguaacuaaaggacagucccuugggcuugaggccaugaaaauaagaauacauguucucagauaccaguuguucuuuugaaaguuucuaaaauggccugagcuguuggaguggauagucaguuauuaggggagagaaggcuaaauucuaagaagucagaguaauuccauuuugggauuggcuuacgaauuuaagcaggguccuacugaacauguacgucugguagauacaugccuuucuuuacacauguuuccuaccccuaggccuuaagagguagcaagaguucgaggaguaggugccucaggcaguuuuacaacuggucagaugcauaggugcauacagucagggugccaguccuguccugaguggcacaucggacucugcguuacugcagcacuacaccaacuucagagauagaacuuaccaugaugugcuguaauuauugguuuauauagaucccuccuauuagaguggguaaggaugcauauagaacccuuguaguuacauaggagaacgugcuuguucuuagcagauacauauugaaguauuuagggguaaaauguuuugauaucuggaacuucaaaugguucagcaaaagaaaaggauguguagauguauggauagagauaaacaaauguugcaaaaaaaaauugugcaucuaagauugugcaaaaugcugaaucuuuugcaacauuugcuuuaucucuacccauacauauacacacccuuuucuuuugcugaaccauuugaaguugcagaucucaaaacaacuuauaugaguuuuuguuguauuacucuuacauccuuuaaaaauucuuugaaauucuucaaagcaaaaaauuggagagaaaagaaguauucauguucuggcuccagcccauucuucuaguuuaaucugcaacaaaucauaccccuucccuccaaaaaaguucaagugcaugcacacaaauacauauucuucucaugccagacuuucacuggugccguaagugugcuguguucuuuuaugccucuaggcuuuuguuuaugcuauuccgucugaucuggucuucuccccugucugcucauggcacuauaagacacaagcuggauaacaccuccuccaagaagcuuuuuccaguauucaccaauaauguucauauaucuggccacucccuucucugaacuuaccauggugugcucaugguuuauguaggucacuccuguuagaugggauaaggauucuuggauuucuggugucuuaaaccacaugccuaccguagucacuacucaaauauguguuggaugaacauaaauacuugcuucuuuuguuagcaucuggcuagcccuguauuccaaauacugacugaagaaugaucuucucugauuacacuuggauucaauuucucuaacuacccucccccuuugaaaaagguccgguuuuucucugcccugccucauggguucccuggcucucauuuaagccugguuauacacuuaaucugcuuuauaggauggaugaaccuuggaaugucagacuggguaccucagagguucucuauucagcgguucugagucugugaagaggcucagguauaugcauuuugaaaaaucucuccauauauauauauauauuuuuuuuuuuuuuuuuuuuuuuuuuuuuuuuuuuuucuuuugagacggagucuugcuuucucgcccggucuggaguucaguguugugugguguggucucagcucacugcaaccuccaccucccggguucaagcgauucuucugcuucagccucccaaguagcugggacuacaggcucaugccaccaugccaggcugauuuuuuacauuuaguagagacgggguuucagcauguuggccaggugggucucaaacuccugaccuuaagugauccacccgcucggccucccaaagugcugggauuacaggcaugagcccccgugcccggccccaaaagauuucuaauacauauuucugguuaagguucuacccucucauuucuguggugaggaaauggaugcccagaaaaguucauugauuuggccaaggucauacagcuagagaauagcagaaugaggaccaaggccagauuacaccaauuuccaguccaguguccucuuuacuauaccaugguaccuuccaauugaaagaaagaaaccuuuucuccugucuuauuaccaaggacugccaaagaccaagaggacagcuuuucuugaaucuaaaggcauuccauuuauuucuucagugcacucccaagccugaggccucuuuuacucaauuucuaauccaauacggcagagacuuccuacucaacaggacuaauagagauuaagggggaaaaaaaagacaugagaaugcugacaauguucugaauuuguuucuuuuuccaucguuuagagucugagugucucuacaucaucugaauuugccuuaguugauuuuacaauuauuuuucagagacuccuugguuguguguuuuuuuuaaggguagaggaacaccgagacugaacaccgugcuugaaggggccgggccaggagacuaacaaaggcgguauuauacugugugcggcaaagccaauaaaugaauucaggagacaccuagauguguuucuagaggagaccgugacggggaggggucuggugaaaaggcagaaaggugggauuaagauaaauuaaaauggggccaacauguuagauaaggggacagucucuuccuguuuccaccauugcuuuagauuucucaaucugcugaguucagaaguuaaaacuagucuuuaccauguacuucauacucagccuccaaggccucccacucuuacuuaggaaagaacuuaguuuuaaggcuauuucagcaugguacagcaguguuuauuacuugagugcugcaucuguuggauguuacuggggaaucuuagacuguuuaaacuggaaaggaacccugaaauaaucugauccagagaucuaaaagugugguccccagaccagcagccucagcaucgcuugggaacucguuagggaugcuagcucaggccagaugugguggcuuaagccuguaauccuagcacuuugggaggccgaggcgaguggaucaugaggucagggguuugagaccagccuggccaacauggugaaaccccaucucuacuaaaaauacaaaaauuagccuggugugauggcaugcaccuguagucccagcuacuugggaggcugaggcaggagaaucacuugaaccugggagguggagguugcagugagccuagacugugcauuugcacucuagccugggcgacagagcaagacucugucucaaaaaaaaaaaaaaagaaugcuagcucuagggcauacccuugaucuucugaaaacuggggugggacccaacagucugucuuuucaccagcucucuaguuugagaaccacugcuccuaaacuaauuauaucauuuagaugauugggaaauuggcucuggaagagcugcguacaaauuagaaacacugaagaguagaacucgggugucuuuguugccacuguuacuguucuccucgcuaagaggagcagggucuaggcaugggcuaacgacaugugaaacuugaggauuucagcauaauucagaagcagaguuccccaauaguaauagcuaacauuuauugagcacuuucuuuuuuucaugcacuuuacaagcaccauuugaauuuuauaacauuuugcaacagucuuaccugugagauuaguaacauuucuagccucauuuuacagaugaggaaacuaaggcucagagauaguuucccauagcaguuacagcagauuaccacaaacuuggugguuuaaaacaacaaaaauuuauucucuuacaguaccggaggccagaaaucaguuucauggggcugaaauuaaggugucggcagggcugugcuucuucuggagguucuaggggagacucuugccccuuccagcucuugguggcugcugauguuccuugacuuguggcugcaucacugcaauuucugccucuguagucauguugccuuuucuucuaucugagccuaaguuccuuccgccucucucuuaaaaggaaggauaugugugauggcauuuagggcucaacuggguaauccaggauucccuccccaucucaagugucuuaauuugaucacagcugcaaaauccuuuuuugccauauaagguaacacgcacagguuccaggaacugggacauggauaucuuuuaggagaccaaauucagccuaccuaccacuguuaggcaauuuaauuagacuuacacaguaaauaugggagccuggauuggaacccaaaccuucuggacucuagagccugugcuuuuaauuacuacucuguacgaaacuaaaaacuauggcucuagcauuggcauuaagauuuuuaacccaaguguuguuucuuucuuccucuaacuuccacaguauccacuuguauuguagcauugaaccuuucaguccauaagcaucuuagguuuuuguuuuuguggguuuuuuuguagagauggguucucuccgugcugcccacacugaucuuggacuucugugcucaagugauccucccaccuuggcaucccaaagugcugggcauaagccaccacgccuagccaggcaucuuauauguugguccuagcuucuccaguuaguuagcuucuagagggcagauauuccauuuuucuguuuuuaaaaauagagauauaauuuauaucccauaacauguaaauuugcuuuuuaguaaauuugcagcauuauguacccaucaccacuauuccagaauauuuuaauuaccucagauagaaauccugugcccauuagcagucacacccguuccccuuaccccuagccccuggaaaccacuauucuacauucuguuucuauggauugaccuauuugggacauuucauauaaauaggaucauauaauaugcaguauuuuauguuuggcuucuuucacuuagcagaauguuuucaaaguucagucauguuguggcauauuuucaguacuucauuccuucuuuugucuuuuuucuucuuuuuauuuauuuauuuuuugcucaacucccccgaccgacaucauuccuuuuugggauagucuguuguguagauauaccauguuuuaaaaaucuauuaaucaguuaauagacauuuagucuuuccacuuuccacuuuuuagcuuuugugaauaaugcuucugugaacauucauauauaaguuuaugucugaacauaaguuuucagcuuucuugagggguauaccuaggaguggaacugcugggucauauggugacacuauguaaacuuuuugaagaauucagauauugugucuuuuaucaaguuguuugaauuccuagaugauuuccauuguucauuuguuuauaaugaaauuagauauguguuaguuauaaugaaauuaguuauaaugaaauuagauauguuuauaaugaaauuagauaugugaccuuaaucauuacuuauuuuaccgacaauuuuagacaguaguaagaagggacaguguggcauaauggaacgaguucugccuggccuggccacucuucggguaagccugaguaagucaaaucacaucaccucucuggggaggagaguuagaugauuucuacauucucuuccagacuuaacauucugcaacucuguggaagucugaaaagcuagccuuguguuaagucccagagcuuguguucuguuuuuuuagcaguucaucacucucugucugauuucuguucccagacacaaacaaaguuuuacccaucuauccauccauuuuauuguggccuguuagcuuccagguacugugcuaaaagcacuggagauacaaggaugauuaagacauuuuccaugacucccuagucuaguaggagaagauaaacauaaacagauaauuacaauauuaagaaauuauaauguuuuuaaauugcugagaaugcccagagucucgagacaggcugggaauagaugacauuugaguuaaaucuuuucagauaaguagguguuugcuagacaagaagagaaugccaggcagaggaacaguguggauaaaggcaccgaguugguaugagaagacaaacaauguuuggcuuuguuuggugacauucuuacuucuccugcaaugguaaaugcagauucucuuuauccagacuagcuccauuuugagauccuugugugugucugauauuuacagacucauccacacuuaaggaucugaguaguaacauguuuugucuuaaguacuggucacacacaguacuucuuccuucuuuguuaaggacacuucagacucgguuucugaguaaggggguucacugaguaguugaggggucaugguccagauuuggguuuucuccauagcaccagcucagguugggcucuugaaaaugccuucuugucgcucuaaggguuuugguuacauaaaaguauuaggaauguaaaauuuuacaauaugaucagcacagcacaaacuaaauuucuagccuuuaaccuagaagcauauauggaaggcuuuguguucuaaacugcccccuucccagcccccggccuucaggagaggucauuguacagcucuuuccauggucacugcucucuucacuuuuacuggagggcaaaacuagggcagagaaauaauuuuuauucacuucugaaagguuacaguaauaaagaaacucuuguuaacaucagagaacguugcagccaagaguuuucacagucuggcauuguuuauuuuacauguaauuuggaaccuucugcacucuuaaaauauuggcacaaaaauguuuuaacucuugaaguacuucucuguacaccgcaguaguuuggugucagggggcagcaggacucuggagagccguuugcccuguuccuguuggagagagagaugguauaagcauguguauguguguaacauacacagucacucguguauuuaugugcccuucugcauugagaauuaagaacuuucuuuguccugaugaauuuccaugcuucucuuuauuaaacaaugagaaugguauagcagucccgcuuuccuuuugccacaacugccaaaaaguacagcgcuucccuuauuuagauauuuugauguaaguauucauuauccccuuucuucucccgccccccacagacuuuauuacuuaagucuuuucuuuuacuuuuauuuugguugcggugcauacuaugggccaaacucugugccaggaauuuuacagacaucaucucauuuaauccuuacaaauuaccuugugauagaguugggaguguccccauauuacaacugaggagaaccaaggagcagaaaacuuaaaggacuuggcuguggccgccauaguaagucacaagcccagagcugacggauuucaaaaucuuugcucaaaaaaaaaaauuggcucuuuuggccauaacaugugccuuuuguuguaauccaauuugaaccuuuuuuuuuuggaaauagguagaauauaaguaauuaugagugaacuaauggacuaacugauccauugauagaagcacaagucacuuauguuaaaugagauaauaauacacagaaguaccuggcuccaucaaaggguuuuuguucuuguuguuguuuuauuagguugaaauuaagauaugaaacgauuacagaaggaugccuugagguaagugggaagaaugcuaggcuggggauuagguuuccuauuuccaggcucaacuuugcucucagaguuuggaggacauucucuuucucgcaucugucuuauguccugugggcuuaaaauagagcgauuuauuagcccagcccuugcuaagaccuaggcauuccccaggacugaccauuuucuuuguaaccugucugguguggggagcucuucuuucuccaagucuggcauuuucuuccuuggccuccaaaauggggcuuuggcaaaagaggcagcacuugcugccaccaggugagcucugcagagcugucacuaagccaggcccuucuccagcagaggacuccuuccccagcaagaguucuacucuggcucugagaaaaggauaccguacugcaugugcacugcagccaccaugccuuccugcaggcugugaaccuucuguuaaagccagcaugggaaucccauaccuucuaguccuguuccauuuucaguacuuaccaaaggagcaagaagagcucaggaccuuucagcucuccuuuacccagagagagcucuguucccuuuuggaagacacaccuaccuuuggcuucagauguccccaugauggagaaucccaguuaguacaugcacauacaauucugggcccaggaaacaggccauucccccaaaaucuagugagggccccuguguguucugcuguucgccucuaaaguguggcauucagugcuagaaaguugagaggccggugcccaguuuuccaaacaguucuuuuccugucauguggucuuuggagccagacagacauagguucuaaucucugcucugccacaauguugcuuugagauccuaggcaagucucuuuaccucucauugucuccauuccauccucuauaagguaagucacgcacaguuaugugacuuaaacaauauggcuuagcacaguguuuggcacauauuaaguacuugauaaaugggagcuaucaggaugcuguauuuggacauuuucaauagcaccuagcauaagcugucauaucuugaagggauuuauaggugcaucugugacaccacacuggauucuggcuuucuggaggacaaagauccuaucuuucauccgucuccuguucugccuggcaugaguaaggcacauagcaggcacucaguugauguuggcugaaucuuuuaggaugacuugggcagagcagggugggcauaaaugcuuuaguuucuccaucugugccuggggaaauaguaaccccuuauuuuggagccuuugaggacaauuuaaaacgauaugugugaaguguuuggagcccuuugaaaggaggguacuggagaaauuaaugguguuuuugcuguucuugggaaagcccuuugugguucccagugaauaaauuacuuggagugaguuuucucacaccuccuacucugcucuguucaccguagcuuuuuuuuuuuuuuuuaaauaacugucugcuguaauacuucuuugcccaugacuuauaaagauauauauuuuugguguuggacuuuugaccccuuucugcucccaggagagaaauuuugaucagaauaauaaaagguguaaacuguguguguugcccccuuuccuaggccuugggcaguuuagcugcugggguuaggaaucagcuggcuugugguauguguaugguuauggggcaaguaggagaugauuccuguuaagcgcugagcaggcuucugucuccugcucuucuuuucaucccugucccauaccguuuugcuaagauucuucagauuucaaaugaaccuuguugucuuuggcauuuucgauagguguuuguggcuauacuccuucuccuucaaagacagaagguguuuaucgucuccugugcuuuaggucccaaggugaguuggcugccagagaagagccucccucuagaaggacagugggagaacugaaaaacacucaccaaucuuggagcuacaagaguggaguuagacuuaguuccacaauuaaccagcaggcuccaaugcagagccuggaccagguuauuucuaagggccuuuccugcuugaaaaaaaauccaugagauaaaaauuuuccagcccaggguagaauuuccaagagugaacacaguuugcaaaacuuucuacuuuucuccaagccucucuugcccuguagcacuggaagaacuggcuccgucccuaauagccucaguucaaagggaccagaagagacuaggguaguuggggacaaaugugggguucauaacguacuagggguaucucgucugaugaagugguuggguauggaugucagaagaaucucacuuggugaugauccucaggaacuauguaaaggaauuuuagauugcccuggcugauggcaggaagccccacccagggcuagcccuagcuggucagaauugccaagcagucaguguuuuuauuuuaugccaucuccuaaucauuucaguggccgccaagcuccuagaagcuugacagccacaaagaugauccuaauucaacccuuuccaagugaggacacucaguccuggucaggaaaaaggcuuggucagugucauauaguagcgguaguagcagagacuaaaacucacuucucuugauugauucuguugcucuuuucguuacuugauacuaucaucuuugcuguucucuagagccacuacacacacccugcauuuuguguugcugggaaaagccuccaaucaaagaccuccugauccuuuucucuuaaggucagcauuccagugucuagcacagugcuuagcacaugguaagccuccauccaauauugguugaauggugaaugagugagugaacucacagagucuauuccuaacccuaucuucuuagaaucaauucuauacuuacacugcaguuuaccugauuaaauucaugccaaaucguuaaggguugccaacaggaucuguuuuaauggucccagauaacucuugcauuuuaaccagaguuuucuguaaauagcgucuuuggaaaaagcagugguugcaguaguaagacauacaggcacugugacgagcucuugggguugacuaugccucucacuccauguccuaccacaagacucuuuucuccugugggcuuaaccccugcauuggguaccaccagagggcaguagcuccgccaggaucuggguggggcuauguaaaaaaguucuggaggcucugaggucagaccuaggauacaguagagacagauguuucuuucagcugcccugggugugccaugaguauuucuggauccauugaugaggcagcuguaacacucuuuucucacuuuguuucccccaaaaugcugagugaauggcccugugggguugguuggagcugaaggggcccagcuagaguggagggacuuguuuuuccauguucauuguccucucuuuagcuggucuuucugaaugucagugauccuugccaucaaugugacgugccugguucucaaaggagcaggaggaacuauaaggagcccuucuuuaaaacaaccacuaucagggccucaacuguccuacugaugcucagauccaguccugaccucucaccuaaacucacugucggcugcuucuucacugguccuccugccucuugacucucuucaucucagauucauucugcaaaucauucagcagccugacuaaucauccuaaacucccggaguucgggaauugucucuuguuuacugcuguagccucagcuccuaaaacagugcuugaugccuggguagugcugaauacauuugaugaaggcaauauugaauguauuuccucuagauccaguagcauuauuaauuuguaugguuuuauuaagaauuguuucauucauuuauucaaggaacauuuuugucucucgccacaugcuaaucccugaaugugguugguagauaauauaccagagauaagugaucuuacagggcuuacaaucuaguuuaugcugagaaaggaaguugaaucuuuccuggauucacuuccacacgaaacagacgaacgagaaagauaugaguucacuugcuuuuuuguuuuguguucacugcaggcuucuuccaggaguuaucccagggcagggcugaguguaaugggaggaugaggcaggagaguaggugagccccaagguccugagagaagcuucagagacuuccaggcucucaucuccaagugggggauuggguugaguuuauaaccuccuuuccaaugcaguaucacagaguaguugagagugcucacauacugaagccaguuuggacucaaauccugcccuagccaugugaccuugggcaaggucucuaugccuguuuccuuucuaugccucaguuuucucuccguaaaauagacauaacuguaauacccaccuuacaucgcuuguagcauugugagggauaaaugaguuaucacaugugagguucuuuaaacaaugccugagagugaaauagauguuugccacuacuaauuuacuuacuguuaggcauuuucaucuguuaauaugaaaaggaaaaaggaaaggugguuuugcauaguugugauggaaaaacugaggcucagagugauuaaucuuucagacucaccagguggggaaacagggcuguuggggcccaaaauuuacuuagauuucagugcguuuccuaggucugaguugggacuuaaauacagaacaccaaagagaucaucucuuuaacauacagcauucuaacugaguuugucucuuuccuuuggauaaaauaccuuucuaagaacauuuuacugagaaaagaggacaaaagagaauuacccuauaaagauggagucacucucagaacucacaggcugugucaguuccaugcuuuuuuuuuuuuuuuuccuuuuuuugugagacaaagucuuguucuguugccccggcuggauugcaguggcguaaucucaccucacugcaaucuuugccuccugguucaagcaauucuccugccucagccucccuaguagcugggacuacaggcacccaccaccaugcccagcuaauuuuuguauuuuuaguaaagaagggguuucaccauguuggccaggcuggucucaaacuccugaccucaggugaucugccugccuuaaccucccaaaguggugggauuacagaggcaugagccacugcacccggcucugucaauuccauuuuaagggauaucugaaccucacucuuggccucaaccuugaccaccucacuacuuaaguaagaaugaucauauggcuucuaccugggauccaggcucagccauucccaggaugcuucuacaggaauguacaaacuauccacugaguggcaauucuguuugagccuuaaaacaaacaaaaaaacuuggacuaggagccagaagaccuugucucugugaaccucuugaccauuuauuagccaagugauaauugggugagucacuugaccuuucugagccuuugcuuccucaugucuucagcagggaacagccucuuucucagauaaccauugggucaguauuuuggcaauuguacagcucugaacagugagcaguuaggacacagcagugaaagacaaacauucugugaccugugugaaacaauguaaaugucugcuuuacuguuuugagcuuuagacuuuggucugacccauugugcccagguggaguuagcaguuaacuccugugauucaguucauuagggugaccccgccccuuucacucuucauugcuguggagaagaagaaggcagggcuguuggaugaagggucaggaaccucaagaucaguaaggggcuaaauuuuggguccucugagaaaauguugccaucugggcaauaugauaucuauuuuaggaucgcugggaaaggacucgggucagugaucucaguguugccuuuagauccucuagguuguucagggccucagcauccaugacaagugacaguggcucagcucuauuagcaaagaacugaccaacuuguugaucuauauucaccuguuugccuuuugugucugugcaguugacaugguugguagugauguggaacaagcauccuguaguuuuccacuguacccagucugccuaaauuuaauagaaaauaauuaaaaaagccaaguagugccugcagcuuuucugcgcucauaaaugcagucaugaggcucagggugcaauuagcagccuccaagugucucuggaaaccugagugugucagcgucuucuugcugacgguaaucagaccucauggcugcagucagaaugcagagggcccggaguaaugauaccgaccuacauguagugaacaaauuacuggaaaaggggcucaggcuccuaggcccugguguguuaugccugugcuccacuggagacgccugccgggcucaaacuaaauacacaucuugcucauauuacaucuuauccaaguaagauuuuccauuaccacaacauaggagacaugaagggcauggugauugcuaaaaucauacaagacugguugucugcgcuuggcacugccagggucagaaagucaucaguguaugauugcauauaacuugcauuccguuuucaucuuucuguucucuccacuuucuucagugaggucugauuacaugcaagucauggccuccccuuuccuccuccucaucuacucgauaaucaaaucccguugcucuggcuguagucauuucucuugaaagcaugccuuccucuuuguucguguugucacuucacauuguuucaguuccuuacagacucucaucuacaccauuguagcagccuccucugguuuuccugccucuggaccuucccccaacuuugugaucuguacuucuaggguuacuuuuugaaaauaaaucuguccaugcaauuucccugugcuuaaaccccuuccuuguucuuucuuucauguggcuggcguucagggccauuuacaaucucacacaaacugcccuuccagcuccaccuucugauucuugccaccaugagcagcuucuguguuuuuuuguuuuuuuuguguguguuuuuuuguuuuuuuuuuuacaaacuucccuuugaaaaugcuguacuuguucaccucccugugccuuuacacauaccauucuuucugucugaacauaccuguugacccuuuaauacccacuguaauaaauguugccucuucucucaagccuuucagucccuauaccauuaccguuuuguacauacaacgugcuaggugugucucccacgugagauuguaaacuucuugaggacaaguacuguguuuuauugauuuuuuuaccuccagcauauaccacaguagaauacagcaguuacucaauacgugcuuaucaaacauguacaaugcaacguagaauucuguaccaagaccguuuauagucuggugaggaacaucaguuagcucaugauaccacugugccaaauggauaaguguccuaagagaggcuuuaauacacacaugguuaagucacagauugaaaugccugucugagaagaacuguuuguaacugggauuuccuuuauugugguaaaauauacauacauaauauuuaucauuuuaaccauucauaaaugcucaauucaguggcauuaaguacauucacaguguuguguaacaauuuucauuaucuauacccaaaacauuuucauuauccccaacaaaaacucugugcccauuaaauaauaauuuucccuuucuuccucccaucagccccagguagacuauucuucuuucugucucugaagguaccuaaguaccucauauaaaucaaauuauacaauauuuguccuuccaugucugacuuauuucauuaagcauaaugcauuuaugagugcauuuuuaagguccauccauguuauagcauauaucaaaauuuuaugccuuuuuauggcugaauaauaucccuugguauguguguaccacauuuuguuuaucccugucauuggacacuuggguuguuuccaccuuuuggcuaucauaaaugauacuacuaugaaaauugguguacaaauauaucaguuccaauucccgcuuucaauucuuuuggacauauaguuaggaaugggauugcugggcuauaugguaguucuauguucagccuuuugagaaaccgccaaacuguuuuccacaguggcuguaccauuuuacauuuucuucaacaaugcaugaggguuucaguuuuucuacauccuugccaauacuuauuuuucuuuucuuuuuaaauuauagccauccuaguggguguaaauggaauuaucuugcucggccaggugcgguggcucacgccuguaaucccagcacuuugggaggccaaggcgggcagaucacaaggucaggagaucgagaccauccuggcuaacacggugaaaccccgucucuacuaaaaauacaacaaauuagcugggcgugguggugggcaccuguagucccagcuacucuggaggcugaggcaggagaauggcgugaaccugggaggcagagcuugcagugagcagagauggcgccacggcacuccagccugggcaagagugcaagacugcgucucaaaaagaaaaagaaaaaaaaauuagcugggugugguggugcgugccuguaaucccagcuacuugggaggcugacuuuagcuaauuuaagcaaacaaaggauuuauuggaagguaacuaaggcucauggaauggagaguuuaacaacagagcucaggaaggaaagauacagggcagcuaagggaucuuagcaauaggaacuuauguauagucucuuuggggugacccaacuuuacuauuuuauuuauuuauuuuuuagaaaugaggucuugcuguguuggccagguuggucuuuaauucuuggccucaagcaguucuccugccauggccuuccaaagugcuaggauuacaggcaugagccacugugcccugccaagggugauccaacuguagcuuccuuuuauauuugguuguuuguacucucagaagcaagagucagauuagcuaagcuucagcuaugugcccaucucugugaugagaggacagcauucuaggaucaacagccugccaacucguggaaaugggaaagaguagguccugaacauaaggaagaaaugcagagagagaaaccucagugucacaguacuucuaagaucuacugacccauugaggcagaugauggaggcaaccugaccaauccauggaauagccucuggguguuucucuuggccauagaaucuugaacgcccuggccugugaccagugccaacccauuguaaccauauauaucugacauucuuucuugaaaccucucugguuucuccauguucauucuuaaguacgguugguaagacaaagacuuuugacuauuaaaauaaaugaggggagaaaacuuuuugaccuuugcauauggcuuuuccuuuaauauagauaauaauaauuaccuuuucauauuucugauuuaucuguucaugagaaagauuugcucugggaugcuauuacaucuacuuggucagacccuugcuucauccuguuauuuuuuuauuuugauauagacauaauacugugcauuugaccuugucgaaucucaucuucuuuuuaaggacaguuuuucuaaauuuaaaaagagucuauuuuacucuugcuuuccaaagugcagaaaugagcaauuuuagcuuugugcuugugugauucuuccauuucucauaugacucaucagaagcagaaaggugugaucgcuuagaaaagacaguagauuggggccgggcgcgguggcucacgccugcaaucccagcacuuugggaggcugaggcaggcggaucacaaggucaggaggucaagaccaugcuggcuaacacggugaaaccccgucucuacuaaaaauacaaaaaauuagccgggcauggugguaggcgccuguagucccagcuacucaggaggcugaggcaggagaauggcgugaacccgggaggcggagcuugcagugagccgagauggucccacugcacuccagccugggugacagagcaagacuccgucucaaaaaaaagaaaagacaguagauuuagagacugaccaucugaguuaaaagucccagcacugucacuuacaagcaggaugugauuugacuacaagugacuuaacguuuuuguuuuuguuuuuguuuuuguuuuuugagacagagucuugcucaguugccaggcuggagugcaguggcacaaucuuggcucacugcaacuucugccucucggguucaaugguucccccgccucagccuccugaguagcugggacuacagguaugcgccacuaugcccagcuaauuuuuuguauuuuaguagacaugggguuucacuauguuggccaggcuggucucgaacucccgaccucagguuaucggcccaccucagccucccagagugcugagauuacaggcgugagccaccgcaccuggccacuuaacaguuuugagcuucuguuuccuuguuuauagaaucaggacaacaauagcauuuuggcugugagcuccucgagggcaggguugugguugugaggcacaaauaagauaauaaaaugaaaauauuauuaaaugcauuguguaaucauuguuacgaccaucacugucaucauuauuaucaguacggauuuuagauaguacccaggauuauuuccuuuaggacuccgcaccaucagugcuguuguugaaacugcgacucuuucaagccagguguuggcuucucuaaugaguaugcaugagacuugucauguggaauacuacaaaaagcuuccagaaaccaaaguagauuauagcuauaauguuccccuuauucaaaugcccuaaaagagacgaaaguuaaauugccaugguaguuugaucaucccagaaccguaguguaccucaucagcuccuuuugaagaugauuguggacuuaauauuauguguucucauguuuucucaacuggacaaaugacuagaauuucugaggacauacaucucuucucucuuggcuauuuuccaagccugagggaaggacuccuguacuucgugacuauauagaaauuagggcugcugguucugcaauucugucugccaaccaugucccuuguuuuucagcacauuaucaggcuaugcagucuugaacauguagaucccaagcagcaaaacuagaauuuucaaaauaaauaagaaagggguuuguauuauuauuacuauguuguagagacaggaccucacuuuuuuguccaggcuagucuugaacuccuggccucaagugauccaccugccuuggccucacaaagcauggggauuauacacguaagccaccuugcccagccaauaagggaauauuuuuaaacagcaugucaucauagcaagcuucccuuguacauuaaaaguuugaaauguuuaaaauggauuuuaaaauggaccuccucaugcuggguuuagguuggccuuucaucgcaacgggaacauacucuauuuaaauguucacauuauuuucuaaaaagagaaaaagaaauugucuuucauuuaaaauauuuuucuuuuuauucuugguauuaacaacuuuuucuggaacugcucaauaugcaugcgugccugagcgugcgcgcgcgcgcgcgcacacacacacacacacacacacacacacacaguuuuguuuguauuuugucaucauugcuaaaagacccucaauagaucuuucagucguaaugcaugugaguuaacagguagacuuuuuuauuuggucucuccaugucccccgucucucuugucugucuacucuuacucuguuucuaaguaucucacaaaauauuccacagugggcuaauuucuaaccugaacuuuaaauaggcuagcugauguucagugcacaucagccuguugccgcacaaugacuguagaacauggcguuggcacugcaaagcauuggugguggcauuacugucuacuacagcaaacuaaaacaugaccuacaaucuuguguugcauuguugccuuaugaugaauuugauauaguccuuaggcuucagccagcaacucuagcuguccuuugucauucauucauuccagcaaauucuuagucugcuacuguuagcaacuuugcuucaagccaguaaccuuaaagcuuauucucaccuucaugcucaucaguguuuuccauaccaacuuucuucuguuuucccauucccccaccauaauuacacccacucucaaccucagguuuucccaggaguggagcuuggcucuacuagggauaucugauguauuaguaaccggccacugaugacccaucugguggcugucucuagcugccacuggaacuggaaucucugaguuguguuuacucaagaccacauuagcauuucuuaguucugccucugcagauagccugagcuguggggcacaggaaggggcagcuacauuccuuccagugucuauuccaacacagguaggcaauggaguuggauugcucuguauucuuaucuugaccccacuauuuccuagcugucuagcuuuaacuuucccaaacaucagauuccucuucucuaaaguggagacaguaacaguuccugucucuuagaguccuugggaagguuuaagugggcuaauguguaaaguuguagcacaguuauuggcacuugguaaauaaugaaugaugggacccgucuccagacuugaaucacuuuggggcaccuguagaugggggagagggcagacuuaguagagaaaauaugugugcuaagucuuagaggauaaggaguuagcaucccuuccaucaguggauaaagaagagaagaauuccuggcagcaguaugacuaagaaauagaugacagcaugauguaucugugcacauacuuuacugacugcagggugaaguaagauggggaggcaagaggaggggaggcaaaaaagauggccaagagcagaucacuagaagccuuguagaguccauggaggaguuaaaacuugaucucccaucagucccuguauccacauagucugguuccucuguuaagcagucacauaaauaucuuuaaggcagcaacagugaaaaggggaaagagagcagcgaauuggccucaaaugaacuggcaucucuuuaaagcuaauauuccuccuugagaaugcuacuuuaauuaaacaugugcccugcaagauucauuauugccuuacuuguguucucuguugguugucucauucauuaaucugccgauuaguaacccugaacucuugcaucccuuccuuuuuuuugcauucccuuuuuaauauacuaugcuguuuccccugggacauaaacuccaggacccgucccuggccugcucguguuuguuuucuuugccccuugugccugccucugcuauaauauuuguaguauguguuaaguaauccuuaagguaacauuuuuauuaugucauaaaaagugcauggcaaauauauuauaacucauggacuuuguuuaaaaaugaacggauaauuuauugaguguguuacaugagccucacuccccuccccauuucagcugagaccugcugcucauuuagccaagccuccuauugagugcucccucccugugacaugcugggaaagcaggccugugguuggcuagaggugacaucauaguuuauguacucaauaaaaauuuaauuaagucauuacaggaauugcagucaucauuuaacccucugauuucuucuguuuaguuuauuauuaaacauucaguaauaccagucacugaauccugguggcuuauaaaauaucugcaugaauuuuaauggcuuaaauaaaugggaaaauaugaguaacugauauaaaaggaaccuuuuccuugugguguuguauguauggguuuuuaugaaaagcaaagcauuauggaaaggaugaguuuaauaagagaacggcccaacacuaucugggaggaguuucucuucugcugggugcagcuguguagucaugggcagagugcuccauauagaaugaucuggcaguggagagguggggaaccugcacaccagcaaccaaaaacuuaaaugagggaauaaaauccaacagggauucaccagagcgaauauccugcuccccuuggcugcuggacuagcuagaagggcccugccgagugaguccgguaguugaggaaggugcugucacuugcccucaccuguugccugcagaucacgugucuguacugaucucacuuccacccucuuccaggaaggccccuuuucaugaucuaauccagccugggugaugauaucugaaaagcauuucuagcuguggcaguuugccauugucucagcuagaggugaagggagaggcagcuuacaggucacuggaguuagaauauaggaccaggaagucaaggagccuugcuaguaaggaacucuacucuugcacuccguuuuuccugggcaguagccaaccagaaugcagguguaucccaagaggagaaaauguguuuguauguuugugggccuugcuggaaagcaagaacugagguuugcagaugaauguguugaugaucucuggaaaugcccugcagaugguaaaguaggaaaagcacuuacccagaaaucagguucuaauccuggcucuuauacuaacuugaugugugaucuugaauaagucucuucuuucuggguuucaguucacccuuuccucaaggguauugagcuagguaaucucugagggcccuuccugcuccaaagcuuaauggugugauacaugacauaaacuagcucugcuaggcagguucagugaauguuuuccucugagagaugcuccugccuuacuguuugacaccucugauaucauccguuuguggcugugauuauuccuaacacaauuaggagaacaacucaugugggaguagggagauccuccaaguauggguaucaggaggucugaguuguagucucauccucacaugacagaaggaaugaacucuagcucuggccuguuucuugacucuucccuuuaccccuuucuggaagaugggacaguagaaguuuggcaguauauguuucugaaauuccagaaacacagaagguauucaacagggggaaagaaaggcgaagaagaagaaaauccccuaaaacacuaguuggauagaacaugcuaugcauggcguaguacacaggcccuuguaaaaauucaguuaccagcaagccugucuuagccccugcucuggguuaggcucuggaccagaugaugggggugccgagauuaaucagacaugguuccuaugacccuugaguagcucccagacuaaugggagagacaggugcauaagcagcucuaaaccacguguguacccaggcagaaaauaugcccagagagcugugagaacaccaaggauggauggcuaauguagcccugguugaaggugugugggauaggucaugguuugcacuccuaguuacauccagucuacauuuuccagccuugagcuucacaauccuuucauuuuugaaaauuauccauggcuguaaagcauuggaacugguuuugguuuuauguaaacaaaccagaaguuauuacuuauaauuccuuacauuugcagagcauucugcaguuuaccaaggcuuucagcauacauacauuauuaaauuaaugaaugaaugcaugcuaacucacgugcucuuccaaauagcccuguguguaggaaaggggccgggcgcaguggcucacgccuguaaucccagcacuuuaggaggucgaggcgggcugaucgccugaggucaggaguucgagaccagccuggccaacauggugaaaccccaucucuacuaaaaauacaaaaaaauuagccaggugugguggcaggugccuguaaucccagcugcucgggaggcugaggcaggagaaucgccugaacccgggaggcggagauugcagugagcugagaucaugccgcugcacuacagccuggccaagagagcgagacucugucucaaaaaaaaaggaaaugggccgggcgugguggcucaugccuguaaucccagcacuuuaggaggccgaggcggguggaucacgaggucaggagaucgagaccauccuggcuaacacggugaaaccccgucuguacuaaaaauagaaaaaauuagcugggcaugguggcgggcaccuguagucccagcuacuugggaggcugaggcaggagaaugcugugaacccgggaggcggagguugccgugagccaagaucacaccacugcucuccagccugggugacagagcgagacucugucucaaaaaagaaaaaggaaauggacucagguugacuugcuuaagauaacauccuguguacauagcaaaacuaucacuugaacccagguuuucugagucuaaauccagaucacccuuucuacauuucuuccgagacuaguuaugagccacaggauaaaaucacucagucuuugauuugugacccaaaguaaaauuauccucccagaagcagaacccuggcagacuguaaggaguguggacucuggauucagacugaccuggaugcugaucucagcuuuaucaugaauuugcugugugacacaaggcaucacuucaccagucugagucucucacacagucacuuacagucugagugacuguaacacaucuaccucccagcccaugacaggugcuucguaaaugagaugacugugggcauggucaccgucagaguuguuaagcacaaaucuuguucuccacauaaaguuccaaaugccuuuuggcuauuuccaaaaccaucaguucagauagucagaguccuuacucugugcuauacauugcacuggcuuucugcugggauccugaagaggaauaaaacguggacccugccuuacagcguguuacugucuggaggucagaguuguacccuauugaaggcauucagcgaacugcacucugggcccugaagauccuccaggccaggcuguuccccaagaggagagaggaguucuacugggcucucaaccaucucaccagaauugcauuucuaaaacagucucugaguuuuuguuuguuugagacaggcucuuguucuguugcccaggcuggagugcaguggcgcgauccuggcucacugcagccucggccucccaggcucaagugaugcaccucagccucccaaguagccgggacuacagucaugcaccacuaugccaggcuaauuuuuguauuuuuuuguagggaugggguuucgccauguugcccaggcuggucucaaacuccugggcucaagcgaucugccugccuuggccucccaaagugcugggauuacaggcaugaaccacugcccagccaaaaugaucucuuaacuuuaacauucuucuugcuucagagcugccccugcuuuguucuucccuccuuuccauggccucagaggccccccuuuuuccucagcaugucucucagaguccugccucucucccuccucuucccaccucugaccacuuccuucucuguuuuuucaucacgacaaacucuuuugaguggcccuuaagaugucuccuaaccuagucucaacauaacuuucuugugauccugccuauucacccucccugacacccucccugcgccauuuucuuuccagccucugcaccuuugcacaccuugcucugucuagaaugcucucucucccuccucccccucacucuccucugucaaacuccuccuccuccaaguuucacuuaaauguuaccuccuagagagcccuuaccagcucccucaagcagguaaaacuaaaacccauuuaucacucagcauguuuagaauaggauuugaggcaacauguugcaguauaauuauuuuuuauaugccuauuuuccuacauuggacugugcuccuccaaucaagaaacuguuucuuauacuugguucauaggaucuagcacaaaacuaaacaugugguuggggcucaguucauuaagcugacuuguguaauuugagaucaaaaccuaaaagaauuuggcaaauuggggagaauccugacacaucagggaauugagaauggacuggcagcuugacuuguuaguggccgucucucuucuacuaagagucugugacagcuaagagucaaagaucauacuuuuuggguuuuuuucuuucuuucuuucaaacuuuuguuuuugccauuuguuucuguagguuaaucccuauauccugaagaagaacaugauccucaugacaaaucauuucuaugcagcgaucuugggauaugaugagguaagauuguuugccaaggcuuaggcaggacgguggccucccccagcaaaggcuuuugaugagagccucugagggaagccacagggaccauuguuacuggcuaccaccauggcguaguauuuauuucuucauauucaucaacugggcagcgagaaugaaugugcugagcauguuugggaaacaugccacauguuugggaaagaaagcaguauauaauauggucaaaccauucaacuagucagcauuuguugaguggcugcugggugcuggauggagggacagaggcaaaugagacacugucuuagccccaugugcucccagagagaggaggauauucacguaaacagcauggucugccaggcaaaguauacacuuuuuuuuuuuuuugcuuuaauuaugaaagcaauacauauucauuuugaaaguuuguaaaacuggcugggcgcaguggcucccagcacuuugggaggcugaggugggcagaucacuugaggucaggaguucgagaccagccuggccaacauggugaaaccccgugucacuaaaaaugcaaaacuuagccggguaugguggugggugccuguaaucccagcuacucuagaggcugaggcaggugaaucgcuugaaccugggagacggagguugcagugagccgagaucaugccucugcacucuagccugggugacagagugagacuccgucucaaaaaaagauaaauaaauaaaaauaaaaguuuguaaagcuguacauaagugguugaaauagaaaucagaagaccuggccaggcauaguggcucacgccuguaaucccagcaccuugggaggccgagguggguggaucagcugaggucaggaguuugagaucagccugaaaccccgucucuacuacagauacaaaaauuagccaggcaugguggcaugugccuguaaucccaccugcuugggaaggugaggcaugagaggcggagucucuugaaccugggaggcggagacugcagugagcugagauugcgccacugcacuccagccugggcaacagaaugagacuuggucucaaaaaaaaugaaauuagaagaccuauuuccuacccugcuccagacgaaaacuuaauuucuaguuuauuggauguccuuccgaauguugucugugcauagacaagcaccuuugucuuuuccuucuuuaugcaacuggaguuacacuagacacaugauucugcaacuugcuuuuuucacugaaguauguaucuuggguguccuuccacaucaggacauuuggaucuaucucaucuuuuuuuuuuuuuuuuuuuuuuuuuagacagagucuugcucugucacccaggcuggagugcaguggcgcgaucucuacuuaccacaagcuccaccucccagguucacgccauucuucugccucagccuccugaguagcugggacuacaggcgccugccaccacacccggcuaauuuuuuguauuuuuaguagagacaggguuucaccguguuagccaggauggucucgaucuccugaccuugugaucugcccgccucggccucccaaagugcugggauuacaggcgugagccaccacgccuggccucaucuuuuuaaaaaaauuguaaaauauacauaucauaaaauguaccauuuuaacuauuuuuaaguguacaguuuaguagcauaaaguacauucccauugcuuugcaccgucaccaccauucaucuccagagcuuuuccaucuuccaaacugaaacucugucccuauugaacaauaauuauucccuccuucccucauauccccuagcaaccaccauucauuugacuuuaugucucuaugaauuugacuacuguagauaauucauauaaguagaaucacacaauuuuugaccuuuugugacugacuuauuucacuuaacauaaugcccucgagguucaucuaucucaucuuuuuucuccccaacauuuauuguggagauuucaagcauguagaaagaaugguguaaugaacaccugauauuuuaaacuaaccauaugcuuuuauacugauuuugugguuaccuccagauuuaaugcaagcaugaccccuccugggaagcgguuccugaacuuccugugacucagcucauuccauccucccugcacucucacagugcuuacuacauucacauuaucugucaccuuggcuggguggggauuucuuuuuggguagugcaaugccuacuguguuugcauuucuguggccuggcauagugcuuggcaugugguagucaaagagugagaaaugcauaaaaggacaaaaguuaagaaacuggaguucaguuucuuaacuuuuguuaaaauagggucuccugauuccuauucuacuggauauccugaauuacaagggagcauuuacauugcauacuauacacaucauuaacuuaacaugagcuuucggggguuauggguugggaauugagaauuauugcucaaguguacauaucaauuauaaaaguggacgaauuguaauuguagaagccuuacaauauagaaaaggaugaggcuuaggagugaagaacuacaccucucugugagccuuuguuuauggucuuuauugcagguggcucuauuggcucagucgauccuuucaucaguauuaauaaaaauguaccgaauuguguuuguuuccggucccccauccaguccauucuggcagagccauuuuacccaacugugccugaccacaggagucaccuggggugcuuuuaaaaucuaaaucuuuaucaccucucugaagauuacaauucaguaggagugcugccuggugguucaacaagucacccgaaggugacuuuuaagagcaggaaauuuuggggaaauauacuaauuaccugggacacuuuuuagaaauaucagugucugggcccugucccccaaagauucugauuuaauugguggagguggacaucuguaguuguaaaaguucccaggugauuuuaaugugcaauucuagaaguuuuuccuguauuuuaaugugcaugugagucaccuagaggaccuagguacaauucagauucugacucagcaagucuggggcggggccugagauucugcauugcuaacagcugcacgugaugggggugcagccauuuugcagaccacacuuggagucacaaggugcuagagcuauuugauacuaaacacaugcagcuauuuuaauuuaaauuaauuaaauaaaauggaaaauucagauccucagguacucaguuacuauaugugacuaccaucuuggacagugcagauacagaacaguuccauagucacaaaaaguucuauuggacagcgcuguucuacagcaaccuuuuccuagaaucuugcuuggauuguucccccucccuggacgcuuugggaaccucccuguuuucugugacauuagguccaaauugcucccugaacuuccaggccuucugugaacuguugccauugcuaugugcccuaucugccuuuauauuucuugugcucucucuuaggccguuugccuuacugcccuauagacaugcugugccugacugagacucuaccuaacaaugagggguugagggcaguagcugagucuuggucagcuuuagggucugguucagggccugguguaccuuguaggcacucccucuguaaauauuuugaauauuuucucuugcuuagaauaaucugcagcuggccaggcacaguggcucacgccuguaaucccagcacuuugggaggccgagguggauagaucacgaggccaagaguucgagaccagccugaccaacauggugaaaccccgucucuacugaaaaaaaaaaaaaaaaaaauuagcccggcaugguggugggcgccuguagucccagcuacucgggaggcugaggcaggagaauggcaugaacccaggagguggagcuugcagugagcugagaucacgcuacugcacuccagccugggugacagagcgagacuccaucucaaaaaaaaaaaaaaaaaucugcagcuuuccaaaucuucccaauuuuuuuuuuuuuuuuuuuuuuuugagacagagucucacucuguugccaggcuggagugcaguggcacaaucucagcuuacugcaaccuccaccucccggguuuaagggauucuccugccucagccuccugaguagcugggacuagaggcaggcgccaccaugcuugacuaauuuuuuuuguauuuuucguagagacaggguuucaccacguugcccaggauggucucgaucucuugaccucgugauccacccaccucggccucccaaagugcugggauuacaggcgugagccaccacacccgcuaaauccucccaauucuuaaaggccuacuucuucagaaagguuucccugaccucucuggaucgcuuguguuuuuacugugaauuuccacacccauccaucuauucauuauccauuuaacagguagcuuuugagugucuaccaugugugauacaugggaauauauuggugaauaaaacaaacacggucuggcucuuucccacuagagcuuaccuucuaauugagagacauaguaaacaaguagcagauaagcaguaaauaucuaacuacaguagagugcagugagagagaacaacagggggaaugacuugauguggaccaggaagaucucucugaggaguugucauaaaagcuaagacuguagaacaaggaggcagccauguagaguguagcugagucucacugugcagcuuggcauguguucauucuccgggauuuuacucugugcugcuguuagaugugcacugauuuugucccuucagcuagauugcaaguucccugagagcucagaccauauugcugugacucuuguguuccuagcaucaugcugagcacauagugaugucaaaucaaucuucacugaguggaacucugccacuuuaaacccuuaaucagaacuagaacccuccaaagcugaaacaauccccuuggcuuccucucaguuacucuagaccuaggugucuuaauuucugaaggaugcuucauugugucacgagggaaaacaaguaggcacccgauuagauuggggggaaauuaugcugugcccucauguuugguucccaggacccuucuuccaguucugcuuucuuaguuugaaaugugcacccucagauuagucucucauuuguuuucacugccuuacacuagcaguguggugggaagaaggcugaaguuguguucguugauuuauucagcuauucuuuuuuuuuuuccuaagacagggucucacucuguugcccaggcuggagugcagcagugugaucacagcucacuguauccucaaccuccccaggcccaggugaucaucccaccucauccucccgaguagcugggacuacacuugugugccaccaugccuggcuaauuuuuauauuuuuuuguggaaacaguuucgccauguuguccaggcuggucuugaacuccugggcucaagugauccacccagcuuggacucccaaagugcuggguauucagccauucugauugcucucccacucuaugccagguucuguauucugacuagagugggucagucaucaucccccaccucaucaaugcaugcugguucuaguucagccaucaguuagcuagccucuaagccucaguuuacuuaucuuucaaauggggauauaggccaggugcgguggcucacgccuguaaucccagcacuugggaggccgaagcaggcagaucacuugaggucaggaguucgagaccacccuggccaacauggugaaacccugucucuacuaaaaauacaaaaaauuagccgggugugauggcacaugcccguagucccagcuacuugggaggcugaggcaagagaaucacuugaacuugggaggcagagguugcauugagccaagaucaugccacugcacuucagccugggugacagagugagacuucaucucaaaacaaaacaaaacaaagcaaagcaaaugggaauauaauaucuauucuacuuggcaaacauaaucauuaggagcuaggcgugugagggaacccuaacagucugaaacaguuggguuguucucacuauuaguggguccugagucauccuuuuccuucugauggcucaggaauuccugauuaugaauuugccccuucccagccaucucacccgcugcuaaaguugccuguuuucccauccugggcucugcccauucuccagguccccauaacacgcgcucccaaucccauuccuuucugcacagcacauguggguugcugccagcagcgcucuggcaugugcccaggcacagcagacacaggcacgcuguugugcuagcaaaucguuugcagaagggugaugugccugagcuuguccucugcuccuguccccaugugccagaaaaagccaguuuuccugacucagccauugugccaggacaguccuaagcuguggaaccguaaggaggguuuaucagagagcauuuggaacagguggaauguuuuucuaccaaacugucagcaccccauacuggacauggcccuuguuggcagcaggccuggagccagaccucacauaccacaaugcccaagaggacagaccacaauaaaaugucgaauaaagugauccugggucuuuggguaauguuuaccacuuacagagccauucauggccaguaucucuuaauucucacagcaacucugugggauagguauuauuaggcuuguuugacucaugaaaaacugaggcucaggaauggcuaauagcuucuuaaaggccgcauggccaucaagugacacagcuggcauucgaacucugugcucuggcucccagaccccacgguuuugacuguauccccgcugucugccaaagcaugcuccuaaucuuuguauccaacagauuacacuuaacaaauaguucaagaaugcuauaaguagagcagguaacuucaucuguuuugaagaaguagaagauugagacuuugguuuagucagcugccaccaucacugaucuuggcagagguggaauuaggacuugaucucccuucuaacuccaagucagcacaucgauuccacacacuaccuuggcaccuggacagagcaacuucucagggccuguuccaucagccaccuucaccccaggaagcaagacucucagcccucccuccucuagagguccaagcuagaaaauguccuuagcugguggcuggggcucuuauuuugcucuguaaucuuuaagcuucccaacagaagucuccucugccaaaagaggcagcguuaggcacacacacacaugcaagcucugagccuggcccucuguggccccagcaauccugcugaacauccuguuccccuacuuagggagaggcugggcccagaguuggguaagagugaagacaagguagcuggcucccuucccccaaggaccaguugccuugccuugguccuuggaccaagcaagaaggcacaguccaugcccaccuccauuccugggagaaacauacauucacaauauucccagcccgugcccuguggacagcagggggagcauugcugcuauggacagcagggggagcauugcugcuacuguuucucuucucagccucucaaguguugccugggccaggcgcaguacggaguacugccugagucccagcucugcaucaccuaacugguggcuuggccccucuggacccccuguucucccucuguauguaauaaaaugaagggauugggccagauacccuuguaagaccccuuccaccucuacugugugacugccccauuuuccucuugugcguggagggcccuucugagcugauuccaugguugcuagcauguucauaguauccccaccgucuguguccuggcucuguggaucccucaggagaccacugcugugcuguauguuccaggggauccuuucagaugaucaugggcuggccgcugcccucuggagaaccuucuucaaccggaaaugugaagacccucgacaucuugaauugcugguagaguaugugaggaaacaggugagugacccuuucccuccccucccaaguccuggcaacaguggguccuccucuugggcuuucaggggaucaugagagguggaguuaccaaggaccagccugagagaauucugaccagaucacaucagcacuagacgcugaagaaggagcgccuucuguauguccaaccaugaacugggccagggagcgggaaaugggaagagagagagaaagaggcaucgaguagucuccugcccucaggaacuuugagucauucauucacugugcaccucauugccuacugugcgcccagugcuaugcuagcagcugggcccacagaguccuggcagauaugagcacgugguguaguagcagcugcccacuguggaccccuucucuacccacuuggauuuguuuccugcuccugacuuccagcaaaacugggcagcaggcagcauuucacagacagccucuuccugcuagaugcucuccacagucaaguagaguccccccacuucaguuucucaccccucuggcuccccagggcuccccgacaucaaagcuucuacgagaaagcuccgcagugggggcugcuuacccacauagcuguccucaagccccggggaauuaauuccuugaccucccugcccucagauccuguauugaugggaaacucauacuugauagaugagugagcugacuggcagcgaagaggacauagaggcucuuccagggccucccagugagucagccugcacagcugcccuagggccccaagcugugugauucaugugaccacugaggccucagcugccucagacagcucaggcugugccaugagucacaccuuugcuucauggccuggccccuggagcugaaggggugucacgccacaguuacucucuuguucacuuguauucauggucuucaacaaccaggaaaggcaaggcuggacuucagcucuugagaagacagggcccauaggacuagcuuguuaacugcuggaaaaaccacauacuggggcucugcagacccacaggguagagaaucccaggagccaggacuucuguuugaccacucuucaaaucugcuagagccagggagagggcacggcauggccagagggccccacucacagagaauucugauacucuguugacuggacucacccucagacgggaguagcaauucgcaaagcaaaugcuguguuuucugagagaccugcccaacauuuccaucugccauggugggcuugugccagaagccccaacaagacacacugggacuucuccgagggcccucuaggaaggggcugccacaaccauugucccuacaagaggucccauguggccccagugagaggcaguggaaaaaccgugaagggguucuugggaaagcagggagcuuugguggggacccaguucuaucagcaaaccuuuugagcaccugcugcuccauguacucuugggaaagcaacgauuaauaagacccaguccugcccucgaggagccagcucaugguuuggugaggaagcccaggcacacggcuaacccuggaguaagccagccuguuaugugauacagggagggcagagugcugaaggccgggaaaggaagagcaggagcugggccuugagcagacuguuugguguggccgauggcccaagagccaaccagagguucuguugagauuuucaacccaggaggugggcagagggguggcacugggggcagaaauggagucacuguaagggaggagugggcuuuagggaagagauggcagggcaggugggaauccagagccaagacacgugcgagaggcugggguugaguucaagcgucagcagcuggaagcggaagcaaccagagugguggauucuuggaagggggaaugaccuaaagccuaagaugaagucuccuggcccugcagcaguggcuucucuggaugaugaccauuuuaauggcagagcugucugccccuacuguccuagagaggugauacuggggcccacugaccaggggcccacuagaggacaacagaggcauacauauguuuaaagcgugagugccuagcacugcauauaugcauauuguugaaucucuucauguguccugugagguaccuguuucuauccccucucucaagacaagggaacuuaaaucucagagaggggaagcugccacccuggguagcagcacugggaagggacagaaucaggacucucacccagcagugcugggguggacagcauggcugugugcgcugcaagcccugacuuccuggccugcaggagcugucuagggagggcguguaggggagacguguccuugggaggugugugucugucuccauucagaggugugauagggaauucccuaacugcccccgccacccagcuccccagugacugcuuucucugaaccaccuuagugaaauuaucuaggagaucagagacggcuuggccugggacggcuuggucugggaccugggauggucagaagccccccucaugccccguccccuuccuuccucuccucugggaggcugguuccugacgcuggcuccucaccucugcccugccucugucgcuuccuccuucccccuccccugguugcagauacaguaccuggacuccaugaacggggaggaucugcuucugacaggggaggugagcuggcgcccucuaguggagaagaauccucagagcauccugaagccccauucuccgacuuacaacgacgagggacuuugaugggcugggcccuccgcacggcccgccagcuggcuucgaggaaccuccaggagagaagugccuguugguccaggacccugcagaaaguggccugaacugaccucugaacagcaucugucaaauaccuggccccauuuguguugaguuuccucuuagugugcccaggagucugaucugcugggguacagggcugggagaaccccuagcucucccgggguguccucucccuuaggggaagccccgagugagagucccccagcacacacuccccaacccccuccagcaacuacaugugacugauagcuuuucccaaaggccaaggaagggaugguguagguucaaaagggaaaccccccagggccugcuguggccuaggagcagauuguaaugcugccgaguccggucggugaccacgcguugucccucggcuuucagccaugggguugaguuggccauuaaaagaaacagagacuucucucugccauggcccuucuuuauuccagggacuuagaaacuugccugagaugguggacgcaguaaugagggcaccgcgcagcucaguuagagacggagaaagggaagaggcugggauggucucugcugcucuugccucuaguucauggagaugugucucuguucaggccaagauacagccagccaggccugucgucugggacccaggaggccucugaugaccaagggcuuucacauccuaagucauuuggaaggaggccuugagaacaaagucaccuuugucacucccagugaacugaaugaggaacaugcugucuccugucuuggccuccccuuucaugagauacuggggagaagagaacauuccuccuggcuuaguuguagcagacccagaccugugcccagcuuuggucccccuucccaacuucugaagcacgugcugcagagccaccuuggucugagcaccugaggaccagccccuccucccucagugcgggucaucucuugggggauuuucuuaaagugaagaaaggggguggggaaccauauugccccucccucccccaucaaacuuccuucauuuaacuugcuauaaaaugagucauauaaagaaacucuauaugggugagguauaucccacuucugugaaaacauuacaaaucaaaccgcuucucucaguuuauuuaagaugcuuuuguugcgagcggagcucuagagugaagccuccugugugugugugagauaauaacaccuuguaacucauuacagcugggcacuauuuacauaaaccagagcugagccaggcaggaauuugcugauuaauuuauuuuuaauggagugaaguauaccaugcaccaaaauaaacuuuacuguguguaccuaacugcuccuggaa

SEQ ID NO: 191259 - RNA, 30678 nt, Homo sapiens
agcgccgggcagcacuuccgggagccuggggcccaggacugcagcggcuucggaaggugggcucugccagcgggaccaugcugcuccgagccgcuuggaggcgggcggcaguggcggugacagcggcuccagggccgaagcccgcggcgcccacucgggggcugcgccugcgcgguacgcucgggucccgcucuccgggaggcgcggaccuguccccuccgcgcggcgacgcaacugaauauuccggagccuuccuguccacccugcugcccagacccucugacccuucucucaaaugacacaucccucaaacuuucuuaggcggguccccgaacgguugaccccggcgcaccaccccucgcacccugcgcgacaggcccccagagccguggaggcgcguccuucagaccgcuccuggccaaguuacagaugcugcuccgggcucccgugcagaccguuaccuucggucagaagggacugcaccuacucuggcuccacguuccuucuaaacgucuuugcccuuuagagccuuccuuccuacgauaccauuugaauaucaacucaacacccccuccaggaacccucucucccucucccuuaccuccuuuuacagcgugucagguaucugguguuguuuucuuuccauugagauucgacccuagcaucccuuacacuuaucucaccuccagccagauuuuuccuucugcccuuuggaugccaugcguucauaguugccuucggucuuacuuggcuacuccguuccauuuuuuaucaguuggagaccgugcuccucagucugcgguucccgcagauacagccgcugccccggagguggggccagugcugcgaccucucuauauggaugugcaagcuacaacuccucugguaaggaugaagcuuuucccaaggcugcuuauaggaaguaaaugaugggcgugaucacgcaaagaaauggcugaaucccuggagaagugagagccgugaaggugugcuggaaaaagcacugagcgaggagucgggaggcuuaaauucgaggccacuggcauuggcuuuacuacucacuagcaauugaccuuggucagaucacuucagcgcaggcucuauaguauuaguuaaaagcaugggcucuggaaugagcagaacggccacuuaguaacugugugaacuuggacaaguauuaaacggguuaaaagacuaaugcaaguuuucaccaaugugugaccagggguguuugccuaggcccuguccugucccagccccuuauagaucacauuaccuggcaggaauggaaacaccagcagaaacagaugucggaacaaggcaguguuuguagacuaccugaggggaggcagaacaauccgaguugggauggguugugagugggaguguauuagguugauauuugguggguaguuuugugggaacaaaagaauguuugaggccuccucuaggcagugccugagggguugagagugucuuaaggcaggguggccaggucugagggguggagugggaccugaauugacgaugcgcucaaggaaaaugaucuguucuguuguguucaggacccccgggugcuugaugccaugcucccuuaccuaaucaacuacuaugggaacccacacucccggacacaugcuuauggcugggagagugaggcagccauggaacgugcucgucagguuaguacacaggagucuaggagguucuaaggucaaagaggggcaguggccugugggaggcauuucuuucuugguaggugugcauggagguagaaaugguuuuggauucuuucuggaagagauucaaagagcagccuuggaguuugacugcaggcauuugauugguucccauauuuccuggcuaaaugacuugggcaaguuaucuaauuucuuugagccuuauuuuccucauuuaaaacagagauugugguaguuucuacucuguaggguuacuggguggauuaaauaagacaaugcugauaaaguguuuauuaccacaacaucuguaaguaagaaguacuauaaauaguaagagcucaauaguucuuuuuuuuuuuuuuuaugagauggaguuuucacauuuguugcccagacuggagugcaguggcgcacgaucuuggcucacugcaaccucugccucccggguucaagugauucugcugccucagccucccaaguaauugggauuacaggcacacgccaccaugccuagcuaauauuuuuguauuuuuauuuauuuauuuauuuacuauuauuugagacagaguuuugcucuuguuacccaggcugcagugcaguggcacgaucucggcucacugcaaccucugccucccggguucaagcaguucuccuaccucagccucccaaguagcugggauuacaggcaugcgccaccacacccggguaaauuuguauuuuuaguagagacgggguuucuccauguuggucaggcuggucuugaauucccgaccucaggugauccaccugccucagccucccaaagugcugggauuacaggcuugagccaccaugcccggccuaauauuuuuguauucuuaguagaaauggaguuucaccauguuggccagguuggucucgaacuccugaccucaggugaucuuuccaccucggccucccaaagugcugggguuacaggagugacccaccacaccuggccaauaguucauuaaaaaaaaaaaguuauuauuuugcauugggcuggaaaagagccugggaucugggauauaacuagaaucugauucuuguaggugcagaccuucauccagggcaauuugguggaaugcaguggagcucuucuugcuccagggcugucccaccugugucugcagcucuauuucugccuggggaacugauguuauauaucucuguuucuuggcuugcagcaaguagcaucucugauuggagcugauccucgugagaucauuuuuacuaguggugcuacugaauccaacaacauagcaauuaagguaagagaagggaaccagaggguguaugugggcuuuccugaccuaggagauagugucccuccaucauuuggacucguauauguauuucgcagccauccauccccaccccauugugaagagaaggcuugcagucuuucugauuuguugcuuccuuuaacccuuugcagucuacucuuucuuaagucuuugcugcuguuggucugaguugagugaggcaguuggauagcaaaggagguggcccucaggccauuaaccacuuguuuuuuuuuugucuggcaguuacuucagagaguggauaauggugauugaaccuuuucuccauucuucuuuuuuuuuuugauacauagucucacucugucgccaggcuggagugcaguggcgcaaucucagcucacugcaaacuccaccucccagguucaagugauucuccugccucagccuccagaguagcugggaguacaggugcccgccaccaugcccaacuaauuuuuauauuuuuaguagagaugggguuucaccauauuggccaggaugaucucaaucucuugaccugaugauccucccaucucgaccucccaaagugcugggauuacaggugugagccaccguacccggccuuucuccauucuuuuuaucuaguaacaacaaguuauauaugugauuucagggcuguccuccucucagccuuccuuuuucuuucugaucagaucuauuugcaacaaguuccuccuguuucuuuagauaucuccauuuugaagugcuugucuuuguggugcccucugcaggcauucacauggucacccauucugggaucagucauuuuguccuggguacauagaagaucuuuggugcuaaugcaaggaaaagguacuuuuaguagucacguugguguuucauagaacauagucagauuucacugggccugguugccaggauuaugugaguaaaugccaaggcucugagaaauuguggcuugcuguacuuugaacucuggcuccacuugcucucaucuuugucuuugaacugugcugccaguguugguuucuuugaccuuggccugaauauaggaggccuaggacgggcuucagggucaucagcacucugccugaucauguuaacaggaaggcauccuuccuugggacugcagagaccagagagucggggugaagguuccuccaaagguggagaugguuucugaaauggagagcauuuucaaaacuucgaaaauauuuucuuuggaagucuccacagauuccaaaccaacaggucaaggaucgcuaagaguaccugugaugauguuucuuuuaaucuccaugauugguagaguaaaauaaucuauaaauuguuaaagaaaucuacaucauggguaacugagauaaaauaagguggguggguggugaaaugucauuuaaaugaaauuuuuauaaacaacuguaacauuuugaacuaucaucaccaucccacaaccauuuuuucuuuuuuuuuuuuuagacugagucucacucugucauccaggcuggagugcaguggcacgaucuugacucacugcaagcuccgccuccuggguucacgccauucuccugccucagccuccugaguagcugggacuacaggcgcccuccaccacacccggcuaauuuuuuguauuuuuaguagagacaggguuucacuguguuagccagaauggucucgaucuccugaccucgugauccgcccuccucggccucccaaagugccccacaaccauuuuuacuuacugauguaaauacuuuuuaggauaaaauagaguauaaaucaauuauaaauguuucucauuuauguucuuuguccucaugaacagaccauuuuuacauaguuauaauuuuguccuauaugguuuaauauucugcuuuuauuuuauuuauguguuuauuuuuuauaagacagggucucagccgggcccaguggcuuacaccuguaaucccagcacuuugggaggcugagaccggcagaucaucugagaucaggaguucgagaccagccugaccaacaugguaaaaccccgucucuacuaaaaaugcaaaaacuaccugggugugguggcacaccccuguaguccuagcuacuuggaaggcugaggcaggagaaucaguugaacccaggaggcagagguugcaguugcagugggccgagauugcgccauugcacuguagcaacaagggcgaaacucugucucaaaaaaaaaaaaaaaaaagacauggucucauucugucaccuaggcuggggugcaguugcacaaucacagcucacuggagccuugaacuccuggacucaagcaauccucucaucuuagccucccaaguagcuaggcuuacaggcguguacuagcacgccugucuaauuuuguuauuuuaauuuauuuauuuauuuuuuuuugagauggagccuggcucugucgcccaggcuggagugcaguggcgugaucucagcucacugcaagcucugccuccuggguucacgccauucuccugccucagccuccugaguagguaggacuacaggcucccaccaccacgccuggcuaauuuuucuauuuuuaguagagaugggguuucaccauguuagccaagauggucucgaucuccugaccuugugauccgccugccuuggccaaccgaagugcugguuuuacaggugugaaccaccgcgcccggccuguuauuuuaauuuuuguagagaugcggcucucauuauguugcccaggcuggucuugaacuccugggcucaugugauccuccugccuuugccucccaaaguucugggauuacuggcuugagccacugcaccuggcuuuuuauucugcuguuaaagguaauagucuuuuauaagcucuggggagagaugcacauuuucuuuccaaguuuuuaauuuuugaaaaauaauucugucacauaugguguguuuuuuuaaaaccaauggaaagauuuaaaaugaaguguaggccgggugcagugggucaagccugugaucuuagcacauugggaggccgaggcaggcagguugucugagcucaggaguucgagaccauccugggcaaaauggugaaacaccaucucuacuaaaaaauacaaaaaauuagcugggugugguggcuguagucccagcuacucgggaggcugagacaagagaauugcuugaacucgggaggcagagguugcagugggccgagaccacaccacugcacuccagccugggugacagaaugagaccgucucaaaaaauaaauaaacaaaaauaaaauaaaaugaaguguaaaucuuccucuccuuccccaaggaccccagucccugauccuguucugcaaaguugauacuguuaauucuuuuuuuuuuucccaagggggagucuugcugugucacccaggcuggagugcagugccguaaucuuggcuuacuacaacuucugccuccaggguucaagcgauucuccugccucaucuuccugaguagcugggauuacaggagccugcuaccacacccagcuaauuuuuguauuuuuaguagagacgggguuucgccauguugacuaggcuggucucaaacuucugaccucaggugauccaccugccucagucucccaaagugcugggauuacaggugugaaccacugcuccuggcccauuuuuuuuucuuuuuucuguuuuuugagacagagucuugaucucaccuaggcuggagugcaguagccagaucucagcucacugcagccuugaccuccuuggcucaggugauccuccugaguagcugggacuacagauguguaccaccacgccaggcuaauuuuuuuuuuuuuuuuuuuuuuuuuuuuuuuaguauagaugauguugcucaggcuggucuugaacuccugagcucaagcgauccuccugccuuagucucccaaaguggugggauuauaggcauuagccaccaccacauccagcccccuuuuuuuuuuuuaauuaauuaauuuauuuauuuauuuugagauggagucucacccugucgcccaggcuagaguguaggggcaugaucucggcucacugcaaccucugccucccagguucaagcgauucuccugccucauccuccugaguagccgggauuacaggugcgugccaccacaccucgcuaauuuuuguauuuuuauuuuuauuuauuuauuuauuuuuugagacagaguuuugcucuuguugcccaggcugaagugcaauggcgugaccucggcucacugcagccuccaacuccuggguucaagcgauucuccugccucagccuccagaguaucugggauuacaggcauguacuaccacgccuggcuaauuuuuguauuuuuuuuaguagagacggaguuuuuccauguuggucaggcuggucuugaacucccgaccuuaggugacccucccuucucggccucccaaaguguuggaauuacaggugugagccaccgcgccuggccauuuuuguauuuuuaguagagaugggguuccaccauguucgucaggcuggucucaaacuccugaccucgugauccaccugccugagccucccaaaguggagggauuacaggcaugagccacugcaccuggcguucuuuuuuuuuuuuuuuuuuuuuuuuuuugagaugcagucucgcucuguugcccaggcuggagugcaauagcacucuuggcucacugcaaccucugccuccugauuucaagugauuccccucccucagccuccugaguaguugggauuacaggugcgugccaccgggccuggcuuauuuuuuaauuuuuaguagagaugggguuuccccauguuggccaggcuggucucaaacuccugaccuuagaugauccaccugccucggccucccaaagugcucggauuacagucgugaggcacugcaccuggccgcuuuuuuuuuuucuucaaugagauaaauguuuuuuuuaguuucuuguaauaguugaaauuccaggaauuuuuaaauguaccuuuauuguuucuugugauauuaacaguaauaccuacucaugacuuguuuacuguuauaucacuggcaccuagaaaauuacuugggauacuggaggugcuaaauauugguuaaaugaaugaaucauaaauuccaauaauauagaguagaacucuaaacacauuuucacugcuaauuugcuguauauuucuccagauuuuuaaauaccuacauuaaucuguauacuauuauuauuuuaauagauuuuauuuuuuauagcaguuuuagguucacagcaaaauugaaaggaagguauagaaauuuccuauauaugcccugcccccagguaugcacagccuucugccauuauuagcauccuccaucaagugguacauuuguugcaauugaugaccugauauugauacaucauuaucacccaaaguccauagcuuauauuaggauucacugguguuguacauucuauggguuuggacaaaugugauuuauucuagugaauuauugaacuugaccgggcuucgggaagcccugaauuuguauuugacugggcagaaguauggguagcuugagaccccugggacuuaugucugguaucugaacuaggggcagucuuguacgauugagcccuuaacccaugggguuuucacuaagucuggagaguuagccucagaauugaauuauaggauacucaguugguaugagagaacugguguuggagcauacuguucuugcccacuuuuccuuuacaaaugagauugaagucauugcugucucucugaguauguucuccuuccaucugucaccaccaauuucuaggggguggcccgauucuacaggucacggaaaaagcacuugaucaccacccagacagaacacaaaugugucuuggacuccugccguucacuggaagcugagggcuuucaggucaccuaccucccagugcagaagagugggaucauugaccuaaagguaggaguggcuauuggcaggaggagcaaaaauggaggagccuggcuucagcuuguaaauuucucucuugggcccuagcuggagcuugaaggaauagaucuaacaguuaggaugaaguuuagagaaauaagccuggcagagaacgagaucauguuccccuugaguguguacuguccuccuuuucucuggaggacuuguuucuuuuucuuuuuuuugagauggagucucacucuuuugcccaggcuagagugcaguggcuugaucucagcucucugcaaccucuggaggacuuguuacuucuuuuuuuuauuuugagacagaguuuggcucuuauaacucaggcuggaaugcaguggcgcgaucucggcucacugcaaccuccgccuccuggguucuaaugauucuccugccucacccucccgaguagcugggauuacagacgcaugccaccaggcccaguuaauuuuuuuuuuuuuuuuuuuugaggcagagucucauucugucaccuaggcaggagugcaguggcacuccacugcaaccuccaccucccggguucaagugauucuccugccucagccuccugaguagcugggacuacaggcacgugccaccacaccuggcuaauuuuuuuuuuuuuuuuuuuuaaaacagagucucgcuguauugccaggcuggagugcaguggcgcgaucuuggcucacugcaaccucugccucccggguucaagcgacuccccugccucggccucccaaguagcugggauuacaggcaugcaccaccacgccuugcuaguguuuuuuuguauuuuaguagagacgggguuucaccauguuagccaggauggucucuaucuccugaccucgugauccacccacuucggccucccaaagugcugggauuacaggcgugagccaccgugcccggccacacuuggcuaauuuuuuauauuuuuaguagagaugggguuucaccauauuggccaggcuggucucgaacuccugaccucgugauccaccugccucggccucccaaagugcugggauuacaggcaugagccgccaugccuggcucuaauuuuuguauuuuuaguagagacagaguuucaccauguuggucaggcuggucuugaccuuuugaccucaggugauccacccaucucggacucccagagugcugggauuacaggcaugagccacuguaccuggccuggaggacauguuucuugcauuuguugguguuuucugguuuguaugggagccacuggccacaugugcaggaugccagggacucacauucaccauggcaaagcucuggccuccuccuucccugcacugaugcuucucauccugcuaaagaaguagugucauuuucuugaaucuuauccaccagauuuuggauaucagcauuccuagacaaauccuaacaugcuguuuguagauggaccccucaauccaaacuccaaaguguucucaucauucauuauuuccucucuuuuucaucuuauuuacauucagucaucaaucaguaacauuuauaucuauggccauuuccuuauaaugucucuggaauuauacuuuucccucccucacucccaccuucccuucuucccucccugccucccuuccuuccuuucucccucuuuucccucccucccucuuuuccucccucccucucucucucucucccucugucuuucuuuuuuuggagacagggucuugcugaguuguccaggcuggagugcagugguauggucauagcucacuguggccucagacuucugggcucauagcucacugcggccucagacuccugggcucaccucaccuggcuaaauuuuuauuuuuguuuuguuuuuugagauggaauauugccuugucucccaggcuggaaugcaguggcacgaucuuggcucacugaaaccacugcuuccuggguucaaacgauucucccaccuuagccuaccgagcagcaaggacuacaggcauacaccaccacacccagauaauuuuuuuguauuuuuaguagagaaaggguuuuaucaucuuggccaggcuggucucaaacuccugaccucaaaugauccacccgucuuggccccccaaagugcugggauuauaggcaagagccacugcagcuggccuggcuaaauuuuuuuuuuuucuugagauggaguuucacucuugucacccaggcuggagugcaauggcacgaucuuggcucguugcaaccucugccucccggguucaagugauucuccugccucagccucucaaguagccgagauuacaggcaugugccaccaccacgcccagcuaauuuuuuuguauuauuaguagagucaggguuucaccauguuggccaggcuagucucuaacuccuuacuuauggugaucugcccacccuggccucccaaagugcugagauuauagacgugagccacugugccuggccagccugcuaaauuuuuaaacauuuuuuauagaggcaacaucucaguacauucuccaggcugguggugaacuccuggacucaagugauccuccuaccuuggccucccaaagcacugggauuacagaugugagccaccuuucucggccuccucucauuucuuuguuuggauuguauccugcaucuuagcugccucuggacuuuaaucucuguugccugaacuaguccuuuuguaggguccagccccacagggucgguggguuuucuccccaugugcagagacgagagagcguagaaauaaagacacaagacagagauaaaagaaaagacagcugggcccaggggaccacuaccaccaaggcacggagacugguaguggccccgaaugccagccugcgcugauauuuauuggauacaagacaaaggggcaggguaaggagugugagccaucucuaaugauagguaaggucacgugggucacguguccauuggacagggggcccuucccugccuggcagccaaggcagagagagagagagagagagagaggagagagagagagacagcuuacgccauuauuucugcuuaucagagacuuuuaguacuuucacuaauuugcuacugcuaacgaaaaggcagagccagguguacaggauggaacaugaagacagacuaggagugugaccacugaagcacagcaucacagggagacgguuaggccuccagauaacugcgggcaggccugaugucaggcccuccacaagagguggaggaguagagucuucucuaaacucccccggggaaagggggauucccuuuccuggucugcuaaguaguggguguuuuuccuugacacugacgcuaccgcuagaccauggucugcuuggcaaagggcgucuucccagaugcuggcguuaccgcuagaccaaggagcccucugguggcccuguccacgcauaacagaaggcucgccucuugucuucuggucacuucucacuauguccccucagcuccuaucucuguauggccugguuuuuccuagguuaugauuguagagcgaggauuauuauaauauuagaauaaagaguaaucacuacaaacuaaugauuaaugauauucauauauaaucauaucuaagaucuauaucuaguauaacuauucuuauuuuauauauuuuauuauacuggaacagcucgugcccuuggucucuugccucggcaccuggguggcuugcugcccacaccuuuagcaacaaccuuccaguguguccugcacauccucaucagacuuuauuucuaaaguacuuauuuggccuuuucucacuuuacucaaaaaucuugagagauuucccauuuccuuugacaugaauuauaacuucauuuugccugauauucagaguucuuuacauggugccuuuuuaagcacuuagaaauuucugauguaauucacauaccauaacauucaucuuuugaaauuauacaauucacuggcuuuuaauguauucacaguuuccaacaaucaucacugucauauuccaggacauuuucaucacuucauaaaagaaagcuauguauuuuucuuuugucauuugcacuuuuuuuuuuuuuuuuuuuugagauggaguuucgcucuuauugcccaggcuggagugcaauggcaugcucucugcucaccacaaccuccgccucccggguucaagcgauuuuccugccucagccuucugaguagcuguaaucccagcacuuugggaggcggaucaccugaggucgggaguuggaggccgaggugaccaguucaucugaggucagaaguucaagaccagccuggccaacauggugaaaccccgucucuacuaaaaaauacaaaaauuagccgggugugguugagggcgccuguaaucccagcuacuugggagggugaggcagcagaauugcuugaacccaggaggcggagguugcagugagccgagaucgugccauugcacucuagccugggugacaaaagcaagacuccaucucaaaaaaaaaauaaagaaagaauucauuuugaaauccaaggucauggaguuuuaccccuguguuucuuuuuuuuuuuuuuuugcggggggguacugaauuucgcucuuguugcccaggcuggagugcaguggcgcgaucucagcucaucgcaaccuccgccucccggguucaagcaauucuccugacuuagccuccucaguagcugggauuauaggcaugcgcuaccacaccuggcuaauuuuguauuuuuaguagagaugggguuucaccauguuggucaggcuggucucaagugccugaccucaggugauccgccugucucggccucucaaaaugcugggauuacaggcgugagccacugcgcccggcugcuauauauauauauauaaaauauuuuauauauauaauauauaauuuuuuuuuaugagacauggucuugcucuguugcccaggcuggagugcagugacaugaccucggcucacugcagucuccgccuucuaaguucaagcgauucuugugccuaugcauccuaagcagcuagaacuagagaugugugccaccacaccuggcuauauauuuauuuaugaaugagagaggaacuugcucuggaaccaccaaggcuuacagcagccuugaccuccuaggcucaaaugauccucccaccucagccuccuuccugaguagcuggaacuauaggcgcaggcuaugaugcccagcuaauuuuuuucuuuuuucuuuuuguagagacagggucucccuuggccaggugcuguggcucaugccuauaaucccagcacuuugggggccaagguggguggaucaccugaagucaggaguucgagacuagccuggccaacaugguaaaaccccgucucuacuaaaaauacaaaaauuagccgggugugguggugucugcccauaaucucggcuacucaggaggcugagguaggagaaccacuugaaccugggaggcggagguugcagugagugagaccccgccacugcacuccaccuugggaaacagagcaagacuccaucugaagaaaaaagagacagggucucccuauguugcaaggcuggucucaaacuccuuggcucaagcuguccucugaccucagccucccaaagugcuaggauuguagguaugagccaccauccccagcuauauuuauuuauuuuuuauuuauuuuuuauugagaugggagucuugcucugucacacaggcuggagugcaguggugugaacuuggcucauugcaaccucugccaccuggguucaaaugauucuccugccucagccuccuaaguagcuuggauuacaggugucugccaccaugcuccacugauuuuuguauuuuuaguagagacaggguuucaccauguuggcugggcugguccaaacuccugaccucaaaugauccaccuauuucagccuuccaaagugcugggauuccaggcgugagccaccaugcccggcccuuauuuuauuuuauuuuauuuuauuuuauuuuauuuuauuuuauuuuauuuuauuuauuugagauggagucuugcucugucucccaggcuggagugcaguggcgcgaucucugcucacugcaaccuccgccucccagguucacgccauucuccugccucagccccuuccccaaguagcuggaacuauaggcgcccgccaccacgccuggcuaauuuuuuguauuuuuagagaugggguuucacuguguuaggcaguauggucucgcucuccugaccuugugauccgcccgccucggccucccaaagugcugggauuacaggcgugagucaccacacacagccuauuuuauuuuugagacagaguuuugcucuggucgccccagcuggagugcaauggcacaguguuggcucacugcaaccucugccucccgaggucaagcaauucuccuaccucagccucccgaguagcugggauuacaggcaccugccgccaugcccagguauuuuuguauuuuuaguagagcagugcuuucaccauguuggccaggcuggucucgaacuccugaccucaggugaucugccgaagugcugggauuacaggcgugagccaccauacccaggugugagccaccauacccagcaauuucuuucuuucuuuuuuuuuuuuuuuuuuuuuugagauggagucucacucuguugcccaggcuggagugcauggagugcaguggugcaaucucggcucacugcaaccucugccucccagguucaagcgauucuccugccucagccucccuaguagcuugggacuacagggcgcgugccaccaugccuggcuaauguuuuguauuuuuaguagagacaagguuucaccauguuagccaggauggucucgaucucuugacuuugugauacgcccgccucagccucccaaagugcuuggauuacaggugugagccaccgugccuggccuuuuuuuaaauuuuuuugagacggagucucacucuguugcccaggcuggagugcaguggcuugaucucagcucacugcaaccucugccccccggguucaagcgauucuccugccucagccucucaaguagcugggauuacaggugccugccacugcgcccggcuaauuuuuguauuuuuaguagagacgggguuucaccaucuuggccaggcuggucuugaacuucugaccuucugauccacccgccuccgccucccaaaguccugggauuacauucgugagccaccacacccggcuggcaguuucuuuaauuuugucauuucauacugucauguggauggaaucauacaguauguaaccuucugggauuggcuuuuuuauuuuuguuuuuguuuuuuuguuuuguuuuguuuuguuuuuugagauggaaucuuguucuguugcccaggcuggagugcaguggugugaucuccgcucacugcaagcuccgccucccagguucacgccauuccccugccucagucucccaaguagcugggacuaccggugccugccaccacacccagcuaauuuuuuguauuuuuaguagagacaggguuucacuguguuagccaggauggucuugaucuccugaccuugcgauccgccugccucagccucccaaagugcugggauuacaggcgugagccaccauaccuggccuuucuuuuuuuuuuuuugaggcagagucucacucugucacccaggcuggauugcaguggugcaaucucagcuuacugcaaccuggauuuaagcauuucuccugccucaaccuccgaaguggcuggggcuacaggugugugccaccaggcccagcuaauuuuuguauuuuuaguagagacaggguuucuccuuguucgccaggcuggucucgaacuuccgaucucaggacacccaccaaccucagccucccaaagugcugggauuacaggcgugagccauugcgcccggccuuuauuggcuuuuuucacuaaucauaagucuuugggaauucauucacugcugcgugugccaguaguuuguuccuuuugauugauaaguaguaguccauguuauggauguacgaaaaucgucuguugaaggaaucuggguaguuucuagguuuuugguauuacgaauaaaguuauugugaacauuuguguaagauguuuugugaauuuaauuuucauuucucugggauaaaugcccaaguguacaguuacuggguucuaugguaauuucauguuuaguuugaugagaaacagaaacugucaaacuguuuuccaaaguggcugugauauuuacauucccacuaacaauguaugaaccauucagagucugugcauccucaccaacauuuuguguugucacuguuuuuaguuaacuauucagauagguauguaguauaagacuccuuuucaugacuaaguuugccuauauucugauuuaggaggacuuuguuuguacuaucuagucaccuuacuccugcauaucccuaggaacuagaggcugcuauccagccagauacuagccuggugucagucaugacugugaacaaugagauuggagugaagcagccuauugcagaaauaggugaguaucauggcuuaucccugaucccugcccaccauggggcucuguaugagguaguauacugagagcuguaauacucuauggaguguaguuaggaaaucaagggaaagccuaaguacuuuguucaaggacauuggaagugucauaggcaguauuugaauccaggucuauuaccauuuuuuuuuucauugagacagaguaucacucugucaccuaggcuggagugcaguggugugaucucagcucccugcaaccuccucacucuggguucaaaugauccuaccgccucagccucuugaguagcugggacuacagguguguaccacuaugccuggcuaauuuuuguauuuuuaguagagaugagguuuugccauguuggccaggcuggucuugaacuccuaaccucaggugauccgucugccuuggccucccaaagugcugggauuacaggcgugagccacugcucccggccaggucuagcaccuuuuaugguuuuuaauuuuauugcaguugcugccaaaaccaaccacaaaacaaaaaagccugcuacucuuuuuccuuuuagaacaucucuauucuccccacauagagaucgcccuguaauuucuuuaggcacauuagcacaaagaucuguuaaucuuguuuuuuuuuuuuuauuuuguuuuguuuguuuuuuaaucaaaagggaucuagaaaguaaucugacauuuugaaaggcugguguuaaugagguggugagaauuguaugcauaagaauaucacgaguguuucgaucuggugcuuugcccuucaucuuuuuuauucuaaagaagggaagcuacugagacacagagagggaggaagggggaagggggaggagggaaggaaaagaggaaggagaagggguagaaggagggaggggaggaguuuaauauuuacaggucauuuacuauuggagauaauucacagugcacugugggacucugacagaugacuuuccaacauugugcugugggucuuccccucuguuuccucagggcggauuugcaguuccagaaagguauauuuccauacugaugcagcccaggcuguuggaaaaaucccacuugaugucaaugacaugaaaauugaucucaugagcauuaguggucacaaaaucuacggucccaaagguaccagccccuucuagaguuccuucucucuguaccuuccagcaagaccuuugauagauguuugucacagucauuugggacuacuguugcucucagaggaaguuguacauucagagucccuuguagaaugcaaaugucauuuagcaauagccagaaacacuugcuuguuuguagaccuuagcaguuacuauacaucaggccauucuuucuugcucucuuuaacaaauccuuagcaagcauguagaucuuaauuugguugaggaaaaauggguuuugucaaaucaaauuuaucuagauaggcccagcuaucuuguuuuccccacuaugaugugcagagcaacuauuugagucccucauucccagugucuugcuauagcucaggggaagauugcaugggauuugacaucucuuuguguucuuuuuuuuuuucuugagacggagucucgcucagucgcccaggcuggagugcaguggcgccaucucgguucacugcaagcuccaccucccugguucacgccauucuucugccucagccugccgaguagcugggacuacaggcgccugccacuacgcccggcuaauuuuuuuguauuuuuaguagagacgggguuucaccauguuagccaggauggucuugaucuccugaccucgugauccgcccgucucggccucccaaagugcugggauuauagaugugagccaccaagcccagcuaucuuuguguuuauucuuagaagacuucauagucuguuauccuguuagucucucaaggauacauguuuguucccuaugguccuauuggaauguguucaagcuugaguuaugccucuuucccuuaacccuugggaauagacuguuguccucuguuuugugaagguaaccauaaaauauaaauauaaaauauaacuccucuuucucaagugagggccuuuuuuggguugaugucugugcugguacccuuuuuaugucugcaggguguguuaucuggguguauaccuuguggaaguagguguaauagcuucuggaauuauggaagauggcgucuucuaaggguucccagagguuguagaguguuuuuugugaguuauuauuucaaaaagcccaguaagcguucugucuuuuaauaaaauguugcuuuuauuggcuuuuauuguagauaagucuuuuugauaaaaaccaaugaacucaggcuggauaccccauucuucaucaugugccuauuucacauuauaugccuguauuaaaacaucucaugggcugggcacgguggcuuacaccuguaaucccagcacuuugggaagccaaggcgggcggaucacgaggucaggaguucaagaccagccugaucaacauggugaacccccgucucuacuaaaaauaaaaaaauuagccgggugugguggcaugugccuuuaaucccagcuacucaggagacugaggcaggagaaucguuugaacccaggagccagagguugcagugagccgagaucacaccacugccugggcgacaggcgagacucccucucaaaaacaaaaaaaaucucaugaacuccauaauauauauaccuccuguguacucacaaaaauuuuaaaaacaaaaaaccaaugaacucauugaucagaagcucugaucaacacuuacauguguacaggugucccucauuauccaaccuccugcuuuccaaguccagaaucuaaauagauuuagauaauguggcauucuucacuguucagacaugguauuugagcacuugcuguuugaauuugggaacuguuuagacucagauaguauaagauucuugaauuuuuuuaaauggagaaaugaaauaauucuuaauaaauacaguuuaauacauuauuuuauucauuuguuuuauagggacaaggucucacucuguugcucaggcuggagugcaguggugcuauccuaccuugccacagcuucaaucuccugggcucaagcaacccuccuaccccagccucaccaguaacuagcacuacaggugugcaccaacacgccuaauuuuuuuuuuugagacaaagucuuacucugacgcccaggcuggagugcaguggugugaucucggcucgcugcaaccucugccucccagguugaagggauucuccucucucauccuccugaguagcugggauuauaggcccacugugcccggccaugccuggcuaauuuuuuuuuuuuuuuuuuuugagacaaagucucgcucuugucccccaggcuggagugcaauggugagaucucggcucacugcaaccuccgccucccggguucaagcgauucuccugccucagccucccaaguagcugggauuacaggugccugccaccacgccuggcuaauuuuuguauuuuauuuuauuuuuugagacggagucucgcucugucacccagccuggaguacaguggcgugaucuuggcucacugcaagcuccgccuccaggguucacgacauucuccugccucagcgucccaagcagcugggacuacaggcgcuugccaccacgcccggcuaauuuuuuuuuuuuuguauuuuuguagagacgggguuucacuguguuagccaggaugguuuugaucuccugaccucaugaucugcccgccucggccucccaaggugcugggaauacaggugugagccaccacacccggccuaauuuuuguauuuuuaguagagacaggguuucacuauguuggccaggcuggucucgaacuccugaccucaggugauccacccacccuuggccucccaaagugccggaauuacaggcguaaucccgugcccggcccaaugccuggcuaauuuuuaaaacaguuuuuguagagauagagguuucacuauguuacucaggcuugaauuccugaccucaagcaacccucccgccucagucucccaaagugcugggauuacaggcaugacccacugcacccagcuuauuauuuaaaaucugguguccuucauaaucgauuuggaaaccacugccuuaauuuuuauaguaccuccauucucagcauaaacaguuuuucugugugggagaacugucaagugccaauucuauucagaagcccugauuacuuggugaauaacuuugcaugcucaugcucauauuuuggcacaaaauuucuguaauucggcuuguuuagucacagguuauacgcauuuuuaaguuuuuuguuuuuuugagucaaggucucagucuguugcccagccuggaguggagugaguggcacgaucauagcucacugcagccucgaccuccuaggcucaagugauccuccugccuuagccuccagaguagcugggacuauaagugcaugccaccaugcccagcuaaguuuuaauuuuuuuuuuuguagacacggggucucacuguguuucucaggcuggucccaaacuucuggucucaagugauucuccuuccuuggccucccagaaugcugggauuguagucaugagccaccgugcuccaccaaauuguuuuuaaauuuaaauuuuauuuugaaaaaguaauauucaugugauucaaaauucaaaagcuacaaaaaagugcacagacagccaggugcaguggcacacgccuguaauugcagcacuuugggaggccgaggcgggcagaucaugaggccaggaauuugagaccagccuguccaacauggugaaaccccgucuguacuaaaaauacaaaaauuagccaugcgugguggcgggugccuguaaucccagcuaaucaggaggcugaggcaggugaaucacuuuaaccgggaagguggagguugcggugagcugagaccgugccauugcacuccagucugggcaacagagcaagacucuugucucaaaaaaaaagggaaaaaaaaggcacagacaaaagucugccucucaccucugaccuccagcuaugcaguucccuucuggggagguaauuucuuucuugguuuuuuuuuuuuuuuuuuuuuuuuuuucugauuuucucugguuauugggaggcaauuucuuggguuuuucuacaauuauccuauguguuuacaaacaaauauauacuucuccuccagcuuucuuuuuuauccagaugauagcauacuguacucacuguuucaaucuuucauuuuucaccuaaugguacaucuuuuuuuuuuuagacagagucuugcucugucacuaggcuggagugcaguggcacaaucuuggcucacugcaaccuguggcucccaaguucaggcgauucuccugccucagccuccugaguagcugggauuacaggugcgugccaccacgcccagcuaauuuuuguauuuuuaauaauuacgggguuucaccauguuggucaggcuggucucgaacuccugauuucaugaucuguccgccucggcugcccaaagcacugggauuacaggugugagccaccguguccagcccauaauacauuuuuuuuuuuuagacggaguuuugcucuuguugcccaggcuggagugcaauggugccaucucagcucacugcaaccucugcuucccgaguucaagcaauucuucugccucagccucccuaguagcugggauuacaggcaugugccaccaugccuggcuaauuuuguauuuuuaguggagaagggguuucuccauguuggucaggcuggucucaaacucccgaacucaggugauccacccaccucagccucccaaagugcugguauuacaggcgugagccacugcgcccggccaauacaucuuuguuuuuucaagcuaaaguacagacuuuuuuuuggauuucaccaguuuuguaacaauguaucuuggagauuuuauggugucaguucagaacaagcuucuucuuuuuuuuuuuuuuuuuuuugggagacagagucuugcuccaucacucaggcuggagugcaguggcuugaucucagcucacugcaaccucuaccaccuggguucaucucaugucucagccuccugaguagcugggauuacaugugccugcuaccacgcuuggcuaaucuuuguauuuuuaguagagagaggguuucaccauguugaccaggcugguuucuaacuucugaucucaggugauccgcccgccuugaccucccacaguugggauuauaggcgugaaccaccacacccggcccccucauucuuuuauacaccugcuugguauuucauuguauggacaugccauaaucuauuugaccauuacccugaugauggacaucuaaguuguucccaguauuuuugcuauuaugaauaauacuguaauguaugauggcauuucauauagcauagggagcuacuuuaaaccauuuugaucauuacuccuucuggcauuuaucuuccagauguuaaauauuuuacuaaauacuaugcuuuuacugcuguuucuucuuuuccuuaacguuuuuuauuuagaaaaauuucaugcuuacagaaaaguugaaguaauauuuugaucccuuuggaaagaaauauuuuguuuuaucuacuuuucucucuuucuguuuuuuguaacaaauuuuguuucccagggguuggugccaucuacauccgucgccggccccgugugcguguggaggcccugcagaguggaggggggcaggagcgggguaugcggucugggacagugcccacacccuuagugguggggcugggggcugcgugugagguggcacagcaagagauggagguauggggagagcaguucccucccacaacuucuuccccugugcugggucuccuauuuagaggcuucucagcaugacugaggcagaucucugcagggagagagggcuuaagaaaacucuuccuuguccuggugcugcuggcaccuuguucugagggagacauuaugggcuucaaaacccauggccuuuuaguaguuaucagcucauuuauuucuggauaaguaaaugaacccuguguccaguuaucaagcgccuuuugcauaccaggcacuaugcucaguacuggagauacagugguccccaugaguacauaggaugauagguggggcugauacauagucacuuccaguuauaggagaagggcuucucaaacugucuuucugagcugguuaaugguuacugccuaauccuuccuugccugcuccuuaguaugaccacaagcgaaucucaaaguugucagagcggcugauacagaauauaaugaagagccuuccagauguggugaugaauggggacccuaagcaccauuaucccgguauggacuugcucuuucuauccucauucugguagaggcugagacucugagaccucucucacaguauuucuuuccuccaggcuguaucaaccucuccuuugcauauguggaaggggaaagucugcugauggcacugaaggacguugccuuauccucagggaggugagcuggacggcauagacagggccugcggcagggccacuuagaagagucauacaggcuauuaaacuucccaguguggagaugauaggcacaagaccucuugauuaaggguaaaggucauuuuguaagugccucucuuuuuuugguuggcuggguagcuggguacagacugaaguuuaccacccuaggaagacuuccugggguagaauuuugugccuuuuaucgucccaggggauguaugugucuguuguggguuacacuagcaguucuguuacaggccucuagaauugaagaugcuccaaaggccacuaaguguuuggcugcccuucaggcuggugcagauggugcauuacguccuggggaagugagcacaugguccucugcugcgucuucuugucaaacccaugugguaucaugcucugucacacuuugccagcguccuugcuuaaggaagucauccaccaugggggccagaggagcuagguucacacauccuaggaugugcaggggagcaucagguccuuuaguucugccagauuagaaggucucuuguuuucuccaggguaugacuccagggcccugggggaugggaacaagacugaggguuugugacuaaaaguagacguugaugaugaacugaacaagguucgugucucucuccucagugccugcaccucugcaucccuggagcccucuuaugugcuuagagcaauuggcacugaugaggauuuagcgcacucuucuaucaggucagugaguugagcugcaacauuuaugaaaggcauccucuuauauuuuucaucuccuguuacaguuuuuuucuuuuuccacccugaaguuuuucucagucgaguucuccuuaucucuucucauaaccuugugaaaguuucuagagcagugguucucagacuucauugaguaucaccugggaaguuugugaaauaugauaucugagucccacauucagauauucugauucacuagguccggaggaggaguagaaaacaucucaggugauuuuaauguuggugguccguagaucauguucuuuuuuuuuuuucugagacagagucuuacucugucgcccaggcuggagugcaguggcaugaucucagcucacugaagccucugacuugcagguucaagcaauucuccugccucagccuccugaguagcugggauuacagacaugugccaccaggcccagcuaauuuuuauauuuuuaguagagacgggguuucaccauguuggccaggcuggucucgaacucccaaccucaugugaucuguccaccuuggccucccaaacuguuggaauuacaggcgugagccaccaugcccggccgauccauauaccauguucugagaaacucugccuaaaggggaaggaccauguucuucucuccauaucuuuugugucguagauccuuagugaguauuugcggaaugaauuuaucccagugccagagcucugauggggagccauucuccugugccuuuuuucagguuuggaauuggccgcuucacuacagaggaggaaguggacuacacaguggagaaaugcauucagcaugugaagcgucuucgagaaaugagguauacauauuguaucagagacgcuuuggaagaaacucuagcacugucuccccucuuguccuuaggcuauguguuuacacugccaaaaccaaaguucaagcguacuuggaucuuaggauuuagagauuccacaaagcaagaaaguagaucuucuuggcuacuugucuucacaaugagaaaguguuuuuaaaaacuaaagaacuaggccgggcaggguggcccaugccuguaauccuagcacuuugggaagccgaggcggacagaucaccugaggucagaaguucgagaccagccugaccaacauggagaaaccccgucucuacuaaaauacaaaaaaauuagccgggagugguggcgcaucccuauaaucccagcuacuugggagacugaggcaggagaaucacuucaaccugggagggggagguugcguugagccaagauuguaccauugcauugcagccugagcaacaagagccaaacuccgucccaaaaaaaaaagccgggcacaguggcucacaccuguaaucccagcacucugggaggcugagguggguggaucacaaggucaggagaucgagaccauccuggcuaacacguugaaaccccgucucuccuaaaaauacaaaaaaauuagcugggcgugguggcgggcaccuguagucccagcuacucgggaggugaggcaggagaauggcgugaaccugggagguggagcuugcagugagccgagaucacaccacugcacuccagccugggugacagagugagacuccgucucaagaaaacaaaaacaaaaacaaaaacaacaaacuaaagaacuagaugaaugcagguaaugcagguaguaguuuuuuuuuuuuuuuuggagacaaguucuugcucuguuauucaggcuggagugcaguggcacaaucacaccucacugcaacuugugccucccaagcucaagugauccucccaccucagccucccaaguagcugguacuacaggcaugugccacuaugccugguuaguuuuuguauuuuuuguagagacggaguuuugcuauguugcccaggcuggucucaaacucccgggcucaagcaguccuccugucuuggccucccaaagugcugggauuacaggcacaagccaccgcaccuggcccagguaguauuguucauuaugauuauuauuaucuuuagagaaagugucucauucugucacccaggcuggagugcaguggcacaguuguaguucacuguaacuuuggacucuugggcucaaguuauccuccugcuucagacucccaaguagcuaggacuacagcugugugcccccacaccuagcuaauuuuaaaaauauauuuucuguggcugggcacgguggcucacgccuguaaucccagcacuucgggaggccgaggugagcggaucaugaggucaggagaucaagaccauccuggcuaacacaaugaaaccccgucucuacuaagaauacaaaaaaauuagccuggcauggugggcaccuguagucccaguuacuugggaggcugaggcaggagaauggcgugaacccaggaggcagagcuugcagugagcugagaucgcaccacugcucuccagccugggcgacagagcaagacucugucucaaucaaucaaucaauguguuuauaaagguaaugagauccuuggccagucagcuggcaccagggcuuccccuaguagccacagagcucaucuuccuccuggaaccuugaggccucuagauuuuuucagagccuggcucugucuugguuaaccuugacuuucaggauucucuugaucuaguugguagagagaggaauuucagguauauacucugcuucccuuuaugagcucucccaggccuuucuguguucuggauuuuucuuuguagggucuagcuguauugcuuaagugucuauagcuugcucaacugcaggacccuuccuuuguccucacuuucugguauucugugguauacucacaaggcauuucuacugaccacguggccagcaaagccuuuuguuuccuaucuauguggcuucggcaucugcacccuauuccuucugacccuuuacaaacugaaugcagccugguccuauuagcucucagagucuuauuuugugagccuauaauaauaaguggucuucccuaaagaggaaggacaggaaggagauggcuaacuuuaagggccauggaaaaucucaugaauagaaaggcauucugggaauguuuaguauauagaagagggacaagucaagaauauaaugaaauuugauaaaauuaccuggugaaaucuaaacuguaaaaucccauauucauagcacacugaaguaauaucuggucugggaacauuauccaagauauccaagcuucugcuuggggaucgaucagagcuuagcagagauuucuuagcagcagcucuugugugagaugggaugcucaggucuaagauccaaggaauucuuuuggauuagacccagggauauuggaagcacaggccaacucuggggagaugaaacgggcaagaacuggguaaggguacagcauaccaagaugauguaggguuaaguuccaccccuaacugggaacuagaacaaaaccaagaaacaaaugcugaaaagcggguaauauguggugggcugaaacgagcugcuuauacaugucauaugaagagaggcuuaaacuagauguuuauacaagucucaagggucuugguuccuccaagggaaaccauggccauagccucuuaccagugggaugaaagcuucaagaauaugaccauguuugguguccauuggcucagggccccacugcaauugagccugaggaaccuaguuauuccuguuagcaguuggggagagcucucaggagagcugacaaggacuuacagggagcuggagagcucaggauaccuuaaccaccuguguuagggucuaccagggcaagaggcagaggacagacagggacagaaggaggcaagccauugcucagagccuuggggccaauguugucgacuuccuaucuaagcccucacucauuuaaugccucuucucuuuggcagcccucucugggagaugguucaggauggcauugaccucaagagcaucaaguggacccaacacuagaagaauagggcccugacuuugugcuggucuggccccuccugccucaccaacccgugcacaaccagacaccuuguuacaccuaguggaugcucuagauugguauagaccaguugacuucagcaucaguccaccucuaugacagaaacacaagaaaacugucuuucccuagcuucaguuccuuggguguggagcacuccccauuucuucucgggucuuaaaguguguggacauuuucaucccgaagccauagagacauuugcugucauauugcugcugggcacaucugugcucuuggugaggagagcaagaggaaccagaagaagucucuuuggucagggaccaugaugcucuacauggacauuugagucuucgucuucugcugcugcucggcuggaccagcuucuuuaacagcaagcauaauccacuucaauguaauauuuucuguagcuccaaaggcuaucucuucauauugacugcagacagacugaauggacaguuucuuagagggcuugucuccuuucuacccuuguccucuuuccuuuccuuugaccuaauggagcuagaaauaugucugugacuccaccaguuauucuaauaauuuguuuucuugaaaauuguuaauuucaagacuggagaaauaaacucaccuucuauuuacucugugacuuuaugagagguugagggaaaaguggaagcuguacuugggaauuguggagaagaccgccacuccaucugauuugcauaaaugacucagugggcuuuuguaucucuucauuuaagaauuauuugaaugccugccaggagccagauuuguucuggguauuaggaauacacugguuaacaggaccaaaaaagacccugcccucacugaguuuuaaauuuuaguggagagauggaaaauaauuaaacaaauaaacaauguuauagauuguga

SEQ ID NO: 191260 - RNA, 178366 nt, Homo sapiens
gggggucacguggugcagagcacgcagaguccuucugucgguugguccuggagcggcgcagccggaguggggccgugaggugagcucgcggccaggcgaagccggccggccgggccggguugggccgggcccgcgcugcgcgcgcgccgugcgggcggggacggcgacggacgccaccgcugcuucgguccccugcccggccccgcuccccgccuggccccgcucgcccagccuggagggaggcccugggacugcugcugagagcguggcgggcgugcgagcggugcccaauccccggggcuacccgcaagaguggcggcggcugccgccaaucagcgccgcccgagggggcugggccguggggugcgggcccggggcgcggagcgggccguguugggggugcggguaagcccuagggcccgagccugagcugugugggcaccuagagccucaucagcagccucugcuauugccuugcgcuuugggaauauguuuuuuaaaauuggcuuuuuuuauccuauucuggggagcacauuccuuucucaagaccccaaauaugggagugucccuuuucucuauaguuuugaaaacugggcggcacacccccuuucuuaagcucuagcucuggaauuuuaucuaaauuucuaaaagcccucccccccccaaauuuagggcguacccucuuccgucagcccccaaagugggagcacauuccuuuuuucgggccuccaauuugauucugcauuuccguuccaauuuagagguucacccuguuaucggguccucagaucugggguccauuagcuaaaguuuugggauacuuucuuguauccccucuacuccaaggaagaauuccccuuuuccaggucccaaaucugacagcaugccuucuggaauuucuuacauuuaggggccacuuccuuuccucagcccuucaaaccugagguugggccgaaaacaauguccaaauuuugaaguuuauggguacuuauuuccaguuucacaaauaagggaauucacugccuucucccgagacuguauuauugggguuacacacuuuucacguguuccccaaaucaaacuaccuuauuuccugaaggagacucauuuucauaucugggaguauauuuguuucuugugccccccaaauguacgaggugaaccccuuuuaguuauacaacucucagagugcagccacuuuccagaugcuucuuaaauuuggggggcacaccuuuuugugaguccucucauuuccagguggcgaguggucugugguuuugagcaugccuuccuacccuguuuagcuuuucugucauccaagacauuuucauuccucaguuuccuucccuuuuuggagccacacuccccuugaggugcuuuccccagucuggucagugcacccauuuccucuuccucuggcgagugcguaucuuuguucagcacggcacuuuucucugugcuucugcgggcuuuucuucugagcacacuucccagagucacaccuccugaauucuccucuccucccagggaaggauuccucuccuaaagggcuaccagcacauuguuuuugauaggccuaucuuuuaucuuuccgcuagcaggaucucuucucucuuggcuugcccaauccccaaacauuuuucugguuucugucuuucuuuggaauuguucuguuuaccuaguggcuauaaagauuuuccuugugcuggagguggccucaagucuaggacugccugggcccccagcgcuggauucaaaguggaaaccauuucuuugguuaaucacaggacucugaauccuccuggugguuuacuucuagaagaccuaagauucuguuuaggugcauacuguuuucuccuuugcuuuaucuccuugugcuggaaaacaaaaacaaacaaaacucucagauuuuuccagcacugcuucuagcccauaaacuucuucccuauauuggcuuucuuacuaucuuuuaugaagaaaagaugucguuuggaggaaucccuuggauacucuuuuuguucuugucccuggggugucgguggggaaauggauauuuuucucucccaaucauccucuugucaaucuucuuuuuuuuuuuuugagacagagucucgcucugucgcccaggcuggagugcaguggcgcgaucucggcucagugcaagcuccgccucccggguucacgacauucuccugccucagccucccgagcagcugggacuacaggcacccaccacaccgcgcccgucuaauuuuuuuguuuuuaguagagacgggguuucacuguggucucgaucuccugaccucgugauccacccgccuccgccucccaaagugcugggauuacaggcgugagccaccaagcccggccaaccucuugucaaucuuuacccccaauccucacauuaaaaucugcaaauaucugggaccuccuaucucuuaagagccucaauaguucuuucuuuuguguuuccuucugccuuuacagaucuuauucagggcuucucagccugaacccccaaccagauuaauuucuccacagcuggaauuccaagugcuuggggauaaugauaccucugaccuuucuuccuuuugggaaguacuugagugugcagcugcaugaggccucagcaggagagagauuuuagguccaagaagcuauaccaguaggacaaggcaggaaaauacuacacuuucaggaucaagccccucugacucucauuuggaaacuggauguuugcuaagcaccugcuucuuaaggaugccgagggauuuaaugauacucccagaaaccuggagagauuaauggggccuauggagaagugcucugaacucaguguugggacuugaauaaaauuaaccauugucauguuuucagaacaacuaagcuguuuuauauuucaugugcaugaaagcccuagaacuaaguuguguuauuuccagaaaugaaauagaucccacaguuagaugauguggccauuaggaaguaccaaauuuauaaaaaucacuggaggucugucugagcaguaccuaauaaaauauaguauacugaaagugaacagauacuuugucucuuucuuuggcugcuugauacuuuaucuguguacugccguacagugcacccuuaaaguauucuacaccagugcuucucaaacuugaaugugcauguaagucacccaggggucuuguugaaaugcugauucugauuugguagaucuaggaugggaccugaaugcauuucugauuugcaggugaugcugauguuacugaacuacacuuuuaguagugagguuucauacacgaagacaaaguuucucugugaaaauaggaagguggugguuagccuuauauuuuuuuauuuuaucuuuauccagacacacaucccuuaaaaguuuguacaaggccauaguccccuuuauuaguuauacucaauuaguuauucuagcacauagcuuuuuaaauauuggccaaaacuggcugggcacgguggcucaugcuuguaaucccagcacuuugggagcugaggcgggcagaucacgaggucaggaguucgagaccagucuggcuaacacagugaaacccugucucuacuaaaaauagaaaaauuaccugggugugguggcaggcaccuguaaucccagcuacaugggaggcugaggcagaauacuugcuugaacccgggaggcggagguugcagugagccaaaauugcaccacugcacuccagccugggccacagagugagacucugucuccaaaaaaaaaaaaaaaaaaaaggccaaaacuucuccaggaguuugguuucuguguguauauauauauauuuuggguggggacagggucucauucugucacccaagcuggagugcaguggugugaucacggcuuacugcagccucaaccuucugggcucaagcgauccuccccucagccucuugaguuucagggaccacuggcacgugccaccacaccuggcuaauuuuaaauuuuuuguagagaugagaucuugccauuuugcccagguuggucuugaacuucugggcucaagcaguccuccaccuuagcuucccaaaguguugggauuauaggugugagcugccaugccuggcuauugccaaauuuaaaugguuacauauuucuuacuugaaugugaacauaauuauugauauagaaucauucuaauaaauacugcauagccagcuugucugucugguuccucauccuaccaugaguagggagucugugauaccccaaaucagugggucacagguguuggaauuuccaaagaguccuucuugguuuucuggguucuggaaaugggccaggaaaagccaggauaaagcuauguuccccgaccucgaauggaagcuucuggcuuucucuaaaugggugcuccagaaagacaaaugcuggggagaagaugauauucuuugauggugaucaugcuuuaugaugaucuuucuccuuuuguacccacaugucuaaucuauucuaagucucaaguggguuuuuccuuuuuucaaaaaauuuuuuuggagacaaagacuaccucugaaaguguuuuuccuuucuaaguguguuggaucaucuguaccuauuucccuggcugucaccugucuggcccucuuccacgugauccuguugccagcccuaaucaggacaaaccugaaugacuagacuauuuugugucccuguccuccuccaaccccuauuccucacaugagugucagauccuauucaguaacggauuugaucuggauuuggcucuaguccuagcucuuccauuuacugugagaccucaggcaagucacuuaaugcuaugggccugcuucuccccauuuguaaaaugaggggcugaugaucugcaauguccacccuggcugaaucuuggucgcuaccuugcuuagaaaccccauugccugugguagcuuguugcagcagaucugauuucuuucaugugcucccuugggcagccugccaguuauucccuuguccaagucacuucugccauuaucuuuuuuucuagcugaggcagccagcuuguucucaacccaacuucagcguucuucuugcuuccaugucuucuuccaguuccaugcuguauuucauucagaacuaccugaaauccucaaagaagucuuccugaguucuccauucaauguuugugacuucucugccuuaccaagaaggagucuguaccuuauauaccccguauuuacuugucaguucucuuaucuaauguauacuuaaaaagggacuucauuuccuccauaccacagcuuuguuuuuugguuugaauuagcagggcagguggcaugaaauuuaaagaggaagcaagcagguuguuugccuuuggcugggauuuggggaaaguaugagauguaauguuuuuaguccccuuccccaagaucuccuguaucugugggaaucaguugccugguaugucuuccuggauuguaaaggugcuuaaacuuccuuucugaaguuugaaaguguauccuaagugcaaauaccauuugacaauuacucgugguugggugggugcaguggcuuacgccuguaaucccaacacuuugggaggccagagugggaggauugcuugaagccaggaguucaagaccagccugggcaacaaagugagauuccugucucuacucccccaccaaaaacaaaaaaguagucaggcaugguggugcgugcuuguagucccagcuccuugggaggcugacgagggaguucagagucugcagugagcuaggauuguaccacugcacuacagcugggugacagcacgagaccccauugcuuccaagugcucuucuaggaacacacagccacaaaacccagaacaaggaauuguuaaggauaaugauaagaaaucuguauuucaaauaacuuaacaaaugaauaaaaccaacaguucuuugagagcaccugauuauugucaaagacaguugcugagggggcuuggaagucaggacuuaaagguauauuuaaccucuggaguuuucuucuuucaucaucuuccuaagaaauaauagggaggauguuuacauuuuucuugauaaagucuuuuuauuaauuuuauuuauuuauuuauuuugagaaagggucuugcucuguugccuaggcuggaguguaguggcgcagucuuggcuuacugcaaccugugcauccugaauucaagcgauucuugugccucagccuccugaguagcugggauuauaggugcgcaccaccaugcccaacuaauuuuuuguaguuuuaguagagacaagguuucacuauguugguuaagcugggacauuuuucuugauaaacauucuuuaaaccaaaauguaugcuuagucaagauccuugauuggauuaugagccuagagaaaaggagggugaugucuuugucuaauccaucuuugccagugacugccccuuacaggcuauugacuauaggguaaccuaaugaaaauugagacaggcacuguggcucacgccuguaaucccagcacuuugggaggccaagucggauggaucaccugaagucaggaguucaagaccagccuggcuaacacacagugaaacuccgucucuacuaaaaauacaaaaaauuagucaggcgugguggcaggugccugucaucccagcuacuagggaggcugaggcaggagaauggcuugaacccgagaggcagagguugcagugagccgagauuacaccacugcgcuucagccugggcaacaagagugaaacugugucucaaaaaaaaaaaaaaaaaauugaacccuuaauuuguaauaaugcuuugacaacuuugcuagaucuugggcuagguccuaccuggaccuuccucucuuuugccaaauaauggaacuaaugagcuggcagaaauccuguacaauuuuagaagccuaauaugagugacuaaauguaaauaggacaguuuuaggaaagagugguggagccugaaucagugaacuuuggggaaggagcaagaggaggggcuugggauuuaaacaaaggguuuuuuuuuguuuuguuuuguuuuuuguuuuuuuuuugagguggagucucacuucguugcccaggcuagaguacaauggugcaaucucggcucacugcaaccucugccucccggauucaagugauucuccugcuucagccucccaaguagcugguacuacaggugugugccaccucacccugcuaaucuuuuauauuuuugguagagacuggcuuucaucauauuggccaggcuggucucgaacuccugaccucaugauccgccugccagggccucccaaagugcuagguuuacaggugugagccacugcgccuggccuaaaccaagguuuuuauucagugauaguuuauuccaugucaggaacauaauucucagauuuuaaaggcugacuuccagguaucuuagaaggauauuugggggucucuguccuaguagagaccugauuuucaagaggucucuuucucauauggaaaaaguccauagcugguggauugacauuccuuucuuucuuuuuuuuuuuuuguugaggcggagucucacucugucgcccagaagugcaguggugcaaccucggcacacugcaaccucugucuccuggguucaagcaauucuccugccucagccuccugaguagcugggauuacaggugcccgccaccaugccuggguaauuuuuuguauuuuuaguagagauggaguuucaccauguucgccaggcuagucuugaacuccugaccucaagugauccacccgccucggccucccaaacugcugggauuacaggcgugagccacugugcccggccaaugccuuucuugcuucuacaggugcacagguguugggauuucgagguuguggaaacuuggucuggaaaugugggcauuuuacaauaaugauaacuauagcuagcauuuuuggagcacugucuuaaaugucauugaauccuuacaucugaccuauuauccuguccuaacagaggaggaaacugagaugaguaauuuguccaaggucauuuggcuaauaagcagggccucgauuggaguccagguuucuuugccuccugucccagugcucuuacaucccucucucucuagcuaacgugcuuuuuccccuagaaauuugaguaagucauuuuaacuacaaaucaaacagguggcagccuggaaaccagcacugaggcacuuugccacccucaccccagauuucuuuuuuuuuuuuuuuuuuuuuugggacggagucucacauuguugcccaggcuggagugcaguggcacaaucucagcucacugcaagcuccgccucccggguuuacgccauucuccugccucagccuccugaguagcugggacuacagaugcccuccacgaugcccggcuaauuuuuuguauuuuuaguagagacagggguuucgccauguuagccaggauggucucgaucugcugaccucauaauccauccgccucggccucccaaagugcuaggauuacaggcaugagccaccaugccuggcucauucuuuuuucuuuuuuuucuuuucuuuuuuuuuuuuugagacagagucugacucugucucccaggcuggaaggcaguggcaugaucuuggcucacugcagccuccgccucccggguucaagugauucuccugccucagccuccugaguaccugggauuacaggcgaacaccaccacacccggcuaaucuuuuauauuuuuaguagagacgggguuucaccauguugcccaggcuggucuugaacuccugaucucagaugauccaccagccuuggccucccaaagugcugggauuacagacaugagccacuggugccuggcccuuuuuuuuuuuuuuuuuuuuuugagauggaguuucaccuuguagcccaggcuggagugcaauggcacgaucuuggcucacugcaaccuccgccucccgaguucaagugauucucuuaccucagccucccaaguagcugggauuacaggcaugugccaacacgccuggcuaauuuucuguuguuaguagagauggaguuuuaccauguuggucagucuggucucgaaccccugaccucaggugcuccacccaccucggccuaaagugcugggauuacaggcgugagcaagauuuuauucuuuuuuuuuuuucugagauggauucuugcucugucacccaggcugaagugcagugacacgaucuuggcucacugcaaccuccuucucugggguucaagugauucucaugccucagccuccugaguagcugggauuauaggccugcaccaccacauccggcuaauuuucauauuuuugauagagacggguuucaccguauuagccagguuggucuccgcccgccucagccucccaaagugcugggauuacaggcgugagccacugugccuggccuucauucuugaccaugcaaaacauccuuuaauuguagaagcccaguucucccaacucaagcugccuuucuacauuuuucuuucuucuucaauuuuuguuguuguuguugucguggucagauacacauaauauaaaauuugccauuuuaaccauuuuuaaguuauauagcuuacugguauuaaauaauguugugcaaccaucaccacucuccaucuccguaacuccucaaaauugaaacucugggccggguccaguggcucaugccuguaaucccagcacuucgggaggcugaggcagguagaucacuugaggucaggaguucgaggccagccuggccaucauggcaaaaccccaucucuacuaaaaauacaaaaauuagcugggcgugguagcacaugccugugaucccagccacuagggagccugaagcaggagaacuguuugaacgcgggggcggguggagguugcacugagccaggauugcugcacugcacuccagccuaggugacagagcgagacuccaucucaaaaaaaaaaaaaauuauaacucuguacccauuaaacacugacucccucuuucaugaaccuccucccagccccagcagcuaccauucuacuuucugucuccauguuuuugaauacuuuucugccuuuuuugaggcuccugggcaugacugguuuggguugcuugacugucccuugguuccauggaguauugaauucuguguaaugugcuuugaugaguaggaaauuggucgugcugugaccuauaugauaauuagacaugugcaacuuguaaaggcaagguaauuaaagaggccacuuuucuuuuucuuguuuuguuuuuuuuuucuuuuuuucuuuuuuuuuucuucucuuuuugagacauucucacucuguucuccaggcuggaaugcagugacaucaucucagagcugacugcaaccucugccuccuggauucaagcaauucuccugccucagccucccgaguagcuaggauuacaggcggaugccaccaugcccggcuaauuuuuguauuuuuggaagagauggguuuucaccauauucgccaagcuagucuugaacuccugaccucaagugauccacucuccucggccucccaaagugcuaggauuacaggccacugugccuggccaagaggucacuuuucauguccaggcugcaugguaugugguggugaggauguaggauuuggagguggaaugccugaguuugagugccuguauuugccacucucuuggggccaaauguaauuugggcauauggcuuaaaccucuugaaccuuucauuguguuaugcacauuggaggcagaacuuuccagccuagcaaguuacuuaaccuauaugagccuguuuccucacccaaguauuaucauaacugucugacaucagucauuggaaauaucaguaaauguuacccuuucccuccauuuccuaaucuguaaaggaaauuaaagaaaccugguuuggcugggcacaguggcucaugccuguaaucccagcacucugggaggccaaggcaggaggacugcuugaagccaggaguuugagaccaguccuggccacagagugaaaccucaucucuauaacacagaaaaaaaaaaaauuaguuuggcaugguggugcacgccuuguagucccagcuccuugggaagcugagguggaaggauugcuugaacccaggaguucaaggcugcagugagcuaugauccugccacuguacuccagugugggugacagugagagccuguguuuaaaaauaaaaaaaagaaaagaaaaagaaaacauaguuuauagaguuuuccuggcuugaagauuuaugaggaguugaguauauguuaccauuauuacuuuuguuuuauuccucucagaaaauguguguaaaauuccuccaugggcccuucagugggccuuguuaguuuguauuucauccauaacuuuaucaguaguguaugccaaagaaaaagacucuuacuuuuuuuuuuucuuuaugauggacucucacucuguugcucagguuggagugcaguggcacaaucacagcugucuugcagcuucaaccuccuggguucaagggauccuccugccucauccucgugaguaguugggacuacagguguaugccaccgcgcuuggcuaauuuuuuuuuuuuuuuuauuauuuauagagacgaggucuugcuauguugccuaggcugaucucaaacucuugggcucaagugauucuccugccucggccuuccaaaguacugggauuggccgggcauggugccucacuccuguaaucccagcauuuugggaggccgaggugggcggaucaccugaggucaggaguucgagaccagcuugaccaacauggagaaaccccaucucuacuaaaaauacaaaaaauuagccgggcaugguggcacaugccuguaaucucagcuacucuugggaggcugaggcaggagaaucgcuugaacccaggaggcggagguuguggugagccgagaucgugccauugcacucuagccugggcaacaagagugaaacuccgucuuaaaacaaaaccaaaccaaaguacugggauuauaggcaugagccacugucccgcccuuacguuuguuuguguguuuuuuuuuuuuuugagacaguguaucgcucugucccccaggcuggagugcaguggcacaaucucgguucacugcaaccuccaccuccaggguucaagcgauucuccugccuuaaccucccgacuagcugugacuacaggugccugccaccacgcccggcuaauuuuuguauuuuuaguagagaugggguuucaccauauuagccaggcuggucuugaacuccugaccuugugaucugccugccucggccucccaaaaugcugggauuacaggcgugagccacugcacccggccacauuuuuuuuccccucauuuucacacacacaaaacuaacaguaaucccuuaauauuuuuaauguugaaauaucccaaagacuuuuuuuuuuuuuuuuuuuuugagauggagucucacugugucucccaggcuggagugugguggcaugaucucugcuuacugcaaccucugccuuccgggcucaagagauucuccugccucagccugccaaguagcugggaauacaggcgugugccacuaugcccagcuaauuuuuauguuguuaacagagauggaguuucaccauguuggccaggcuggucuugaacuccugaccucaggugaucugcccaccucagcaucccaaaguauugggauuacaggcaugagccacugcacucagucccuuguuuuuaaaagcaauaaagguuagugggggccgggugcgguggcucacaccuguaauuccagcacuuugggaagcuuaggugggcagaucacuugagcugaggaguucgagacuagccucggcaauguggcaaaaccccgccucuauaaaaaauacaaaaaugaggaaggggugguggcacgugccuguagucccagcacugggggagcugagguggggaggaugguuugagccugggaggcaaagguugcagugagccaggaucaugccgcuucacuccaaccugggccacagaaacagacccugucuuaaaaaaaaaaaaagaggguaguggguuuuggaggaaggaggucuugcuucugaagucccagcucuucuaucuagccaggugacuuugggcaaguuguuuauuguuuauacuccuucguaaaauacugcugacuucucugcauuguugggaaugagauguuugucaaggauuuagcauguggugauaaaucaguaaauguugaauauuuccugguauuaauaauaaaggcuaggaauaaaaauucauacuuaaaggaaaauggacuuuuauuuauuuauuuauuuuugagacagaguuuugcucuugucacccaggcuggagugcaguggcacaaucuuggcucacugcaaccucugccuccuggguucaagcgauucuccugccuuagccucccgaguagguggugcuacgggcuccuaccaccaugccgggcuaauuuuuauauuuuuaguagagaugggguuucaccacguuggccaggcuggucucgaacuccugaccucaggugauccucccgccucagccucccaaugugcugggauuacuggugugagccaccacacccugccaagauaagggaauuaaugaauugucucauaaauaucuuagguauuuaaaacuccauaggcaugaaaaugucucucaaggcccuguugaguaaugauuucaucuccaaauuguuuuccuuuguaauauggugauauuucaauuaagaaauucuguaagaauaggccgggugugguggcucacgcuuguaaucccagcacuuugggaggcugagaccagccuggccaacacagugaaaucccgucucuacuaaaaauacaaaaaauuagcugggcaugguugcaggugccugucaucucagcuacuugggaggcugaggcaggagaaucgcuugaacccgggaggcggagguugcagugagcugagauugcaccacugcaccccagccugggcgacagagcgcaacuccaucucaaaaaaaaaaaaaacaaaaaaaaaaacaaaucuuguaaggauagcuggucagguguguuuaaaaaaagacuucccagcugggcgugguggcucacgccuguaaucccagcacuuugggaggccgaggcagguggaucacgaggucaggagaucgagaccauccuggucaacaugguaaaaccccgucucuacuaaaaauacaaaaaaaaauuaguugggugugguggcgugugccuguaaucgcagcuacucaggaggcugaggcaggagaaucgcuugaacuagagaguuggagguuccagugagccgagaucgcgccacugcauuccagccuggugacacagcgcgacuccgucucaauaaauaaauaaauaaauaagacuuccccuaggcugugagcaguggcucaugccugucaucccagcaguuugggaggccgaggcggguggaucacaaggccaggagaucgagacuaugcuggccaacauggugaaacccugucucuacuaaaauacaaaaaauuagcccaguuugguggugcacgccuguaguuucaacuacuugggaggcugaggcaggagaaucacuugaaccaaggagguggagguugcagugagccgagauugagccacugcacucuagcuuggcgacagagcuugacuccgucucaaaacucacuccagagcuauagacuauaucacucagagaguguagaguauugauagauuggagcccccagugccugaagaaauggauacagcuuuucuuaagccccagggauaaaacugugaucagucuucaguugcuucauuccgcaugcuuugccuuccucugcacgcaaggaguaauaauaguucccacguuuaccuguggauaacacucuucaaagaaccuccaugugauuaucuucuugaaucuauauacccauugagguggaugauauugaucucuuuccuguuuuuuuuuuuuuuuuuuggagacagggucucuugcucuguugcccaagcuggaguacgguggugcaaucauaguucacugcagccuugaaccccugggcucaagugauucuccagccucagccuccugaguagcuaggacgacaggugugugucacugugccuggcuaauuauuuauuuauuuauuuauuuauuuauuuauuuauuucagacagaguuucacucuuguugcccaggcugcagugcaaugaugugaucucggcucacugcaaccucugccucccagguucaagcgauucuccugccucagccucuugaguagcugggauuacagggaugcaccaccaugcccaguuaauuuuguauuuuuagucuagacgagguuucaccauguuggucaggcuggucucuaacucccgaucucaggugaucugcccgccuccaccucucaaagugcugggauuacaggcgugagccaccgcgcccagccuauuuuuuuauuuuuauuuuuacuuuuugagacagaguuucgcucugucucccuggcuggagugcaguggcacaaucucugcucacugcaaucuccgccuccuggguucaagcgauucuccugccucagccucccaaguagcugggauuacagggaagcaccaccaugccaguuaauuuuguauuuuuagucuagacgagguuucaccauguuggucaggcuggucucgcucugugcccaccucugccucucaaagugcugggauuacaggcaugagccaccgcgcccagccuauuuuuuuauuuuuauuuuuacuuuuugagacagaguuucgcucugucucccuggcuggaaugcaguggcgcaaucuuugcucacugcaaccuccgccuggguucaagugauucuccugccucagccucccugguagcugggauuacaggcccuuggcaccacacccggcuaauuucuguguuuuuaguagagucaggguuucaccauuuuggccaggcuggucuugaacuccuggccuuaagugauccaccugccuuggccucccaaagugcugggauuacaggugugagcuaccuagcgcagcucuauauuuuuauuuauuuguuuauuuauuuauuuuuugagacggagucuugcucuguugcccaggcuggagugcaguggcgcgaucucggcucacugcaagcuccgccucccagguucaugccauucuccugccucagccuccugaguagcugggacuacaggcgcccgccaccacgcccggcuaauuuuuuguguuuuuaguagagacaggguuuccucauguuagccaggauggucucgaucuccuaaccucgugauccacccuccucggccucccaaagugcugggauuacaggugugagccacugugccuggccuauuuuuuuuauuuuuuguagaguugagaucucacuauguugcccaggcuggcuucaaacuccuggccucacucaagugauccucucaccuuggccuuccaaaguacugggauuacaggugugagcaauugcaccuggccucuuuucuguuuuuauuuccauuuugccagugagaaggcugagguuaccucuuuuuuuuugagacguagucucgcucuguugcccaggcuggagugcaauggcaugaucucugcucacugcaaccuccaccucccauguucaagcguuucuccugccucagccuccugaguagcugggauuaccgguguacaccaccacgccuggcuaauuuuuguauuuuuacuagagaugggguuuugccauuuuagccaggguguucuugaacugacgucaggcgauccacccaccuuggccucccaaagugcugggauuacuggcgugagccaccacgccuggccagguuauaucauuuaacaaacauuugaccaccauguuaagggcacugcuuguuagaugcuggggaugccuaugaggaguuaauugccucuugggagagaucugcuuagauaggcaguuucagcauagagugaugaaugcuguggcccagaggguagguuagguugccaugggagaaugcaggugugaaggaaguccuucagggagguuccaauggcuaauccuggucaugaaggaccaggaagagaaagcagcuuguuuggccaggugcaguggcuuaugccuuuaaccccagcacuuugggaggcuuagugagggagggggcagaucaccuggucaggaguucgagaccacccuggccaacauggugaaacuagagacuagcccgucucuaguaaaaauacaaaaauuagccuggcaugguggcuugcuccuguaauuccagcuacuugggaggcugaggcaggagagucgcuugaaucugggagacagagguugcagugagccaagauugugccauugcacuccagccugggugacagugcaagacuccaucaaaaaaaaaaaaaaaacaaaagcagcuuguuuauacaaaggcccuggaggucggaacugcaggguguuuggauguggcaggaguaugggugguaagaacaguaauaacccuuuuuucuuuuucuuuuucuuuuuuugugacgcagucuugcucugucuuccaggcuggagugcaguggcgggaucucggcucacuguaaccuccaccugccggguucaagcaauucuccugccuuagccuccugaguagcuaggacuacaggcgugcaccaccaugccuggcuaauuuuuuauauuuuuaguggagacaggguuucaccaugucggcuaggcuggucucgaacuccugaccucaugauccgccugccugugccccacaaaguggugggauugcaggcgugagccauggcgcccagcccccgccccccccccccccuuuuuuuuuauacacaguuuuacucuuguuccccaguccggagugcaguggcucgaucucagcucacugcaaccuccgccucccggguucaggcaauucuccugccucagccuccugaguagcugggauuacaggcgucugccaccauccccagcugauuuuuuuuuguguuuaguagagauggguuuucaccacauuggccaggcuggucuugaauuucugaucucaggugauccgcccgccucugccuccuaaaaugcuagaauuacaugcaugagccaccaugcccagcaagaacaguaguaacccugcaagcuuauugugugccaggcucugcuaaauaacuuuuuuuuuuuugacggagucucgcucugucaucccggcuggagugcaauggugugaucccggcucacugcaaccucugccuuuuggguucaagcgauucuccuuccucagccuccccuguaggugggauuacaggcgcaugccaccacgccuggcuaauucuuguguuuuuaguagaggcgggauuucaccauguugacaaggcuggucucaaacuccugaccucaggugauccgccugccucagccucccaaagugcugggauuacaggugugagccaccgggccugaccugugcuaauaacuuuuaucuucacaacaccuauaugaugguuugaaguaggugcuggugauauccucauuuuacagauggggagccugaagcucagagaggaaaugacuugugcaaguuuaucuggaaagugguggggcugagguccaaacucaggcacucuuauuccagaguucuggcucauaaccgcugugucccacagccccucugcuaaagcuugccugcuucucuccuuuuaagcuccaaaagagaguuucuuuuggcuugguuauaauggcuaacucacuaauggcccaaaugcugcgcugaguaccuugaauaugguucuguaggggagccgcugaacuguuuuuuuuguuuguuuguuuuuguuuuuugagacagagccuugcucuguugcccaggcuggacugcaguggcgcgaucuuggcucacugcaaccuccaccuccuggguucgagcgauucuccugucucagccuccugaguagcuggaauuacaggcgugugccaccaugcccggcuaauuuuuguauuuuuaguagaggcgagguuucaccauguuggccaggcuggucuugaacuccugaccuugugauccaccugccucagccucccaaaguguugggauuacaggcgugagccaccgcguccggccugaacuguuuuaaaauagaagucuuaugaucauacuuacauuuuagaaauaucacuguagcagcagugaugaagauuggcaacaguguaauuaacuggagucagccuuaccucgguucaauuccuugucccaauaccugacuagccuugguauuugggaaacuuacuuugugaaccucaguuuucacauccauaaaaugggaauaauccucauuacaaaccuaagagguagacacuaaaugggcugauauaguuuuuauauauauguauauauauaccagaauaguaucuaucuaucuaucuaucuaucuaucuaucuaucuaucuaucuaucuaucuaucuaucuuagaauaguauauacauauauaucuuagaauaguguauauauauauauauauauauauaucuuagaauuguguguauauauguaucuuagaauaguauuugucauaaaauaaccacugagaagaugucaucucaugagacaguauugauuuggaucuggggaagguauagcuggaggauuggagcucugucaagagcugcuggaguaaucaagauuagaacugaugcagggcugaacugggcauccacuuggcaauggcugagacuuagaagcagguccuacaaaauguuguccgagugugggaggugagggaaggagaaggagguaagggaagugcccauguuucuaguuuggcacacuugccaaucuugagggcuuauuugauggggacaaaaggagaaggaacuuguaaggguaagaugauuagcucagugaaauugaguaauaugcgaaaggucauacagcagauacauuuuagggccaacccuggcacaggcccuuuccacugcuucugggaaaauccacugauuuaaucgacucauucucaguaguuuggaaugaguaaacucaacucauguuugcugucucuuugcauuuuaauuauggaaggcaaagcuugacucuugcagaaagcauuucaaguaucugggaagaaagugggugaaguuuugaggccuauuucuuucuucacucuucuuuuuuuuacgacagagucuugcucugucgccaggcuggagugcaguggcucgaucuuggcucauugcaaccuccaccuucugggcucaagcaauucuccugccucagccucuugaguaacugggauuacaggcaccugccaccacgcccggcuaauuuuuuguauuuuuaguagagacgggguuucaccauguuggccaggcuggucucaaacuacugaacucuggugauccgcccuccucgaccucccaaaguguugggauuacaggcgugagccaccgugccuggcuucuucccucuuuucauucuugccugcccuuccuuccuuccuuucuuuuucuuccuccuuaccucuucugccuuuccucccuccuucccuaccuugucaaguaaaagggacuaauucccuuucuucuagugugaccugggaagagguccuacuugaaccaauuugucacuucccuacgacuaaagauacgcucuuuaugcacuuuaguauauuggauacuguuuguuaauuuuuaauaauauugacuauaauucuuugugucugauguccuuuuugcuaguauaccaccauugccaucaccaguaccauuuagaguuugcuaugcuaagcacuugacauccauuagcucacuuauucuucacaacaacccuaggaaauuggggcuguugaucccaucuuauagcugggcaaacaggcucagugauuuuucuugucgucgcucagccaacaaugccuggagccagaauugguuagaaucugagucuaaaaccugucugugcacccaucccuaggcauucccuggccuuccuccacggcagaacuuuggcaaaagguccucuuggaggcuucuuccugggagacccagguaucacuggaccggcuaaaauuguuuaugcuuucuugggacagcagcaugggcugugggaagucucaaccuucuagguucaagcuguguguggggaaagcuccuuucugccggagauucuuugccuguaguaguugccuuugcuuagaagucacuuccuuuagaucuccuucuugucaccuaguucucugcuuagaccucaguuccucagagaguccuuucuuuuucuuuuuuuuuuuuuuugagacaagagucucgcucugucacccaggcuggagugcaguggcaugaucuuggcucacugcaaccuccaccuccuggguucaagcaauucuccugccucagccucccaaguaggugggacuacaggugcccaccacuaagccuggcuaauuuuuguauuuuuaguagagacgggguuucaccauauuggccaggcuggucucgaacuccugaccucaggugauccaccugccucggccucccaaagugcugggauuacaggcgugagccauugugccugucuugagaguccuuucuaacagccguaucuaaaauaguccuuuccaugucgcugguucacauuauuuuguuguuuuucccacaauuacuuaucucugucagaaaugaucuuuauaugcucgcauggcgcaguggcucaugccuguaaucgcagcacuuugggaggcugagguugguggaucacuggaggucaggaguucgagaccagccuggccaacauggcgaaacacugucucuacuaaaaauacaaaaauuagccaggcaugguggugcacgccuguaaucccagcuacuggggagggugaggcaggagaugcuugaaccugggaggcggagguugcagagagccgagauugcaccuugcacgcugggcugggcgacaagagcgggacucugucucaaaaaaaaaaaaaaaaaaaaaaggccaggcgcgguggcucacaccuguaauccccagcacuuugggaggcugagguggguggaucgccugaggucaggaguucgagaccagccugaccaauauggagaaaccccuucucugcuaaaaauacaaaaauuagccaggcgugguggcacauaccuguaauccuagcuaccaggaggcugaagcaggagaaucucuugaaccugggagauggagguugcagugagccgagaucgugccacugcacuccagccugggcaacaagagcaaaacucugucucaaaaaaaaaaaaaaaagaaaaaagaaaugacccuuauguaugugcuuaucuuguuucuuagcugccuuccccacuagagaacaggguccgggugccuuguccucccauugucuauuuccaguaccuggcacacagcaggcucucaaugaauauuucuugaaugaggggggcauaaagauuuaagcuggucuuucaccugaagugucccucaauuuaaagugguuguauugaguuaaaaggcacugucacccuuuaauggagguugaaucccagccuuguggugagcaccauuagauuaucccaaagccuguucuguaguuucuggugguuggcauuuuauuccuugagagucccagagacuuuuuuccucgaaaguuccagaguuuauuucccucuacuccugucccagagcugauucacugaaaggucuuguuccauacccaucuaucacuuuuaauucuuuguugucccucuuuucccugagcacaaagggauugcugagggcaagacuuccaguuaccauagcgacaguacucuuuugccucucccaaaauaaaacccagagucuuugucaguacauuaacuguaaaugugauaugaauucagaaaauaugggcgugguggcucacaccuguaaucucagcacuuugggaggcugaggugggcaaaucaccugaggucaugaguuugagaccagccuggccaacauggcaauacccugucucuacuaaaaauacaaaaauuagcugggugugguggugugcuccuguaaucccagcuacuugggaggcugaggcaggagaaucgcuugaacccgggaggaggagguugcagugagcugagauugcaccauugcacuguagccuggggacagagcgagacucugucuuaaaaaaaaaaaaaaaaggaagaaaaaucugcuaucauuuauugaguaccuacuuguuuuuuuuugagacgaaucucacucugaugccugggcuagagugcaguggugccaucuuggcuuacugcaaccuucauccccugguucaagcaauucuucugccucacccuccugaguagcugggauuauaggugugugccaugaugccuggcuaauuucuguauuuuuuuaguagagacaggguuucaccacauuggccaggcuggucucgaacuccugaccucaagugaucugcccacuuugcccucccaaaguguugggauuauaggugugagccacugcgcccagcugacuaccuacuuuguguuagauauuuuaauagggguuuugcagaccuuucucauuuaauucucauagcacccacgauaggggccauuauccccauaucauaagugaagaaacagagcucaacaauguagcuuguaaauaaacuugggguaagaaucugaacucaggagcuacuggacugagguucgauugcuggcucagcuccuuacuaugugaguguccuuaacuuucuuuuuccucaucuuuauaauggggauuaauauaguacuucugugauuuuuguaaggauuaaauugguuaauauauguaaguuuaauuauuauaaauuuuuuuuuugagacagucucacucugucgcccaggcuggagugcagucgugugaucucagcucacugcaaccuccaccugcaggguugaagugauuguucugccucagccuccugaguagcugggacuacaggugcgcaccaccaugcccagcuaauuuuuguauuuuuuaguggagacgggguuucacuauguuuaccuggguggucuugaucucuugaccucaugauccgcccgccuuggccucccaaagugcugggauugcaggcgugagccaccgcacccagacuauacauuuuuuuuuuaugcggguuuuguuaguuuggauaagguuauuuuacaucuacucucuguaaaguuaguuuauaucuuuaucauaguaguagcuuaauagcauucuuuauuuaauuuauuacauauuuguugaguuuauaauguaguccuacuguaaugaauuuugauuaaauauucucuuguuuuuuaauggaugaacuacauccaguuugcccagaaucuuauguaaagagcuauugguuuuucucauuuucacaaaugauuuauuuuuauccuggacuguauucuucagcuugaaauggcugaguccaagaguauaagcaguuccacagguuguucuuugcuucuagauuaagguauaaaaagauggccauggucaggaccccaggagguguucuaguguaccuguuuccccacagcuggaccaguguuagguuuugucuuuucuaaaaaauuagguauuucugcuuguuauauaauggugugauaauuuugacacaacauuugaaaagcauccaguugcuuuaucuuccuguauucaaguuauguuuauaucuaaagauaugaauauaagcauagcaacgacuuuggucagagaaagaggaaggaccuuugagaaguacuuugucuacuucugcguacauccuguuacuuuugauaagagggauuucuccugccucagaggaccuugaaauuggcuagcaccucugcaugucaguuuccucccuguaacuuaauuuuacuuguauaccaugguaacauuacauuaguccuaauuauauaaucuggcaguugugaagauccaguaaauaguaaaauaguguaagaauuaaauucuugcauuuaaaaaauuugcagguuuuuuuuuggauuuuuuguagagaugacauuucaccaaguugcccaggcuggucuugaacucuuagauucaagcuaccugccccuuggccucccaaaaugcugggauuacaggcaugggccuauacucagccucccaaagugcugggauuauaggcaugagccaguguaccuggccaaaaauuugcauauuuaaauaaccuuaaaagaaaaaaaugggccgggcgugguggcucaugccuguaaucccagcacuuugggaggccaaggugggugcaucauuugaggucaggaauucaagaccagccuggccaacauggugaaacucugucucuacuaaaaaugcaaaaauuagcugggcaguaguggcauaugccuguaaucacagcuacucaggagacugaggugggagaauugcuugagccuaggaggcggagguuacagugagcugagaucgugccacugcacuccagucugggcgacagagugagacccugucucaaaaaaaaaaaaaagaaaaaaauaugaagaaacauaaagaagcaaccccaccaccagaauaaaauaaaauuuuaucaucuagauaauuccugcugacaauuacuucuuuggugguuuuuuuuguuuguuuuuguuuuuuggcuuuuuuuuuuuuuugagauggaaucuugcucugucacccagacugguuugcaguggcacgaugucaacucacugcaaccuccgccuccuggguucaagugauucuccugccucagccuccugaguagcugggauuacagguucccaccaccaugcccggcuaauuuuuguauuuuuaguagagacgggguuucaccauguuggcuaggauugucucgaucucuugaccuugugauccucccaccucgaccucccaaagugcugggacuacaggcaugagccacugcgccuagccuggaauggguuguuuaauagauagcuuauuguccuucacauguauaauccuuuacauuauacacuugugaaaaauuuucauugugaaaaacuaaaauuuaggaaaguauuuaagaagaaaggaacaaucaccaauaaccuauaacuuauuuuuuucuuccugucuuuacaaaagaaucaguggcuggguaccauggcucaugccucuaauuccagcacuuugggaggcugagucaggaggaucacuugaaccugggaguuugagaccagcccagacaaacacauagcaagacccugucucuaccagauaacaaauuagcugggugugguggcuugcaccuguagucccaggugcuugggaggcugaguaaggaggaucacaugagcccaggaagucgaggcuacagugauccagguuugagccacuguagaccagccugagugacagagugagcaagaccuugucuccaaaaaaauaaauucauaugaguuuuuuucuuuucuuuucuuuucuuuuuuuuuugagacagaauuucacucuuguugcccaggcuagaauguaauggugcgaucuuggcucacuggaaccuccaccuccuggguucaagugauucuccugccucagccucccagguagcuggaauuacaggcaugugccaccaugccuggcuaauuuuguauuuuuaguagagacgggguuucugcauguugguuaggcuggucucaaacuccugaccucaggugauccggcagccucggccucccaaaguucugggauuauaggcaugagccaccaugccuggccuuuuuuuuuuguuuuuguuuuuuaaagagacagguucuugcucugucacucaggcuggaguacaguggcacaaucauaacucacugcagucucaaccuccugggcucaagcgauccuccugccucagccuuuucaguagcugggauuauaagccugagccaccucaucuggcuguguaugaguuuuaaugugagcuccaugugguacaauuuugcauccugccuuuuuauguaauauauugcaagcaaauucuucauaaaaugugcugcuauuaaacauuagacauguacucacuucugugauuuuuuuccauacucauuuauugcaaagaaaguguucugguaggaggcaggcauugcucuggcagugcucuggcauugcuugggcaguguaggcugucaagagccaaaguauaaggcuggaugcaguggcucgugcuuguaauccuguaaucccagcacuuugggaggcccaggcgggaggauugcuugaacccaggaguuugagaucagccuaggaacauagauacucucucugcaaaaaaaaaaaaaaaaaaaaaaaaaaaagcugggugugcugacgcaugccugugauuccagcuacucgggaggcugaggcaggaguauugcuugagcccaggagucugaggcugcagugagcuaugauagcgccacugcauuccagccuggacaacagaaugagacccugucuaaaaaaaauuuuaaaaaguccagaguuuagugggaggaaagaguuaggcugggguaagucugcuguaaggaaguggccuguucaagugcccuuagaguucagaguggcuacauguccaucagaaccaccacuagcuccuccgauagcauuuaggacccugcagauuaguagauuaauuaccucagugaucacaagaaguguucuuuuuuuuuuucuuuuucaagauggagucuugcucugucacccaggcuggagugcaguggcgugaucucggcucacugcaaccuccgccucccagguucaagcuauucuucugccucagccucccaaguagcugggauuacaggcgccugccgccgcgccccacuaauuuuguauuuuuaguagagaugggguuucaccauguuggccaggcuggucucaaacuccugaccuugugauccgccugccucggcuucccaaaguguugggauuacaggcuugagucaccgcacccggccggaaguguucuuuuaugggggccacuuuucuuguaaauggccuaauccaguacaccuuuuuuuuccaucaaaaggaaauuggcuuuacuguuugguucugaucauaaauauaaauuuuauucauugcagcacgaguacacgagacaggauugagaaaggagagauucaaauugugacuucagauucaaaggcaauuaaaggaauuaaacgugaauauuuuuacuguuuuauuguucuaugauuaaaaaaaaaucuggguaaaacuuauaggaaaauacaaaugaucagaauggacucaagaaguaggaaauauagcugggcaugguggcaggugccugcaaucccagcuacuugggaggcugaggcaggagaaucacuugaacccgagaagcagagguugcaguaagccgagaucaugccauugcacuccagccugggcgacaagagcgagacuccucaaaaaacaaaccaacaaacaaaaaaagaaguaggaaauauacauagaucaaagaaaguauaaacaauucugggcgcagugguucacgccuguaauaccagcacuuugggagguugaugugggcagaucacuugaggucagguguuugauaccagccuggccaacauggugaaacccaaucucuacucaaaauacaaaaauuagcugggugugguggcaugcgccuguagucccagcuacucaggaggccuaggcuccagaauugcuugaaccugggagguggaggauacggugagcugagauggcaccacugcacucagccuggguaaaagaguaugacucugucucaaaaaauaaauaaauaaacagaccucguacagccuuccaaaaguagcaccaaguauuaauaucucaacuuuuguuugcuucguuuuuaauuuuuuuuguuuuuaagagacgagcguuugcuauguuucucaggcuggucuugaacuccugggcucaaagaaacaacuuggcucugccuuccaaguagcuggggcuauaggcauacauuacugugccuggcauuuguuugcuuccuuuguaacucuuuaaauuucauugcaauuacaguuugcaguuauuuaucaguuugcuggcuaaauuuuuguguuuccccgguagacugaaggguucuugagggcaggagcugugucucuuuuggucuugauuguuuccuuaaauagucgcugagcaaauauuuguugaauaaugcaucagcagaugacugaauuuaacugugaaagcaguuguuuuuuuguaguucugagggguggcccuuggcccuuguaggugagugguaagcaguguugagggagggucuucuuaguuccagaaaccacaggaagcugcacgauggaggaauaggaaccaguggaagacacaccuguguuagaaugaggacaccaacaggguuucauggagcuuuguguuuugaauaaugccuguuuuuuuauguguagugaaugaugcuacacucuggguggacuuugccuaaguuucauaaauauuuaauuggcuuuuucaggagaauaaaggcagccccguugaugacugaaaaugacaaagcauccaccuaacagacgaggaaucagcuuugaagugggagcccaguuggaagcccgggaccguuuaaaaaacugguacuuuuacauuuuucuguuaauuaaagcccuucaguaaaggauuuuugccagcacugauagagugguagcuuaggcuuuuuuugugguguuuuucuacuuccugacucuuggaagaugugaggaaaugucagucuuuucucuuugaugcagggaucccagugucagggugacuguccuguaacccccuguauauauuuguuucccccuuuugccuguucaucugaaagaguucugggaaaaagaagcaggaauggcuacagggaagggaagaguuaauaguggcagcucucuugcuccuggcugccugucugaaaaaagaggaaagaucagggauggaauagugaagaaaaagggguucgauuggagcagcucauguguugugaacaccccauccuauuuucugggcaugaucuuguauguugaaauacagucaucauguaagggcacacugucagggugauuagguucagaagcugagggguuauagucccagcugugucauugacuugugaccucuggcugguaauuagcugcuuugugcauuggcuuaucuauaaauguggguauugguaauauugaccucauaggguuauucugagaaucaaaugauagaauauguaaggaaagaccuuauagacugugaagugauuguugugguugagggcauccuagaauuuggucauuuuuuggugcucaaggugagcgugggguuuucagaacuuauaccucuuuaaggguuuuuguuuuuuuuuuuuagacagagauucgcucugucacccaggcagaucuuggcucacugcaaccucugccucccagguucaagcaguucucgugccucagccuccugaguagcugguauugcagaugugugccaccaugccuggcuaauuccuuuuugagcuaaagaaggaagaguuuaacccuuuuugagauucuuucaaaauagauugaucagcucuucagguguaggaagauaagacaggagaagagaggcauagaagcagcugguacagaaaacugucuuugcuauuagaauuagguacacuuggcugggcgcgguggcucacgccuguaaucccagcacuuugggaggccgagguggguggaucaccugaggucuggaguucgagaccagccuggcuaaaguggcgaaaccccgucucuacuaaaaauacaaaaaauuagccgggcaugguggugcaugccuguaaucccagcuucucgggaggcugagccaggagaauugcuugaacccgggagguggagguugcagugagccgagauugcaccacugcacuccagccugggcaacagagugagacucggucugaaaaaaaaaaaaaaaaaagaauuagguacacuuggccaguugugguggcucacgccuauaaucccagcacuuugggaggcugaggugggcggaucacgaggucaggaguucaagaccagucuggccaacauaaugaaaccccgucuuuacuaaaaauauaaaaauuagccgggcaugauggugcacgcauguaguccuagcuacucaggaggcugaggcaggagaaucacuugaaccugggagguggaggcugcauugagccaagaucgcgccacugcacuccagccugggugacugagcgagacuccgucccggaaaaaaaaaaaaaagaaaaaagaaaaaauaauuagguaauuagguacauuuucaacacaguuguuuuugggcuauuuuuuuuuuuuggagacaagagucuugcucuuucauucaggcuggaguguaguggcgugaucucggcucacugcagucuuugccuccuagguucaagcaauuccucugccucagccuucugaguugcugagauuacaggcaugcaccacgaugcccggccaauuuuuuguauuuuuaguagagacaggguuucaccauguuggccaggcuggucuccaacuccugaccucagaugaucugccugccucggccucccaaagugcugggauuacaggcgugagccaccaagccugccuguuuuugggcuauuuguauuaucuauaauuaguuccuuuuuugguuucaguauauauauauguguguguguguguguguguauauauauaauauacugcguguguguauauauauuauauauuguauguauauauauuauauaaguaguaucauacaacuuguuuuuuuucugugucuuuguuuuuuauauucaauauguuuuugugauuuacccauacuuaacuccgcacccuccucgcccaccccugauauagggucuuacucuauugcucaggcuggaguguaauggcacaaucauaguucacuguggccuccaacuccugggcucaagugauccuccugccuuagcccuccauguaucugggacuacaucuuaacuucuguauagaguuuuauuguaugaauauaccacauuuuguuuaucuaguccccuacuaauggacguuuguuuguuuguuuauuuauuuaugauggagucuagcucugucacccaggcuggagugugguggcacaaucuuggcucauugcaacauccgccuccuggguucaagcaguucagccucagcugggauuacaggugcccaccuugccaagcuacuguauguuuuuuuuuuuuuuuuuuuuuugagacguagucuugcucagucgcccaggcuggagugcaguggcucgaucucuccucacugcaagcacugccuccuggguucacgccauucuccugccucagccucccgagcagcugggacuacaggcacccaccaccaugcccaacuaauuuuuuuguauuuuuuuaguagagacgggguuucacgguguuagccaggaugguugcgaucuccugaccucgugauccacccuccucggucucccaaagugcugggauuacaggcgugagccaccgcgcccagccuaauuuauguacuuuuaguagagaugggguuucgccauuuuggccaggcuggucucaaauuugugaccucaggugauccacccaccuuggccucccaaagugcugggauuacaggugugagccaccgcuccuggcccguuuauuuauuuauuauuuuuuauuguauuuuuuuuuaaaugggugcuuaaauuccaguuuuucaccugagacacagugcugugugaaugucucuuugugcacauacacagacuuuuacuugggcaguggcuuuugaccacaaccuacaguaagaaauguauuuuaaauccagugugguacucaaccauauguacauaaaaauuuauuuuuauuuuguuuuuauuauuauuuuuuugaaacgcugucgagacagcgucucacuuuguugccuaggcuguaaugcagggucgugaucuuggcucacugcaaucuccgccucccagguucaagcgauucucgugccucagccuccugaguaugugggauuauaggugugugccaccaugccuggcuauuuuuuuuuuauuucuaguagagccgguguuucaccauguuggccaggcuggucuugaacuccuggccucaggcgaucugcccaacucggccuccugagugcugggaccacaggccagauccauggcacccggccuauuuuuauuuuuccagacaaggucucauucuguugcucagguuggagugcaguggugggaacagagcucauugcagcuuugaccucccuuggcuuaagcaguccuccugcuucagcugggaccacaggcacaugccaccacgccugauuuuuuauuauuauuauuauuauuauuauuauuauuauuauuauuauuuugagauggagucuugcucugucgcccaggcuggagugcaguggcgcaaucucggcucacugcaagcuccgccucccggguucacgccauucuccugccuuagcuucccggcuaauuuuuuguaauuuuaguagagacgggguuucacuguguuagccaagauuuaccucgugaucugcccgccuuggcuucccaaagugcugggauuauaggugugagccacuaugcccagccacacgccugauuaauuuuuaaauuuuuaguagagaugaggucucacuauguugccaaggcugaucucgaauuccugggcucaggugauccuccugccuuggccucccaaaaugcugggguuacaggcauaagucaccauaccugaucuauauaaauuuaacugaaacacaaauuuuaugaaguaguauuuaaccuuaauacaugcauuauacucugguauuuuuuucaguucuuuuuuuuuucguuugggacagagucuugcucugucgcccagucuggagugcaguggcacaaucuuggcucacugcaaccuccaccuccuccuggguucaagcgauucuccugccucagccuccugaguaacugggauuacaggcgcccgccaccacacccagcuaauuuuuguauuuuuaguagagacaggguuucacuguguuggccaggauggucuggaacuccugaccuugugaucugcccuccucagcuucccaaagugcugggauuacaagcgugagccaccaugccuggcauuuuuuuuuuuuuuuuuuugauaugucucacucuguugccuaggcugggguguaguggugcaguuacaacucauugcagccuugacuuccaggcucaggugauccucucaccucagccuucugagcagaugggacuaccagcacauaccaucaugcuaggcuaauuuuuuguauuuuuaguggagaugagguuucacuauguuggccaagcuggucuugaacuccugaccucaaguguuucaccugccucggcuucccaaagugcugggauuacaagcgugagucaccaugccuggcacauauuuagguuuuuaauccaccuggaauucauuuuauguguaguaugaacuuguaucuaauuauuauuuuuuaauucaaugaauaaccaguugcuccaauaucauguuuagaauaguccauucuuucccuauugaccugcaauaccacuuguauguacuaagccucauauuuacauaggccuguucucagaucuuuagucuauuccauugauuuauguuuacuccugugcuuguaauaacacauuauuuaauugauauugcuuuaacauaacucuugauaucugguaagacagguuuuauuuuauuuguuguauucuuagaccuuuacucuuuuuuuuuuuuuuuuuuuuuugagacggaaucuugcucagucgcccaggcuggagugcaguggcacgaucuuggcucauugcaagcuccgccucccggguucacgccauucuccugccucagccucccggguagcugggacuacaggugccugccaccacgcccggcuaauuuuuuguauuuuuagcagagacggaguuucacuguguuagccaggauggucucgaucuccugaccuugugaucugcccgccuuggccucccaaagugcugggauuacaggcaugagccacugcacccggucaaccuuuacucuuuaaugugaauuuuuguaguauuguugagugucuugaaaaguguuuuuggaguuuugaaguaaauuguauuuaauugguaucuugauaaaaaguuuucauucaugaaaauacaucuuuauacuuauucauguuuuacuuuaugaacuuuagugauguuuuauaaccuccauaaagauuuugcauguuaucuguuagauuuauuccuaaguacugucuaguuuuuguugcuucuaugaauggaucuuuuuuuuuuuuuuuuuuuugagaugaagucuugcucugucacccaggcuaaagugcaguagagcgauuugggcucacugcaaccuccgccucccaggcucaagcaguucucccugccucagacucccgaguagcugggauuacagaugcccgccaccaugccuggaauuuuuguauguuuuaguagaggcgggguuuugccauuuuggccaggcuggucuugaacuccugaccucaggugaucugcucaccucggcuuccuaaagugcugggauaacaggcgugagccacugcaccuggccagaucuuuauauauauauuuuuucucuuugguuauugcuggcaugaaggaauauuguuaaccaaauucaguauguggauuuuauauaguuugaaaacaaaagcagacugcuuaaaaaagauuuaugacauuuaugagauuguuggaaguuugaacauugauugguuauuugauauuaaagaaucguuaacauuuuagauguggaagugauauuguaauuuuguuuuuuaagaguucuuauuucuuagagauuauauaccuacauuuaugaauaaaaugauacauugugauuugcuucaagauaauaugaagauucuguaauuauaugcaguaggaagaaaaaggagauaauaugaagggggaaaagggugggaagauagaggaagcaaaagcggccauguguaauggguacaugagucuuuauugcuauugagucuuguaucuggucuuacacagaaaccuuucuccauuuucauguucaucuuaaugguucuuuuggauuuucuacauagaccaucauguaucugcaaacaacuguuuugccucuuccuuuccaauccucugcuucucauuucuuuuccuuucuuccuuccuuacuuuuuuucuuuccuucccguuuucccuucuguguucauugacuaggaucauagcagcaagauguuaaaugacagugaugauagcagccuuccauaguuuguuguuugacuuuaacaggaacgcauccgagaguucaccauuaaguaugauguuuaucauaggaucauaguagauguguuuagucagauuaaagaaguucaugccuauuccuuguuugcuggaaguuuuuuuuuuuucagccugaguaauguugaauuuaaugcuuuugggcaucuaauuaacuggccaugcguauuuuccccuuuaaucuucauuuauuuauuuauuuuuauuuuuauuuuuugagacggagucucgcccugucucccaggcuggagugcaguggugcaucuuggcucacugcaagcucugacuccuggguucgugccauucuccugccucagccucccgaguagcugggacuacaggcgcccgccaccacgccuggcuaauuuuuucuauuuuuaguagagacggggcuucaccauguuggccaggauggucucgaucuccugaccucgugaucugcucgccucggccucccaacgugcugggauuacaggcgugagccaccgcaccuggccccaauuuuuuuuuuucuuaaccgugucuuuauggaaaagaggaaaacguuauggccaucuuguacaaauuucuaggaacaaauuuuaaacuuaacauuuggccagaugcaguggcucaugcccguaaucccagcacuuugggaggccaaggcggguggaucaugaagucaggaguucaagaccagcauggugaaaccccgucucuacuaaaaauacaaaauaaauuaguugggugugguggcacaugccuauaaucccagcuaccccugagucugaggcaagagaauugcuuaaaccugggagguggagguugcagugagccaacaucacgacgccauuguacuccagccugggcgacagagcaaagcucugucuuggaagaaaaaaaaaacaaaguuucaacuuaacauuuaaaagauauucugggccuggugugguggcucacaccuggaaucccagcauuuugggaggccaagccugguggaucaccugaggucagcaguuugagaccagccuggccaacauggugaaacccugucucuacuaaaaguacaaaaaucagucagacaugguggugugcgccuguaguccaagcuacuugggaggcugaggcaggagaaucguuugaaccugggaggcagagguugcagugagcugagauugugccacuacacuucagccugggugacagagcaagacuuugucucaaaaaaaaaaaaaaagauaauccagcugggcauggugacucaugccuguaaucccagcacuuugggagggugaggugggaggauugauugagucaaggauuucaagaccagccuggacaauauaaugagacccugucucaaaaaaaaaaaaaaaauucugggcauggugguacaugccugaagucccagcuacuugggaggcugaggcaggaggacugcuugagccuaggaguuugagguugcagugagcugcaauugugcugauagccgcagguggcagucaaaugccuaggcagauagggacaguucccuggugaaaccugacugucaaaccaaggacaguuuguuuguuuguuuauuuauuuuuugagacggaguuuugcucuugucgccuaggcuggagugcaguggcgcgaucucagcucacugcaaccuccgccuccugaguucaagcgauucuucugcuucagccucccaaguagcugggacuacaggcaggugccaccacacccagcuaauuuuuguauuucuaguagagaugggguuucauuauguuggccaggcuggucucaaacucgugaccucaggugaucugcccgccuccgccucccaaagugcugggauuauaggcaugagccacugugccuggccuccaaagacaguuuaaagccugaaagccaagcuacaaguccuggguaaauccacggacuggauugagaaccucucuuccaguucggcaagguuuccucugauugauccccacccuucaccuguuuuacauguauuuacucuucccugauugguuuuuuacacugucaugcccaccuuugagugacgccuuuguuuuagccuuuuuguuauaugcacaaaccaaucagcauacauuccccauucugaacccauaaaagcccugccacacugagagggagacuaccugucuucaagugggagaguacccucaugugggugcucuuaugagccucauuuuagcaguaagaaaaaggagucucagagagaugaaguuauuugcccaaggucacacagugguaggacuaggguuugaaucaaaguagacugaguucauagcauuuuuguaauaaccaaauuucuccagagugucugaauguuccugacuccuaaaucaaaaaacaaaacaaaacaaaacacuggaaaaugcauucugauuauguucaccugauuuccuaaucuagaguacuggacauuuaauuguuugguaaaaucuuugacuuugaaugcuuugccaaaaacaauggagcguuuguuuuauuaucucuagacugaaagugguuauguuuucacccugguaagugauuugcuuacauuauaguagauaguauugcugcaagguacaaccauauuuuuugugugugucugugucucucuguguguguauguguguauuuucaguccauugaaaugaaaugugugggaauuagguuccacuuuuuuuuuauuuucauuuuuuugagacagagucuugcucugucgccaggcuggagugcaguggcgugaucucggcucacugcaaccuccgccuccaggguucaagcgauucuccugccucagccucccgaguagcugggacuacaggugugcgucaccacgcccagcuaauuuuuguauuuuuaguagacaugggguuucacuauguuggccaagaugaucuugaucucuugaccucaugaucuguccaccucggccucccaaagugcucacauuacaggcgugagccaccacguugggcuagggcccacuuuuuaauugcuuauguccuugugacuucuugccucugaauccuugaauuauuuguucuuauuuuugggcccuaaagaaacuaagucccagcuuuuuuuuuuuuuugagauggaguuuugcuuuuguugccuaggcuggagugcaauggcacaaucucggcucacugcaaccucugccucccugguacaagcgauucuucugucucagucucccaagcagcucggauuacaugcaugcgccaccacgcucagcuaauuuuuuuuguauuuaguagggacaggguuucaccauguuaggcugguugagaacuccuggccucaggugauccaccugccuuggccucccaaagugcugggauuauaggcaugugccacugugcccggcccagucccugcuuuuuauuuauuuauuuauuuuuauuuuuuaauuuuuuugagacggagucucgcucugucucccaggcuggagugcaguggcucgaucucugcucacugcaagcucugccucccggguucccaccauucuccugccucagccucccgaguagcugggacuacaggcacccgccaccacgcccggcuaauuuuuuuguauuuuuuuaauagagacgggguuucaccguguuagccaggauggucucgaucuccugaccucgugauccacccgccucagccucccaaagugcugggauuacaggcaugagccacagcgcccggccccugcuuuuuauuaagaaaauuuucuaacauaaugaaaaguugagaggacauuauaccuuccaccuguauucacuaauuguuaacccauuuguuuuauauacuuauuuaauuuagcaauaauuuuauaauaucuaauauccagagauauucagauguucuuguuguuccaaaaaugucccuuauaguauuuuuccagacaggauccacauuacuuuuuuauuuuuaugucucuuuaguugcuuugauuccaugauaaucuuucuucuucccgggaggcagagcuugcagugagcagagaucgagccacugcacuccagccugggagacagagcgagacuccgucucaaaaaaauaaaaaaauuuuuccccuucacaacauuauuuguuuaauuuuuaagaguuccgaacaguuguuuuuuagaaugucccacauucugguuuagucacauuguuuuaucauggugaguuuaacuuguuucuuguauucucuucuauuucccguaaacuggaaaugaggucuagacuucagauuaaacauuuuuuuugcagaguguuucagugguaaugccguguguuucauauugcaucacaucgggggacacauaaagcuaggucgucccacuguuccguguaucacuuggauaagguaaugacuuccaucucucaccauuauaaagguguauuuuuccuugugcaaguaguagauaaucuguggggauacucugguacgugucaauauccuauuauccccccacaucauuuaccuaaugauuuagcauccauugauaaucccugccugaaucaguuauuacucuggagauggaaaaaugguaauauucuaguuuugucauucuguuauauuaggugauguucuucuguacgaacagcuuucauuuuuauuauuauuauuuuugauacagagucucccucugucgcccaggcuggagcacaguggugcgaucuuggcucacugcaagcucugccucucagguucacgccauucuccugccucggccucccgagagcugggacuacaggcgcccgccaccacgcccggcuaauuuuuuuuguauuuuuuaguagagacuggguuucacccuguuagccaggauggucucgaucuccuggccucgugaucugcccaucucggccucccaaagugcugggauuacaggcgcggugagccaccgcgcccggcccauuuuuauucuuuuaaagugcacuuaggaauaagauuauugaguguggugguguagucaauuccauucauuauuauuaauuuugugcuaaaauuaucccaaauuuguccagugggaugcuguuuaaacuagcuccuuuguucuuuugacaauuccuguuagucccuuagcauuuucuuguuuucuggcacuacuagaaaccccaaacuuacuuucuacuuuucuuaucccagacccuggacgcagcugguucuccaaggcuugguuucuuuaauuaggaaaggguauuuagaaauugaccucugagcugggcacgguggcucacgccuguaaucccagcacuuugggaggccuaggcagguggaucagaaggucaggaguuccagacaagccuggucaacauagugaaacccugucucuacgaaaaauacaaaaauuagccaggcgugguggcacgcacuuguagucucagcuacucaggaggcugaggcaggagaauuguuugagccugggagguggagguugcagugagccgagauagcgccauugcacuccagccugugugugagccaagaucacaccauugcacuccagccugugugugagccaagaucacaccauugcacuccagccugggugacagagugagacuccgucucagaaaaaaaaaaaaaaaaaaaaaaaaggaaauugaccucugagguugaggcugcaguuagcuaugaucacaccacugcuugggugauaagaauaagacucuaucucuaaauaaaauaaauaaauaaauaaauaaaauaaaacauugguuuuuaaaaaaagaaauuuagcucugggcacuggguguguuuauugcugcuaggaugucauugucuuaaacaacuuuuuaguagauggggguaagaaaucuauuuuuugaaaaaaugugaguucacuuugauacuuccaauuuauuuauuuauuuuuuugagauagucuuggucugucucccaggcuggagugcagugguacgaucucggcucacugcaaccucugccucccuaguucaagcaauucuccugccucagccucccaaguagcugggacuacaggcgcaugccaccaugccuggcuaauuuuguauuuuuaguagagaugggguuucacccucuuggccaggcuggucucgaacuccugaccucaagugauccgccugccuuggccucucacggugcugggauuacaggcgugaaccgcugcgcccggccuauaauauuaaauuuaaguuggaaauaucaggccuggguaacagaguaagacacugucucaaaaauaaauaaauaggccgggcgcgguggcucacgccuguaaucccagcacuuugggaggccgaggcagguggaucacgaggucaggagaucgagaccaucccggcuaaaacggugaaaccccgucucuacuaaaaauacaaaaaauuagccaggcguaguggcgggugccuguagucccagcuacuugggaggcugaggcaggagaauggcgugaacccgggaggcggagcuugcaaugagccgagaucccgccacugcacuccagccugggcgacagagcgagacuccgucucaaaaaaaaaaaaaaaaaauaaaauaaauaaauaaauaaauaggccaugcauaguagcucaagccuguauucccagcacuuugggaggcuaaggugggcggaucaccugaggucaggaguuugagaccaaacuggccaacaugaugaaaccccgucucuacuaaaaauacaaaaauuagccgggugugguggcaggugccuguaauuccagcuacucgggagguugaggcaggaaaauugcuugagccaaaggaggcagagguugcagugagcugagauugcgacacuggacuccauccugggugacagagggagacucugucccccgaaaaauuauaaauaaauaaguaaauaaauagaugaaacaaaaagaacuaacauagaauaugcaugguguaacuaugcuaaaugaaacucaaaauauggccagacacggugacucaugcuuguaaucugggcacuuugagaggcugaggugggcagaucacuugaggucaggaguuggagaccagccuggccauuaugacgaauccaugucucuacuuaaaauacaaaaaauuagcuggacauuguggcaugugccuguaauucuuuuauucuuuuuuuuuugaggcagagucuugcugugugucucccaggcuggaguguagcgcgagugaucucagcucacugcaaccuccaccucccugguucaggugauucuccugccucagucuccugaguagcugggacuacaggcgcaugccaccaugccuggcuaauuuuuuguauuuuuaguagaggcaggguuucacuguguuagccaggauggucucggucuccugaccucguguuccacccgccucagccucccaaagugcugggauuacaggcgucagccaccgcgccuggcaugccuguaauuccagcuacuugggaggccuagguaagaggaucaccugagcccagaaggcagaaguuguagugagccaagauugcaguugagacucugucucaaaaaaacaaacaaacaagcaaaaucguuuuggaaauacauauauauucccccuccagcuuuauugagauauaauugacaaaaggcauuuauauauuuguuuauuuuugagauggagacccgcucagucccccagacuagacugcaggggcuggaucucagcucacagcaaccuccaucuccgggguucaagugauucuccugccucagucuccugaguagcuggaacuacaggcacgcgccaccaugcccagccgauuuuuguauuuuuaguggaggugggguuuuaccacguuggccaggauggucucgaucucuugaccucgugauccacuuaccucagccucccaaaguucugggauuacaggcgugagccacugcacccggcccgaaaaucuuuguuccuaaucauacuuuaaccuacuugccuuauucuguguuauaugugaaauaguuuuaaaguuacaauaucaauauuacuauuaacaaguauacugagugaauuuuaaggauuuuuugacauuugaaaaauguauaucuuacucaggacaaauuauauuugauuuaugucauaaacuuuuuuuaaguuuuuuuuuuuuuugagacggaauuuugcuguugucauccaggcuggagugcaauggcgcaaucuccggucacugcaaccucugccuccgggguucaagcgauucuccagccucagccucccauguagcugggaauacaggugccugccaccacacccagcuaauuuuauuuuguaauuuuaguagaguucggguuucacuguguuggccagacuggucuugaacuccugaccuuaugauucgcccgccucagccuccgaaagugcuggaauuauaggcgugagccacugcgcccggccgauuuaugucauaaacuuaauccaaaauuaaaugaguuuuuuuuuuuucuucuucuuugagauggagucuugcucuguugcccaggcucgagugcaguggugcaauuucggcuuacugcaaccucugccuccuggguucuagcgauucucuugccucagccucgugaguagugggauuacaggcgugcaccacuacgccuggcuaauuuuuuguauuuuuaguagagacaugguuucaccauguuggucaggcuggucucgaacuccugaucucaugauccacccuccuuguccucccaaagugcugggauuacagacgugagccacugcgccuggccauaaguguuguuguuguuuuuuuuuaaucuguuaugugaacuaacaguucuuucuuuuuuuuuuaaauacuccuacagucuaauuuuauuuccgcauuuauuuauuuauuuauuugagacagagucucauucugucacccaggcuggagugcaauggcgugaucucagcucacugcaaucuccgccuccuggguucaagagauucucuugccucagccucccaaauaggagggauuacgggccccugccacggcgcccagcuaauuuuuguauuuuuaguaaagaugggguuucacuagguuggccaggcuagucuugaucucccgaccucaggugauccaccugccucggccucccaaagugcugggauuacaggcgugagccaccacgccagaccuauuucugcauuuaaauuauuuuuggggccaggcauggugucccacaccugcaaucccagcacuuugggaggccaaggugggcauauugcuuugagcucaggaguucaacgacagcugggggcaacauggcaaaaaccuguuucuacaaaaaauaaaaaaguuagcuggguguugguagcuccuggcuguagucccagcuacucaggagacaggcuagagaauccuuugagcccgggaagcggagguugcagugagcccagaucgugccacugcauuccauccugggugacagagugauacccugucucaaaaaaauuuaaaaaauaaaauuauuuuuuggccagguguuguggcuuaugccugugauccuagcauguuuagaggcugaaguaggcagaucacuugagcccaggaguucaagacaagccugggcaacaugacaaaaccccaucucuacaaaaaaauauaaaaauuauauuuuuauaauuaaaguauaaauuuaauuauaauuaaauuacaggcaugguggcucacaccuguaaucccagcacuuuaggaggccuaggugggcagauuacuugaguucaggaguucgagaccagccuggccaacauggugaaacuccgucucuacuaaaaguacaaaaaaaauuaggcgcaugccuguaauccuagcuacucaggaggcugaggugggaggcuugcuugaacccaggagguggagguuguagugagccgaaauugcgacacugcacuucagccugggugacagagcaagacuccgucucaaaaaacaaaacaaaacaaaacaaaacaaaaaauuagcugagguggaaggauugcuugagccugagagguugaggcugcagugagccaugauccuccuacuucagccuccugaguagcugggacuacaggcaugugccgccacccuuggcuaaguuuuguauuuuuuguagaggugggguuugccauguugcccaggcuggucuuaaacuucugggcucaagcagugcacccaccucauccucccaaagugcugggauuacaggugccuggccuagcauuuuugagacagaguuuugcucugucaccaaggcuggagugcaguggugugaucauaacuguagccugguacucuugggcucaagugauccucccaccucagccuccugaguaggcugggacuauaggugcaugccacugcaccuggcucauuuuuguauuuguuauagagacugagucucgcuguguugcuuaggcuggucucaaacuccagggcucaagugaucuuccuaccuuggccucccaaaguguugggauuacaggcaugagccacugcaccuggccuauauucuaauuuuuaaucuaccacuuuggggugaacuuucagcauguccauuuucuucucuguagaagggguaauccugccuucccuguuuuuguuuuguuuuguuuuguuuugagacagucuugcucugcugcccaggcuggagagcaguggcccuaucucgguucacugcagccuccaucuccuggguuccagcgauucuccugcuucagccuccuguguagcugggauuacaggcaugcaccaccacacccagcuaauuuuuguauuuuuaguagagacaugguuucaccauguugaacagccuggucucgaacuccugaccucaggugaucugcccgccucagccucccaaagugcugggauuacaggcgugaaccacugugcccagcccugccuucccuauuugcuuccugcguuuuauagaugaacuaaaaucugagaggcugcaguuuccuaguagugauacuugguggauagaauagaaucugcuugcucugcugccuucgccuucuuccugucaucugucaggagugugccaucuguuccaagaaguaggcuggccuucccuguucuugcuccaaacacaacgaaaaagcuccuucuguugcuuuccugacacucugguaccuuuccacuacuguguuucuauuuaaguugaucauaguucgcuuccauuucuuguacagaagauuuaaaaaucugaguuucauaauguccuuagaucauuuuugguuucuuuuucauuaggguuauuuguacugaucucaucugaguuucugguucauaccucuuuacuccuuacaccaucuguguguguguguguguguguguguguguuuuuaagcaaucuuuucugagcuuuccacaaacauguauugaaugcugugagucaggugguacacuaggugcuaugaaaugaaggaaaauaaguacuucaagauguucagagacgagucaaguauuuggcuuugguuuuuaguauugauagccaagggucguuaaucauguauucuaaugcuuaugucuuugcuagugacucacauuuauugagugauuuacucugugccaggcacaaaucuaaaggcuuuauauguuauaccuccuuuaauccuuuagaugcuaugaaggggguacuuuuauucuacuuuauauaugaggaaauagaagcagaaagcaguuaaguuuuccagugcuauguagcuguaaauggugaauuuaggauuugagucuagcuaguuggcuucugagcauggucggguguggcuuugauccccacgcauguguucaguaccuagaauaaagucccugaaauuaaauauauuaugaggagauauuuacucuguacaaaguucauuuacaaaaaccccuaggggagaauaguuaauuucauaugugggaauuucagaaggcuucagaaagaugacuuuugaugccaagucauucauucaaugcuagaugcuggagaaauaguggugauuaggacagacauagucccugaucuuuagaagcugacauuccaguggagguggauagaacagaaaccagcagacugauauauauagauaauguuagguggugauaaaugcuagaaaguggaauaaguacuuuuuuuuuuuuuuuuuuugugagauggagucucacucugccacccaggcuggagugcaguggcaugaucuuggcucacugcaagcuccgccucccagguucacaccauucuccugccucagccucccaaguagcugggacuacaggugccugccaccaugcccggcuaauuuuuuguauuuuuuaguagagaugggguuucacuguguuagccagguuagucucgaucuccugaccucgugaucugccugccucagccucccaaaguguugggauuacuggugugagccaucacaccuggccagaauaaguacuuucaaguggguagagugccucuauguguguauguguuuugcuuuuuuuauauagagggugaacagaggagaucucucugacagacauuuaaauagaguccuaaaguaagugagggagugagucauguuaguauccagaggagagaggguugcagacagaggcagccaaggcagaagcccuggcguaggagcaagcagggcauucaagcaauaauagguaggaacauguggcugggaggguagagagugagaggccagagguaggaggugagcccagaaaggucagcaggggccagaucggccauaauaaggaguuuggacuuuauucuaaaugugauaguaagucauugaaaggucuuaaacagggaaucaauguuaucugauuucaaguauuaaaaguggcugugggccaggugcaguggcucgcaccuguaaucccagcaguuugggaggccgagguggguggaucauuugaggccaggaguuugagaccagccuggcugacauguacuaaaaauacaaaaaauuagccuggaguguuggugggcgccuguaaucccaguuacucaggaagcugaggcaggagaauugcuugaacccgggagguggaggaugcagugagcugagauugugccacugcauuccagucuaggcaacaagagcgaaacucugucaaaaaaaaaaaaggggcugugagccuaggcaauauagcaaaacgcugucucuaccaaaaauacaaaaaaaaaaaaaaaagccaggcauggugguguguacccguggucccagcuacuugggagguugaagugggagaaucacuugaaccugaggggcagagguugcagugagcugagauggugccacuucacuccaucccaggugacagagccagacccugucucaaaaaaauaaaguugcugugguuauuguguguagaauaugcuguaggcagccaugggcagaaacaagaagagcaaggaucuuuuguauuaguccaugugaaagaugauaguuguuugaacuaaaaagcagugggggaguugaugagaagugaucagcgucuguauaauuuuugaagguacagcugacagauuugcugacgacauguaagagauagagaagagucaaggaugacuccaagggcuuuuucucucgguaccaguagauggaauuaccacaugcugaaaugggguagacuucaguagaacuagguucuagggagaugauaagcaguuugguuuugggcauguuaaauauaugagauuccuuugagaugacuaaguggagauguugaauggauaguugaauaacagagucagauguucaagugugagcccuggguuagagauagacaucugggaguugggcugagugcgguggcucacgccuguaaucccaggacuuugggaggccaagacggaagaucgcuugaaucccaagaucgagaccaaccugugcaacauagugagacucugucuuacaacacauauauacacaaaaaccccaagaaaccuagcugggcaugguggugugagcuuguggucccagcuacuggggaggcugagguaggaggaucacuugagcuagggaggucaaggcugcagugagcuaugauugugcugcuauacuguaugauugugcuuggguaacagagcaagacccuguuucaaaaaaaaaaagaaaaaaaguaaaggaauuugggaguugguaaugaguaaaugggauuaaaaaaauagacuauauuuuagagcaguuuuagguucacagcaaaauugagcagaaaguacagaguucuggcugggcacagugguuuaugccuguaaucccagcacuuugggaggcugagguggaaggauugcuugagcccaggaguuugagaccagccuggacaccauugcaagacccugucucuacaaaaaauaaaacaaauuagcugggguaggggguggcuugcaccuguaguccuagcuacuugggaggcugaggugggaggaucgcaugagcccaggaguuugaggcuacagugagccaugauuaugccacugcauggcagcuugggucacagggucacagagcaagacccugcuucuaaaaaaaaaaaaaaaaaaaaaaaaaaagaauguaucaaguucccauauuccuguguucucccuccagccucccccacuuucaacauccugcaccagagugguacauuuauuacaguugaugaaccaauauugacaccucaguaccacccaaggaccauaguuugcauuaagguuugcugcugguguuguauuguuuauggauuuugacaaauguauaauguauauguguauguuacacauuuaucaaaauccauauguguacauuauacauuugucaaaauccauaaaaguuacaaaaguacaaaaaaaguacaauauucauaaaaagacaacuugaugcucaaaaaguuucggauuuuggauguuuggauuugagaugcucaacccauaguaaaauucgcucuuuuucagaauacaguugaguuuugccaaauuugacaguucacgcaagccccaccacaaucaagauaugggccgggaauggugacucaugccuauaaucccagcaccuugggaggacaacgugggaggauugcuugagcccaggaguucaagacaagccuaagcaacauaaugggacuucgucucucaaaaaaaaaaaaaaaaaaccauaauaaaaguaauaauaauagcugggugugguggugugugucuauaguuuuagcuacucaggaggcuggggugggaggaagacugcuugagcccaggaggucaaggcugcagcaagcugugauuguaccgcugcacuccaacuccagccugugugauagagcgagacccugucucaaaaaaaaaaaaaaaaaaaaaaggggugaagaaagaaaaaaaaagauauaaagcacuucuguuacccacagaauuuccucauguccauuuguaaucagccucuccuggcaccuccagcuccugucacccacugaucuguccuuugucuauacaguuuugccuuuuccauaguguguuauaauggaauuauucaguacauagccuuuuggauuuggcuucuuaaacuuagcguaaugcauuugagacucacccguauuuuugcaugagcaaaauaaaggguuguugcuuuuagaaccaaguaguaaguauuccauuggauggauauaccacagcuuaucuguuuauguguucaaagacauauggauuguuuccaguuuuggguuaauaugaauaaacauuuauauauagguuuuuaugagaauauaaguuaucauuucucuuggauaaauaccagcgagcuggauugcugggucauguaaguguauguuuaaccaggugagaaaccgccaaacuuuuucagagucucuguaccauuuugcauuuccaccaggaaugucaggaauguaugagaauuccaguugcucugcauuguugucagcacuuggugggauucuuuuuuuucucuccuuuuuuuuuaauuaacuguuuuaaaaaauugagauauaguuuacauguuauaaaauucauccuuuuaggcugggugugguggcucacgccuguaauccaagcacuuugggaggcugaggugggcggaucacaaggucaagagaucgagaucauccuggccaacauggugaaacccugucucuacuaaaaauacaaaaauuagcugggugugguggcaugugccuguagucccagcuacucgggaggcugaggcaguagaaucgcuugaacccgggaggcagagguuucagugagccaagaucacgccauugcacuccagccuggugacagagugagacucugucucaaaaaaaaaaaaaaauuuaccauuucaaagcauacaauucaauaauucaaugguuuucaguguauuuacaaaguuguacaauugucaccacuaucuaauuccagaauucucauuaucccaaaaagaaaccucauacacauuagcagucagacccuauuuccucccugcccuucccagccuaggcaaacacgaauuuacuuucccucuauauauaugccuguucuggacauuucauagauauggagucauacaguaggugacuagcugcuuucacuuagcaugcuauuuucaagguucaucuauguuguacguuacugcuuuuuguggaugaauaauuccauuauaugaguauaccauauuuuguuuucccauucaucaguuguuggguauuuacaguguuucuucuuuuuggguauugugaguacacauuuguguggacauaugauuuuacaucauauggguauauaccuaagauggaauugucagaucauaugguaauucuguuuaaccuuuugaggaacugcuaaauugcuuuucguaguagcugcaccauuuuacacucccaccagcaaugggaauccuguuuguuuuuauuuugaagagaugggagucuugguauuggcccagacuggacucaaacuccugggcucaagugauuguccugccucaggccuccuggguaguugggacugcaggugcauaccaccgugcccagcuauuuuuuacauucaauaagaaguaaaauuaucagcugagacugagaucaggacagggagggcuuagguuugaggaaagaagauaagguaugaaauauuuaggaguuugcacucccuccucaggcuccacuuuacucaguagcuaaugacaggccucaaacuccuggccucaaguuauccuccugccucggccucccaaagcacugggguuacagguguaagcuaccaugccuggcuaaaaacuuuuuugauauuaauuuuccuggcuccuuaaagguauaagacauugaauuaagaagagugcaaaauugcuacucuauaauuagguuaauuauuuuuagagagagggucuugcuuuguugcccaggcuggaguacaauggcuauuuacgagugccaugaaauacacuacagccuucaauucuuuggcucaagcagcucucuugccucagccuccuguguaguugggauuauaggcaugcacuauagcacccagcucuuacacuuuuauuuuaaaaauacuuuuuguugaguuuuaauuuauaguagaguguauaaacccuaaauguguagcuugaugaacuuuuacauauguauacacuucuauagccaccacccaaaucaagauauggaccauuaugggcacuccggaagcuuuuuugucccucuccuacccccaaagagaauuacuguuuaauaccuguuugcagauaugcauuuuauauauguauguauguguguuugagacaguuucgcucuugucccccaggcuggauggcaguggcacguucucggcuuacugcaaccuccgccuccuggguucaagugaucuccugccucagccuccugaguagcugggauuacaggugcccgccaccacacucgacuaauuuuuguauuuucaguacagaugggguuucgccauguuggccaggccgggcucgaacucuugaccccaggugaucugcccgcgucggccucccaaagugcugggauuacaggugugagccacugcaccuggccuagacaugcauuuaaagugagacccaucagcauguugaguguuuucucuagccacauuuagcugucuggguacaggaauggagaauguggagucugaaauaaccaggguuggguggcaguugugaugaggaagagagucgccaguaauuugagggcauaugcaaggaagugaaauuaaagaaugagaagauuuccaggaagagaguggcagggggagaaggcagaaggaauaacaucagcaaaaauauucagggcuugaaagaacuugguguguucugagaauccagggagguaacaggaguggugggagauugaacugaagagugaaaauuuaagcaggagagagacauguuuugauccuucuuaguaacagaaaauuggcaguguucauucugucauaagauauuugcugaguggcucuguaucaggcauucugcuggguacugauagaagggguuuaggggugauguguacauacugacuguucaguuguugcugguaagaaaugauugagauagagaggaaagauaaauuuaagaccuuucuuauaucagauguugauuaauggaaguggugaagggguagggaaagaguuaaggcauucaaaauagcaguuuuucugcaguuuaauagucagccuuuuguuuuuuacuaaauauaucuuccauccccaucuccucuccagcaaaggcuggugauggcuuagaauguuccuuuugugcauagaaguauuuugcuucugguaugugcccugagccaggaauagaggcaagcucugauuuuuuuucgcucuugucgcccaggcuggagugcaaugguacgauuuuggcucaccgcaaccucugccuccuggguucaggugauucuccugccucagccucccaaguagcugggauuacaggcaugcgccaccacgucuggguaauuuucugauucuugaaguaaaaugagugcuguauguuugcagacaaacuguuuauauagcaaagaaucuggaagcagucugaaugcuuaaccucugggggaaaguuaagucaaauucugggcuagccacgcaguuaaguagacuauuacauggcuaagacaaaagacacccauguggauguggugacugcaggaauguuuacauguggaguccaguuaagagcagaaggcucauagccgggugcgguggcucacgccuguaaucccagcacuuugggaggcugagguggguggaucaugaggucaggagaucgagaccauccuggcuaacacggugaaacccugucacuauuaaaaauacaaaaaauuggcugggcgugguggcgggugccuguaguccagcuacucgggaggcugaggcaggagaauggugugaacccgggaggcggagcuugcagugagccaagaugacgccacugcgcuccagccugggcaacagagcgagacuccaucucagaaaaaaaaaaaaaaaaaagcagaaggcucuucaccggguuuagaguuagauguagauaucgaucuugauugugccucuuccuagucauucucuuugaggcuccauuuccaugaauguaaaaagggggcaguaauaauaaugacuccuuaagucuucauggcaugaucaagugagauaccuuagauaaagauaguuuacaaacccuagaguaagcugcacucauuaguuuuauuuauuuauuuauuuauuuauuucugagacagaguuucgcucuuguugcccaggcuggagugcaauggcaugaucucggcccaccacaaccuccgccuccuggguucaagcaauucuccugccucagccucccgaguagcugggauuacaggcaugugccaccaugcccaggcuaauuuuguauuuuuaguagagacggaguuucuccauuuuagucaggcuggucucgaacuccaggcuucaggugauccgcccgccuuggcuucucaaagugcugggauuauaggugugagccaccgcgcccagccucauuaauuacuaauagccaugugggugaacacugaugaguuguagugggaauucggaaggaaauugucauccuuucuguuuuuuucuccccggccccaugauguuucuuuaguuaguauuucugguauauaggggggaacaaaacagauuccugccaagcacugucuggcugcucuaguuuaagcacgugcacgguauguaguauuaggcagcuuaauuuuacacagaugcagcaagacucugagcggcaagccuuccuggggcuuaaggucauauagggcaggcaugucaacacuguuucccugaauuagaccuguacuguucucugccuucuggcugugcacauggagucaugccagcaguggcagugcuuuacugucuuacagcccucucucucccuugguggagcccuaggacauguuggcuuaucuuguagcuuagagcaguguuucucaaaccugaaaacaugaggacuggcaccucuaaccuauaaacuauugauagacuccauuucuagauaccaaagcagucuagcaaaaugcaacuuuguuagcuacuuagugcuguguaacacauuuucucaaaauuuaguguccuaaaacaauaaacauuuauuauucucuaggugucuaugggccaggaauucaggagcggcguaaugggggguugagggggcuucuggcccaggaucucauaaaggcugcauccaagggggcucacucacagggcuggcaaguuggugcugguuccugacagguggccucaguuccuugucaugugaaccucuccauagacaucuagaauguucucacgauguagcaccugacuuacccuagaacagggaaucugagagagugcagggcagaagcagcagugcuuuguguauaugcuugugguaaaauacauacaacauaaaauuuaguauuuuaaucauuuuuaggugugcaguacaguucuguagcguuaaauacauucacacuguucugcaaccauuaccagccuacuucuccaaaauauuuucuuucuuucuuuuuucuuuuuuucuuggugauagauucucacucuguugccaggcuggagugcaguggugcgaucucagcucacugcagcuucugccucccggugauucucaugccucagccucccgaguagcugggauuauaggcuugugccaccacgccuggcuaauuuuuguauuuuuaguagagaugauguuucaccauguuggccauggcuggucugaaacuccucaccuuuggugauccaccugccucagccucccaaagugcugggauuacaggcaugagccacugagccugaccuaaaauuuuucauagugagauaaaaucucacuauguuguuuauguuggucucaaacuccuggccuuagccgugcgccauggcucaugccuauaaucccagcacuuugggaggcugaggcaggcauauugcaugagcccaggaguuugagaccagccuagguaacguggaaacccugucucuccuggccucaagcaaucuuccugccuuggccucucaaaguauugggauuauaggugugagccaccacgcccagcccaagauuuuuucuuuuucuuuuuuuuuuugagauggaguuucgcucugucaccuaggcuggagugcaguggugcgaucucagcucacugcaacgucugccuccuggguucaagcaguucugcugccucagccucccaaguagcuggggcuacaggcgcaugccgccaugccuggcuaauuuuuuguauuuuaguagagacgggguuucaccauguugcccaggcuggucucaaacucccgaguucaggcaguccaccugccucggccucccagagugcugggauuacaggugugagccaccgugcccggccugauuuuuucaucucuccaaacugaaacccuguaucuauuaaucagcaacugccucaucccuucuccccuuagcuccugguaaccucuauucugcuuucauuaaucuggcuacucuagauaacucagaugaauggaaucaugcaguauuuguccuucaaguggcuuauuucacuuagcauaaguccucaagguucaucuguguuguagcauguauuagaguuuuauuccuuuuuaaggcugaauaauauuccauuguauggauauaccacauuuuaucuauucauguauuagacacuuggguggcuuuuugacuacuggguugucuuuugacuguugugaguaaugcugugugaauucuggaguacagacaucuguuugaguccuuguguucaguguuuuuggauauauacccagaaguggaauugcugcagugcuuuuuuuucuuuuucacaucaacuuuauaguuagauaauccaucacuuuauuaauucagaaguuugcuuuuuuuuucccuucaacuuuuuuuuuuuaaguucugggguacaugugcaagauuugcagguuuguugcauagguaaacuuguaccaugguaguuugcugcacagaucaucccaucaccuagcuauuaagcccagcauccauuagcucuucuuccugauauucucucuccccuguccugcugcagugcuuuuuauaacccagcuuuggaagucccacaccaucacuuuugccacauucuacuuguuagaaaugaggccauauucaaggauaaaacgauuaaaaucuaccuuuugaaggaauaagugccaaaucugcagacauauaaaguugucccagcuacuaugugggagugauuuuauaaugccagguuaguuacaaauauacacacuaaaguuauuucuuucuuccuucccucccucccucucuuccucccucccucccuccuuuccuucucauuuauuuauuuugggucucacucuaucacccaggguggaguucaguagugcgaucaugacucaacacagccucaaccuucugggcuccagugauccucucaccucagccucuugaguaacugggacuacaggcaugcaucaccacaucuggcuaauuaaaaaaauuuuuuuuuguacagacagauggggucucccuauguuucccauacugaucucaaacuccugggcucaggggauccuccuucagccacccaaagugcugggauuauaggcaugagccauugugcugggcugauuaaauuuuuuuagaaauagggucucacuuucuugcccaggcuggagugcagugguguugugaucauagcucacugcagccucaaacucuugggcucaagugaucccccaacuccaaccucuuaaguagcuaggacuacaggccuggcuaauuuuuaaaacuuuuuguagagacggagucuuccuaugcugcccaggcuggucuugaacuccuggccuccugccuuggccucugaaagcacugggauuacagguaugggccacugcgcccagccuuacacacuaaaauuuucuaguaguucuugauuauaugguggucaucugguaucucaacguucuucaugucauugcccacuuguaacccauuugugguaccucagcugggaagcucugguaaagaggguccagauuacagaaaagcacaauauaauauucuucaucccucauggagaccuuguggaccagcagcucuguguucaccaacacgcagugguccguggacugcucuuggcaaacauucauuuagggcucagcagcccauccauaagauccuccuggccccucaaacggaguuguuguuuccucuauccccuugaauuuccuuguccucuuuuuugccugcuuuccucuguacuaugcugauuuacuccuauuacaucuucucucagaaacucuccccagcuucacugccucuuugaucagcuggaaaaugccuacucaucuuucagaauggagaucaagugucuccucuuccccaggguugucuugggcccuccucucacucgauccccuuccucucccucuccccuuuugcaccucuguaucuuacucuaccuuaaggaguccucuguuguugcaccugguauacuuuauuacaauuauuuguaccuauagacauacuuagauacuuuuauucccccagacuauacuguaguaaguaagagacagaugccucuagcagugccuguugucuccuggggaagcaggccauaaacacaaacaaaugaaauaaugacagauuaggguaaaugcuaugaaggaaacauauaggaaacugacacagacuggaaagaaaugggggcuacuugagauaguguagucagagauucugaggcuaugggaggauaaggauguugccugggaagagugggcagggauuguuguuucagguaacgggagcauacucgguaugggaaggugugugguguguuugaggaauugaaagucuacuguguguuguaacguagggccugucauccucugccaguugcugugaucaugcaucuuaauagauuugguucuggccagaugugguggcucacgccuguauucccagcacuuugggaggccaaggcagguggaucacgaggucaggaguucgagaccagccuggccaacauagugaaacccugucucuacuaaaaauacaaaaaauguuagcugggcgugguggugggcaccuguagucccagcuacuugggagguugaggcaggagaaacacuugaaccugggagguggaggcuguagugagcugagaucacaccacuguacuccagccugggugacagagugagacuccaucucaaaaaaaaaaaaaaaaaaaaaguagauuugauucuguauuucuaaacccuaauauacuuccuggcccagagcagguacucagaaaauguuuguggaauuaugguucaaugaauuuuucuucugcugauuucuguucauucuccuuguccuuuuccauuugacauuggcuauacuggucuucuguggcuucuugguuggcuuagugaccaguuaucugacuugcuuaaauuaagcuuauuacgguaaccuuauuuauuaugaauuuuugcuuaucuguccuuuccagguugaauuuuagaugagaguuuuugaugcuuuuuggccuuuggaaaacaguuuugugacuaauuuugucauggugaccaccaugugcauauauccccuccaaauuaagaguucccauacugggguauguuuguccucuugacaucuacaacaugaauaucacugguuuauuuugaugauucaucuugguuuguuuauauauuucuauugcuguuuuguggcuccagaucuuuuuaaaaauuacaucuggugaaccuuuauugaaugucuaauauaugcaggauacccugggggagauucagacucuugaucucugaagguuugauccaaaggcuaagucuucucugaacccuuucccaacccucuaguuagaaaaaaugggacucugaugaaaaaguuuaaugugggcuuuagaaugaaggguuaaaaaaaauaaaaaauagaccaggcacagcgguucaugccuguaaucccagcacuuugggaggcugaggcgggcagaucacgaagucaggaguucaagaccagccuggccaacauggugaaaccccgucucuacuaaaaauacaaaaauuggccaggcaugguggcgcacaccuguaaucccagcuacucuggaggcugaggcaggggaauugcuugaacccgggagacagagguugcagugagccgagaucaugccacuguacuccagccugggcgacagagugagauuccgucucaaaaauaaauaaauaaauaaauaaauaaaaaggcgggaggguuuauucaagugcuuuagaagggggcagggaagagcagcagaaacccagacuguccagccugggcuggacauggaggagagauaaugccucucuucugucuaguccugguuaugggauauaggcaggcugguucauucuacagcuaugguuuuuuuuuuuuuuuuuuuuuugagacggaguuucgcucuuguuucccagucuggagugcaguggugcgaucucggcucaccacaaccuccaccucccagauaaagcaauucuccugccucagccucucgaguagcugggauuauaggcaugcgccagcacacccagcuaauuuuguauuuuuaguagagacgggguuucuccauguuggucagacuggucucgaacucccaaccgugggugauccgcccgccucagccucccaaagugcugggauuacaggugugagccacugcgcccagccagcuaugcuucuuuuucucuccuuucuuccugagauccagaguguuccugaucuuuuugcuuguggagaggagugggaaaucucauggagcucaccaaacuucucuuugggcucuugccacccuaggggcucugaugauuggucaucuauucugugucuccaggaccuagcaguuuguuugucucauaauacaaacucaggaauguuuguugaauaaugaaguucauagggcauaguuccugcccuguaaagugcuuagcagccuuguguuuauauuagccauuuaaaaaucuuguuugugacuugaguuugaaacauuuuuguugacucuugaacucuuucuucugaggaaaacuauugauuuuugaacauuuaaguuguaccugauuaucauuucaaacucucuuaucaguuuaggaaaaauugacucaagaagagguaggaggccgggugugguggcucaugccuguaaucccagcacuuugggaggcugaggcgggcggaucacgaggucaagagauugagaccauccuggccaacaugcugaaaccccgucucuauuaaaaauauaaaaauuagcugggugugguggcgggcgccuguaguccuagcuacucaggaggcugaggcaggagaaucgcuuaaaccugggagucagagguugcagugagcugagaacacgccacugcacuccagucugggcgacagagcgagaugccaucucaaaaaaaaagaagagguaggaaacuugaucagacuaguaaccauagaagugaugggaaagguagauaaagaacuaccuucugagaaggcccucagaguaggugguuucauagaaaaugaaauaaagcauuuuaguuuguuguaugagauuaucauagccuaauacugaaacugggcaggaagggcauaauacaagaacacuuggacagaucucauuuauaagagguacaauucuugucaauaaaauccuggaacaccaaguagagacuuauuaaaugaaugaugcaugaaaccaaauaugauuuauucuagcagaguaaugauaacuuaaauuuaagaaaucuaucaguucauuauauuuacagaauaaaagaguccgggcacaguggcucacgccuauaaucccagcacuuugagaagcugagguggguagaucacuugaggucaggaguuugagaccagccuggccaacaugaugaaacccgucucuacuaaaaauacaaaaaauuagccaggcgugguggcguguaccuguagucccagcuacuggggaggcugaggugggagaaucacuugaacccgggaggcagagguugcagugagccaagaucacaccacugcacuccagccugggcaacagcaugagacuucaucucaaaaaaacaaauaaaauaagauaaaauaaaagagaaaacuuuuauaaucuucuugacaaaggcugaaaauucuaaaaauuuauuauuaccuguuuuuuagaugggggucucacucuguccccagaguagagugcaguggcacaauuauaguucacugcagcuuugaacucuuuggcucaagugaucuuccugccucagucuucugaguagcugggacaacaggcacacaccacuacucauagcaaauuuuuuuuuuaacuuuuuuuuuuuagagauggggucuugcugucuuguucaggcuggucucaaacuccuggcuucaaagugauacucucaucuuggccucccaaagugcugggauuauagacaugagccacuaugcccagccaauauucuuauuuuccucuucuauaacacaaaagguaucauaagauaugcacuauucuguagcuuguuuuuuaaaaacuuaaugugucauggaagucuuucuguaucaguucauagagugugucuucauucuuucuuguggcuacauaauaugccauuuugugggugugccauagcagcacauaaacauaauauucaugaagcuaucgguugauaucuuuaaaaaaguuuuuuaaacuuuuaauuugccgggcgcaguggcucacgccuguaaucgcagcacuuugggaggccgaggcgggcggaucacgaggucaggagaucgagaccauccuggcuaacacggugaaaccccauuucuacuaaaaauacaaaaaauuagccgggcaagguggcaggugccuguagucccagcuacucgggaggcugaggcgggagaauggcgugaacccccggcggggcagagccugcagugagccgagaucacaccacugcacuccagccugggugacagggagacuccgucucaaaaaaaaaaaaaaaaacuuuuaauuuaaaaguauuuauuuuuuggcugggugcaguggcucacaccuguaauccuagcacuuucagaggccaaggccagcgaucgcuugagcccaggaauuugagaccagccugagcaacauggcaaaaccccguuucuacaaaaaauaccaaaaaaguaucuuagccgagcaugguggcgugagccuguagucccagcuacucaggaggcugagguggaucaccugagccugguagguugaggcugcagugaguggagauugcaccacuguaccccauccugggugacacaguaagacccugucucaaaaacaaaacaagaaacaaaaacaaaaacaaaaaaaacacaaaaccccaaaaaguacuuauuuuuuacuuauacaaguaauauuuaacuaaauuuuuaaaaaaauucacacuaaagcaaaaaucucuugguuauuccuaaucccuaucuccuccuaagagcuaauuuuuguuauuaguuugauuaucugccccuuucuggccaguauucccgcugguuggaaauguaacucccagcugcaauguuaguuuggaaacuagagucucaucaguggcucuuaguuacacagggaagcuagaaauucucucuuccuuuucugccuguacaaauuccauucacaucucuuuuguuaacucugucucaucaucuucagccugcuuuaugguuguccauauauuuagguugaaccagauaaaauugcuauuuugguagguaaaaagcaguugauuaucagcaauuaaaugugguucaaccuaauaguuuuaaagccuaauccauuuaugugucuaguucuccucaagggcaggggccagaacacauguuuguauaaucccuuccaagacuuagaauuggcuggucagaucaaaagcacuuaauaaauuccuguugacugaugaagcuaagcugucgccaaggcaggcagaguugugauccacuaaaucuuaccagguugaucucuaagaugguuuuugcagccucccucuucucugaaauguaauuggguccccaccgccguaagugacuugcaucuuugucacacuuuagggaaguggggaggaccacuuaaucuuuggaaaauuuugcgccuuggcuacuauugagccucuuggagggguuuguuuaggucugcagagaguuggauaugugugcccaauaaaguuuuuuuugaaugagggagaagcuuuacauuagcugaggacguaaagacccuucagagugaguggaguugcuggccuaggaguucacacuugauucuaugaauccugacuuccgaccagugcauauccaaaagaauuuaagguuuucccugagguugccaacuuuuaauuuugccaaauaaggacauuuaaaauaaguauguaauuauguacuuuuaauaguuaauaugugcucaugguacagcauucaaaauguccaaaaggauauacagcaaauaaaaugagucucaugcuuccucuccaguugcuuaaaacuauccaguuccccuuccgggaggcaaaccggguuacuugauccuccuucccgagguagcccacgcauuuaaaaacagguaugacuguacuggcucucucccuucccccacauaaaugguagugcauucaaauacuguuugacaucuuugaguuuaccucccacauuucuuagaaaucuuuuaaaaucaauacauuaaaaaaauaaaguaaaaucaauacauagagcugccuuauucuuuuugaaggcugugugauauuaggaaggguauuaaaaacaguuguuaucguuuuaacuuagaagguauauuuaaauacuaaaaguuagaaagaaugcgauuucaagcgggacguggugguucaugccuguaaucucagcacuuugggaggcugacgcaggaggauacuugagcccagguguucaagaccagccugggcaacauagugagacuccaccucuacaaaaaaaaaaacccaauaaauuagcugggcauggugguaugagccuguagucccagcuacucugguggcugacgugggaggaucacuugaggucaggaguucaaagcuguagugugccaugguggugccacugcacuccagccugggaaacagagcgagacccugucucaaaaaaaaaaaaaaaaagugauuuccguguaaagaaaauuuccugccuuaguccaaggacccugugugagaaagcuguugcuagagauaguaaaccauuaaagaaagugguuugaagccaggagcaguggcucacaccuguaguaccagcacuuugggaggccgaggggggcggaucacgagaucaggagaucgagaccauccuggcuaacauggugaaaccucgugucuacuaaaaauacaaaaaaauuagccgggcgugguggcgggcgccuguagucccagcuacuugggaggcugaggcaggagaauggcaugaacccaggaggcggagcuugcagugagcuaagaucgugccacugcacuccauccugggugacagaacgagauuccaucucaaaaaaaaaaaaaaaaaaaaagaaagugguuugaauaggaauguguuaagacagauuguguuauuuuagagagguuuacuagccucagguaggcugaaugaaugagaggguaagagauauauaauugccauauugauguccuucuccccauuuuacagagaggaguggauuuagggaauccucucuugucuccuacaauuguacuauuucauuugucagaucagacaauuagccagucuguugucaagauaucuuguauuuauagcagcugucauuuggauuggaguaggaagacuaguuucagggcuguuuaugucuuuuguuaauauuuuugagcaaguaagguaugcauaguagcaauuaggaauuauggaaaacauacccuuccaguccucugugaggaauacacacaugaagugaugggggccugaacuugaggagugaaauuggaauagguugcuggagucugagaauguuggaauuuaaaaacugacagaauacaugaccuuugggaagaauaagaggaguggaauucauuugcuaaacauuuauugaguaccuaguaugugcaaaguacugcaauaaguuaaugccaagcaaacugccuuagagggugcuaguguggguugaaaaguacacaguauacagacacaagaaagcaggccuguucauuuagguagguagcauguguuuauuaggacagcacuguacuaggugcuggauauaagaaaggaaggaagugguacaaaccagguugcagggagaaaauacagauagaauguaaacuuuuucagucuagaauagcuauuugauuaauacaaguguuuucagagaaaaacugcauacaauauuuuucuuuauuuuuaaccguuuauuuuuuggaaugagcaauaccuuuauauaguugaaauaaaaagguauuauaagguauacugcaaaaagucucccuccuauuuuugccccuucccaccucuuauccagauaccucucuugugucaggaauaaaugcuggaaacagaaaccagcccgaguauuuuaaccacaaaaggauuuaacguggggaauuggguacuuuuaaaguuguuggaagggcuggaagagugggacucaaggaggcugcccuuaggguaucaucuugaaaggcccacaaucguagcugugaucuggucaggaagucacuacuggcacugccaucugcaccacugcugcuugacaugcaugaaacugaugauuagacauuaggcucuggcuuauugcagaccagcagcagcagcagcagcagcaacaucugggagcuugugagagcucuuaggccccagcuuggcauacugaaucagaaucuucauuucaacaggauaccuugaugauuuacauguguguggaagcuugauaggccuuguacuggaccuggccacuaacccaagggucuuuaugaccuuggccaccaauuguaaggaagucagggaaauguaguuguugauuuuccuaacucucagucuagaaagaagguugaauggagguugaaagaaaccaucuacugaacugaccacacuuuuccacaaguaaccuuuguuguuucuugggcauccuuccagauacuuuaugcauauauaagcauaugugaauacauauccuuuuuucuccucuuuaaaaaguaagucaggugugguagcucaugccuguaauuccagcauuuggggaggcugagccaggaucugcuauccugggcagauagcuugagcccaggaguuugagaccagccugggcaacguaacagaacuccaucucuacaaaaaauacaaaaauuagcacuguaugguggugugugccuguagucucaacuacuugggaggcugaggcuggagggacacgagcuggggagagggagguugcagugagccgagaucacgccacuguacuucggccugggugacagagugagacccugucucaaucaaucaaucaaucaaucaaaauaaaacgaaacaauagcuuagcauauacaguguucugaaucauauaacuguauaucuuagaagagcuuuccauaucuugacagauaaaaucaucuuguucuuuuuaauaaccgcguaguauaaggcugggcacgguggcucaugccuguaaugcuagcacuuugggaggcugaggugggcggaucaugaggucaagagaucgagaccauccuggccaacauggugaaaucccguuucuacuaaaaauacaaaaauuagcugggugugguggcacguaccuguagucccagauacucaggaagcugaggcaggagaaucacuugaaucagggagguggagguugcagagagcugagaucgcgccacugcccuccagcauagcgacagagcgagacccugucucaaaaaaacaaacaaacaacaaccaaaaaaacugcacaguauuccauuauauugcuuauaaaugcuuaaaauugagacugucugauacagucuggguugcauggucauucugauuuauuggcacauguaaaaucuaaucuaguuguuaaauccuuaauguuuucuuccugccucuugugugcucaagucuucuguguaugucaucuuguuuaauccacacuacaacccagugugcuucuuccacuuuacaugagggaacucaggcucugaaaguuuaauuuaaugguucauaaacuggccgggcacagugguucacccuuguaaucucagcacucugggagguugaggcgggcagaucaccuaaggucgggaguucgagaccagccuggccaacauggcgaaaccccaucucuacuaaaaauacaaaaauuagcugggcaugguggcgggcgcuguaauccccgcuacucgggaggcugaggcagggagaauugcuugaacccaggagguugcggugagccaagaucacaccacugcacuccagccugggugacagagcgagacucugucucaaaaauaaaauaaaauaaaauaguucauaaacuaaggaauaugcagguuaggauuuggaccucaagucuguuacccuccauaauuugugauuugacccaacuacacagagucucuaaacgguaggccugguaaccuucuccuuugggaagagguuuggaaauguaccauuauggauauuuggauauuugggguggguauuaaaggaaugccaauuuuuuuuuuucugacucagguauccagcucacauagaagacauugacuacgaggaaggaaaaguacucauccauuucaagcguuggaaccaucguuaugaugagugguucugcugggacaguccuuauuuacgcccuuuagagaaaauacagcugaggaaagagggcuugcaugaagaggauggaucuucugugaguaacaaaucugggaaguucuguaguaugcaaggucagccauugggcuguuuguguuucaaucuuugauguuaguagcagcuggagaccaguucuuauuuaggccuauaguuguaacccugagaucucuaugacaccuggggcucuugaagaaucccaauuuuguuuguuuguuuuuugagacggagucucgcuguguugcccaggcuggagugcaguggugcagucucugcucacugcagucuccaccucucggguucaagcgauucucgugccucagccucccuaguagcugggauuacaggugcccacccuggcuaauuuuuguauuuuuaguagagaugggguuuugccaucuuggccaggcuggucucaaacuccugaccaauuuuacggcauuguaucccuaacuucuagaacacugccuggcacauuguagaucuucugaucuuuuguuaagcugucuggucuuuuguuaagugaucauucuggccaggcgugguggcucacaccuguaaucccagcacuuugggaggcggagacaggcaaaucacaagaucgggaguuugagaccagccuggccaacauggugaaaccccaccucuacuaaaaauacaaaaaauuagcuggauauaguggcgggcgccuguaauaccagcuacucgggaggcugaggcaggagaaucgcuugaacccaggaggcggagguugcagugagccaagaugaucaugccacuccacuccagcccgggugacagagugauauuccaucucaaaaaaaaaaaaaaaaaaaaaagugaucauuccauguagaacguuguacuaagucucauaugcaaggucuucuucuuuugagacagggucuugcucuguugcccagacgggaaugcaguggugcaaucauggcucacugcagccucaaucucccaggcucaagcgaucuuuccacuucaacuucccaaguagcugggaccacgggcccaccacacccggcuaauuuuuaaauuuuuuuauagagacagugucucguauuguugcccaggcuggucuugaacuccgggcucaagugauccucccgccuuggucucccacagugcuaggauuauagguguaagcucguccugcagagucuuuuauaagcccuuaaagaacuuggaauugauuggacuguauuccauuuuucuaaauuuuaucucuaugccuggagcuuuuacugacuucaaaaugcaguaugaaguauuaguuuuaagguuuuuuuguuuuguuuuguuuuaagcagugaaagcacagauuuauugaaaugaaaguacacuccacagagugggagcgggcucaagcaaguagcucaagagccguuuuuuugguuuguuuuugagacggggucuugcucuguugcucaggcuggagugcaguggcucgaucucaccucacugcaaccuccaucuccuggguucaagcgauuccccugccuuauccuccugaguagcugggacuacaggugcgugccaccacaccuggcuaauuuuuuguauuuuuaguacagaugggguuucacuguguuagccaugauggucucgauuuccugaccucgugauccgccugccucggccucucaaaguccuggcauuacaggugugagccaccgcgcccagccgguuuuuuuuuuuugguuuuuuuuuuuuuugauaauguuguccagcuuuauuuuugcuuucuugccaaagauuugucaagcuccucacucugucauuauaaaauucccacccugagaaucucccauuuuucuucaccaucaccacacacacacacacacacacacacacacacacacacacacacacacaggcugaaacaauaaaauauaaaguucauccuaagaagaagauaucgaguccaaagaggguuaucaacuuuagaaaagaagcaaagaaaucauaaaauaaugauauuuuaagauuacagauuaagcccuaauuuagaauauuuuuagaaauuuuaucauauuaaaacaagggugaaggcacuauagacucuuguuuuuuaacuaacuuuauuuaaauuagcuauacccauuuuaaguguaugauuucauaaguuuuguguaauaagcuuaaauuuaauaagcauuuaaauuugugauauaaaaaucacccauuuuaaacuguauaguuuaauaaguuuugcaaauuuauauugucagauagccacugccauaugauacacaauauuuucauuaugacaaaaagaagcucucccucaaauugcuuuucauucagucuucaccagccaguccuggaccaguucuggacccuggcuugccacugaucuaucuauuuucuguuuauaguccuauuuuuguuugguuuuucauuugaaauaaaaucauacuguauguaacauuucgggucugacuuacuucaauuagcauaucuuuugaagcuucauuuaugguguuuuuuuuuucuguuccuguaauaacaguuuguuuuauuuuuuuaauuuuauuuauuaauuuuuuuauuauacuuuaaguucuaggguacaugugcacaaugugcagguuuguuacauauguauacgugugccauguuggugugcugcacccauuaacucaucuuuuuuuguuuuuuuuuaaagagacguuuucuugcucugucgcccagucugaagugcaguggugcagucuuggcuuaauguagccuugaccucuugggcucaagcaauccuccuuccucagccuccugaguaccugggacuauaggcauguaccacugugccugacuaauuaaaaaauuuuuuuuguagagacaaggucuuauuauguugcccaggcuggucuugaacuccuggccuuaagggaucuuucugccaaagaaggaagauccuucguaccucccaaaguccugggauuauaggcgugugcccuugugccuggcuaguuuuaagguuuuuaaacaggcauugagacaucuauaaugguccugcugcuuuuggaucugacucagacucagcccugccuucuauuuuucuuucuuuuuuuuuuuuuuuuugaggcagucuuacuguauggccgaggcuggagugcaguggcaugaucuugacucacugcaaccugucuuucggguucaagugauucucgagucuuagcuuucugaguagcuuggacuacagacgcauccaaccacaccuggcuaauguuuguauuuuuaguagaggugggaguucaucauguuggccagacuccuggccucaggugauccaccuuccccagccucccaaagugcugggauuacaggcacgagccacuguguccggcuuauuuucuguuuuaacccuauuagggaacuugaacuauugcuggccuuuuuuuucuuuuucccaauuaaggauuauucaguauuguuccauuugacuuuucaguguucauucuacaaauuuuuuuuuuuuuuugagacagagucucacuguaucacccagccuggagugcaauggcgcaaucucggcucacugcaaccuccaccuccuggguucaagugauucuccugccucagccaucgagaagcugggauuacagguggccgccaccacacaggcuaauuuuuguauuuuuaguagagacgggguuucaccauguuggccaggcugaucucaggugaucugcccaccuugaccucccagagugcugggauuacaggugugagccacugcaccuggcccauuguacaaaauuuaucagugcaaacugugugcugggaaaagaguauaaaauauuaaaggugaaugguugcuuucccuggcaaaagacccuuuagaaguguagauggcauuaaaugcugcuucccugaguaugaaguagccucauaucuucugacuccuauacuggauguguauucuaguaguccuggccucuuagacucauuuucagaauguaugcugguuaggguggaauuaucaucagugcuguucugugccugcccagaccucuugggcuuauugaggucuugugucccagcccuuuuguuuugacuccugucuuagucuuuucuguguugcuauaauagaauaccugagacuagguaauuuauaaagaaaagagguuuguuuagcucacaauucugcaggcugggaaguucaagugcaugguacuggcuucuggcaucagcuuucaugcugugucauacaugguggaaggucaaaaagggagacaagugugaagagagggaccaaacagaaggagacuugcuuuguaacaacuugcuuucuugggaaugaauccauucccaggagagcgagaagucacuccugugagacagcauuaaucuauucaugagggaucugcuaccaugacccaaacaccucucauaggccccauuuucaacacugcugcacugaaaacguuuacuuuuggugaggacaaaugacaccgaaauuauagcaacuccuaguguugaacaacagaaauaucuuccuccaucucaacagcuacuuucccuucacacuuucuuaucaaucccagcuucuuuuaugagaucugguauguccuguauguccugugaaauuagguugguaacaggaucuuuuuuuuuuuuuuauguuuuuuaggaauuucaaauaaaugagcagguccuugcuugcuggucugauugucguuuuuacccggccaaagucacugcuguuaacaaggaugguaaggcauuugaguuguaguuguuuuuacucaugacuuaggugguggggggggauguuuguaauaucagagcuugauaguauauuuucaguauuuauuuacugccuagguauccgcuuuauucaaguuaaucacuaugucaggaguuggguagaaauuauaaguguaaagaaaacuggacaaaaaagauaguuugacuuuuuacccccugaauuucagucauuguuuucuaaaacagucacaguucaucugucacucugccuggaaguaugcagguacuugcugucuaggaguuccuaauauaauugaugacauaguccugaauauuugugaauagcuuagaaauuaaaugaacacuaacaaacuuuaaaaaaugugcuuucuagaugcaaggugacugaggguggucuguaacauuggaguugcuaguggaaacugggaugccggaauuuagagcacugaguuggguuucauuugccagaguugaacaugugaagagacaggauggggaacuugacuaauagaggcucaauuuugcuaguaaaagggcagacaaagaguuaugaggauaauauguacggucaggauccuggcaccuggagaauagagucugggucccagugauaccauuguaagcacauuccacuaggguguguguggucuccaugaucucugaagugaguguuuagggaagucaggccucuugaugccacuguaggguugacuauuaggccagccugacuuuucauuugaugaaguuauucagauauuuauuaauacucugcuaacugcugggccucaggcugaccaaguuuugucugagaaugauuuuuuuuuucuuguucuuuuuugggacagagucuugcucuguugcccaggcuggagugcaguggugccagcucagcucacugcaaccuccaucuccugaguucaagcgauucuccugccucagccucccgaguagcugggauuaccaacgugcaccacggucagcuaaauuuuguauuuuuaguagagacgggguuucgcuauguuggccaggcuggucucaugugauccacccaccucggccucccaaaguuuugggauuauaagcgugagccaccaugcccagccgcaacuuuuuagaaaaguauuuuucaggccaaacacgaugguucuugccuguaaucccagcaguuugggaggcucucgugggaggaucacuugaggccaggaauuugagaccagccugggcaacauagugagaccucaucucacuaugaaaaaaaaauuagaugaguguggugacauguuccuguaguccuagcuacucgcauggcugaggugggaagaucccuugagcccaggaguuugaggcuacagcaagcuaugauagugucauuguacuccagccugggcagcagaacgagacucugucucuuaaaaaaaaaaaaaaaaagucuuuucaguugugcuuccuccauaagcuaaaauuauaggagggagagucucgaggcuaugauaguuccuaaaauggucauuugcaacgcuaauaucuuguuucugaagcuccauauucuguccagugaaauuuaguuaauugaaggacaugaaaaugaauggaaauuucugccaaaaccuguuguccugagguucuugggucugaaguccuguauuaugcugacacauugacugguuuuugggacuaacuggaagagggaggagaggauaugggagaggggcaauccugaaacagaaaguuaguggggcaggcuggguaguacuauuggccacccagauugugaaggaaagcuagccuuuguaggagcucagaucuaugucugauucagagaugaagauaauuaaugccucuaagaggggugggaaggugucuugguggaggcaaugaaggcuuaguaaucuacuguuuagaucuaauaccugcagagcccagagcuuggcaucaugaaguaaaacaaaagaagaccugcuucaaaguagaaugaaguaggugcugaaauagagcuaccaggaggaggcagggcaggauggugcagguuaaucaugguaggcaccugucucuauaagguuuuguguuugugugugggauggaucagaaacucuuugaaauaaugauuucaaaaaugauuagguuuggauuagagcugauggucaguuugugcuucaucacgauucacugugggauuacuugugggauugggagcgacaaugcuagucucucuuuucacucuuuccuugguauuuucugcugugccucagguucauucguagcaguggccaccagcuuaauggcccugcgaggagaagcucugccggcaaggcggccccuuuauuuccuguaaaugucacuuaugucuuguuggugcugccaggaggaggcaggggauauagugaagucaugccuuguagauuuaucuuuagaaggcuuggucugauuuucuugccacucuuaaucuccuuggauguuuugcuaaagcugaguguugagcaggcugguggguggggacuguagccagaguguggaaguggcagcugcuggcacugaggagucuggcaugauugaaucagaacuaaauaacaacuuuaguuucuuaaggaagucuguuagcacucggaaaauagggcauauaaugccauauuauuuagcuuuuuucaccuggagugguucuucagcaguggagauuaagcauuauuuaguacgaaggcagcggcaguugguagccuuguuagacccucagucuguguuguuacaaaagacaguaaaagauggguuucuacuuucagggaaucuuuguuuggaagccaucucuggugagcugaccucaccucuuugcuggggcugcuuagcuucccccuccguuuuuuuuuuuuuuuuuuuuuuuuuuuuuggugacagaaucuugcucuguuguccaggcuggagugcaguggcacaaucucugcucacugcaaccuccaccuccuggguucaagcaauucuccugccucagccuccugagcagcugggacuacaggcacaugccacaccacaccuggcuaauuuauauauauauauauauuuuuaagguuucaaauguacuuuauuucuucauuaaugccauaucuuaauggguacacagugcuuuaacuuggcaucaauuaugagcuguuuuuuuuuuuuuuuuuuuuuuuuuuuuugagacggagucucuaugagcuguuuuuuaaacaauucauuauuacaucagcugguaugauuacuguucucuccauuuuggggggugacucugccaacaggggauggguuccauucuauuccaauuuguguuguuauauauguccacauagcaauacagaaaguggguccacuagcuaauacaguauuaccauauuuguuaugaaaaucagguguauguuucugguggcucugccuugccauuguuugcugaaugcuucgaacuuggagaugacugaguuuguuuuugaccaagggaaacaucgugaaggugaagauagaacugcagcaaugaagcugcugcuuuaauuuuugcauuuguaggagagacagaguuucacuguauuggccaggcuggucuggaacuccugaccucaaaugauccacccgccucagccucccgaaucuccccuuuuuuucacacaaggauuagcagagucaguugucugucagggcuuuuugcccccaguaguguacaacucugcucuguaagugauuuucuuuaaggaaacuacuguguagguuagcauuuaugacaaaauggggaauugguccuuucuguugaucugugguucuuuaacuugaaugagcagguaaaucagcuccuucuuccuaaaaaauaugcauauuuuugggucauguccccuaccuacccugccaguucagucucuggggcagugacugaagucugcauuuauaacaggagaugcuauggaaaugaucuuguuucuagagucucuggcugaagcagcucuuauuuuuuguuuucuucaugcuguaacugauucuacauuugaaauguggggaggcugauacugugugaacagcuuuguagaaagagaaaaggaagauuuaggcccacacgugcaggugcuagcuuggcuguuuucuucuauugggggaagagggauugugcuucccccccaacccccaccccgccccuuuuuuuuugccuagauagccuuuaacgaugucaaugucuggccaggcgcaguggcuuaugccuguaaucccagcacuuugaggggccggggcagcggauuaccugaggucaggaguucaagaccagccuggccagcauggugaaaccuaguaucuacuaaaaauagaaaaauuaaccuggcgugguagcaugugccuguagucccagcuacucgggaggcugagacagaagaaucgcuugaacucaggaggcagaaguugcagugagcugagauugcaccauacugcacucuagccugggugacagagcgagacuccgucuccaaaaaaaaaaaaaagaugucaaugugcugugcuucccuuuuagggugacuuggugguauugaucccuuggucugugacaggcccugugcuagguuguuuccauaucuuaucguauuuagucuuuacacaaacauggaaagguuauugccauuaaccccauucuuauuuugcagaugaggaacuaagcucacagggggaaacugcuugagguuauaaagcgcuuggaugguagagcugagaucugcauggaggucugugguucuacagagucccuaaacugucguucccacaguaccaggcugccucuuuggagcaggguuuuccuaagagggcagguguugucaauuagguccagguguucacugauagaaugcgagaguggauguaguggucugcacuuucuggagccgguguugucuugagaaccaugguugggagacagggucuggucccagcuccugcucagugauuaugggcgguucacugccuuugcucuggacucuuuugagcaguuagaagucaaagagggagugggaauagaugaguguuguauuggccacagaaccuaaacccaaaauguaaaauugcuaagaagaaaauacuuagagggaggggaaggcaugcccacaaacauaugcacauccccaccccucaaucuguggaagccuaaggacuucaagaaaacuuuuuuuuuuuuuugagacggagucucccucuguugcccaugcuggagugcaguggcucgaucucagcucacugcaaccuccgccuccuggguucaagugauucuccugugucagccucccgaguagcugggauuacaggugugugccaccacgccuggcuaauauuugcauuuuuaguagagacgggguuucaccguguugguuaggcuggucuugaacuccugaccucaugauccacccgcgucggucucccaaaguauuggaauuacaggcgugagccaccgugcccgaccugacuaaucuuuuuuuccuuuuuuuuuuuuucuaaaaagggccaguccaggcgugguggcugacgccuguaaucccagcacuuuuggaggucgaggcagguggaucaccugaggucaggaguucaagaccagccuguccaacauggugaaacccgucucuacuaaaaauacaaaaaguagcugggcuugguggcgcgcaccuguaaucucagcuacucgggaggcugaggcaggagaaucacuugaauccaggaggcggagguugcagugagccaaggucgagccacugcacuccagccugggcaacagagcaagacucgucucaaaaaaaaaaaaaaaagaaagaaaaaaaaagaaaagacuaguugaaagcaguugugagaagaaaggaaagaguagaacaacaaguucgaucuguaacuaacugugaaccaucaauugagauaacucacuacuuucagaccagccugagaaaacauguuugaaaacccuccguuuuccaucuguggcauucuggaauaaucugacuuccgaagagugaaugagauagaaaagaagcccuggacgcugggcaggauggcacacaucuguaauuccagugcuuuuggaaguugaggaggcaggauuguuugaggcugggaguuugagaccagccuggguaacauagaccccaaugccccgcuaucucuacaaaaaacuaaaaaauaaaaaauuggcuggacauguuggugcaugccuguagucccagccacuugugaggcagagacaguaggauugcuugagcccaggaguuugaggcugcagugagcuagguucguaccacuacacuccaggaugggugacgaagacccuauuucuuucuuuuuuuuuuuuuuugagauggagucuugcucuguugcccaggcuggagugcaguggcgcgaugucagaucacuacaaccucugccucccagguucgagugauucuucugccucagccucccgaguagcugggauuacaggcacucaccaucaugcccagcuaauuuuuguauuuuuguagagaugggguuucaccacauuggccagacuggucuugaacuccugaccucaagugauccgcccgccuccaccucccaaagugcugggauuacaggcgugagccaccaugcccggccgaugaagacccuguuucuaagaaaaaaagaggcccuggaauauuggcugugguagauuucaugagcaacagaaaucuguccaauccaaaaucacccauguauuaucccuaugucuuugguccuagagaacaugagcuuguuaugcaucucaguuuuguucuuagaacccuuuuaguguuacugacugcuauaagauugucugcaaugcugaguccuuaacccucagaggggcaagaccaggaaucuuuguuucaucuuaaagucuaaggacaaaaacuccuugagggagucugaggcagguagcccuucugucacguuagaggagauggaacaggauacacuuauuuugaguuccuucauuuacauguuguuuguuagguaguguuuguggccacaggagaacucuauuauuagcuaccuacgggaggauuccaugugaagacaaucuuuuaguaauauacaugaaaccaucugaguaaaaugugggccucucuguuguccauuauucugucugauuuauugaagcccaaguuaggcuguguuuagcaugaaaguuucaagaugauccuuuguaguccuuuggaaguuaaaaggaucaaagaccgagauauaucuaaggacggucaucccuuagcaccuuuggccauaguuugggucauuucagcacucugaaaugggucugugguuuggaauuagacugaggagcuugagcaauaggcagugcgggguggugggaaaaaauugguuggaggucaguagacaggcuuggauuccaaagauagcugucucagacuuaaucauggaacucagguuccuuuuauguaaguccuccuucuggaaucugccaucaggaguaagcuucaaaauuaacuccaaguagcugaaaauguuggacuguuagguaacauuacucaauauugacuuuuggauguuggaaaugccuguaaaaauggcaguuuucauuuugauguaacugauccugaacuaacuuuguugauaaaauaguugaaaguagagucuugggugguuuguuggcacacauaauauuuaagauuucaagauaacuggagucuuaaaacucccauccccccaucuccguccccagacuugccagaguugcaccaugguugcuugagaggguucuguuuagaauuccauagcauuguuuaucauaacugcuuugcuugccaacacccugacaauauaggcagguaaaaacaggaacccagaccuuuguuguaaguacucauaagucauugcugagcugccuguguagauaauuguuuaugcucuuauccuuuuauguucuuauccuuuuaucauagccuguucaucuaauuguuguugucaucuaauugcugauguuuuaacccaaccaggcauaacuauguaucuuuauaucuuguuugcuagccaguuucuuuuuuuuauauuuuuaauuuuuuuaaaaauuuuuaauuuuuguggguacauaaguggguguauguauuuaugaguuacaugagauaucuugauacagguaugcaauguguaauaaucacaucaggguaaauggggguauauaucacgccaagcauuuauccuuuguuacaaacaauccaauuauguaguuauuuuauuuuuauuuuuuauuuuuuuuaggcagaguuucauucugucacccagucuggagugcaguggugugaucuuggcucacugcaaccuccacuuccuggguucaggcgauucucuugccucagccuccugaguagcugggauugcaggugcccaccaccauaccuggcuaauguuuuuugcauuuuuucaguagagacaggguuucaccauguuggccagacaggucuugaacuccugaccucaagugauucacccgccucggucucccaaagugcugggauuacaggcgugagccaucacaccuggccaaguuauuuuaaaauguacaauuauuuuugacuauagucacccuguugugcuagcaaauacuagaucuuacucauucuuucuaacuuuuuuguaccccuuaaccaucgacacguucccccaccccugccuacuacccuuccuagccucugguaacccucccucuacucucuaucuccguaaguucaauuguuuuaauuuuuagcuccuacaaauaggugagaacaucaaaguuugucuaugucuugcuagcuaguuucgucauguauuggugacaccugugacaaauaaucaccuuuauuuuguaauuaccaggaauaaaggucaguagguaauuacuaauugucuauggcagugguucuuggacuuugguguacaucagaaucaccuggaggaguuguuaaaaaugcacauuccugugcccuguucccaguugcuguuucaguguaucugaggugggacugguaacuugcauuucuaaugaguucccaggaguugcucaugcugcugcugugggaccacacuuugagaagcacugguuuacucugaggcagguacuguguguggaagaaagugguauaaguuauggucucuggccuugaagagccugcuuuugaguugugaucuguacuuauaugaagguagaccuaaguuugaagcucuguaggcuggugccaaaugagccuaagaaguucagaucggggguaaucauuaguagcugaaaagcccggaagcuuuuacagaacuguuguggguauuugagccaggcacuuaaagaucagugaguggcacauucccagaaggaaaacacuuuuaauacagauguggaguuagaagugucgcuggcaguuucaguggguagcuugucacuuugaguugguggguauuggauggugguaaugggaaauaagguuuggaaaauuauuggggucagauuguguuggagguugaauacuuuuggacuucauuugguacccgugauuagccauugacuaggcccuguugaggacuggcgguggaggggugugggaagagaauguaucagaaggagaaaaccaggucuuaacuuuguuguugcauucuucggcucccaggccucaggguuuuuugcagggggugggggaauugguucuaaaaagagaaaaaccuguuuacuaguggaaaccauuacgugauuaccaaugguuuacugaaucuugacaagauuaauugugauuauuuuaaaucccuggggcaaaaauggguggggcaugaauuggcucuaagaugcaaaauuugaaaguguuguuuggguacaacuaaugagaacuucuguaguuggacaccuuauuugggaagauaagauuaucuggguuuccagcuuaagguuuuuagcagggacggaucuuuauugaauaauuuuuuucuaaugggaaaaaacuaacaguguagcagaaaaaaacuaacaauguagcagcaaacauuuuguguuuugaccaagucucuauuuuagaacauuguaucaugaacauaauucaaauggauuuugaguuguggaaauagaacacaucucuugaaacacaauaccuuuagcugaaugauguuccuuuuuuuuuuuuuuuuuuuuuuuuguuuuuuuuuuggagaaggagucuugcucuguugccuagccuggaguggagugcgauggcaggaucuuggcucacugcaaccuccgccuccucaguucaagugauucuccugccucagccucccgaguagcugggauuacaggugccugccaccaagcgcggcuaauuuuuuguauuuuuaguagagacagguuucacuauguuggccaggcuggucucgaacuccugaccuugucauccgccugccucggccucccaaagugcugggauuacaggcgugagccaugauguuccuuuuaaaacuugagagcuauuacugcccccgaucccggaacguaaagauuaaauuauaaaagugaaaaauucaccaaggaauaaauaagucugcauuuuacucacuuucuuaauuguuuuacugcucuuuguucuucacuuaaauucagugaaauuuuuuuuauuuuaaugaagcaucuaaaaacaaguuuauuuuuuugauggauuucaauuuacguagguagaaaacuaaucuuaacuaagaaaugaagauaagcauacuguuaucuuggacauaaguaagacugaauaugauucuuaaacaguuuuaaacuccuauaagcuuauuaugugguuggagaucccuuguguuuauacuuugaaaaguuaccacuuuucaugaaauugugaguuaaaaucaugauaucuucuugaauuuuagguacuuacacugugaaauuuuaugauggaguaguucagacugucaaacauauucaugucaaagcuuuuuccaaagaucaggugagaaaugugguuuugugcuuuguguuaugaauaaugcuaacauuguaguuuuguuuccucaaauaaagacauuacauuuguuuaugauagcaaguguuuauuuccuccaucugacacaauuucaccagaaaauaauacacaaguuuucagaaguuguaaauauuugucucuuugcuguuuccuauuuauuuauuuguuuauuuagaaacagagucccgcucugucgcccaggcuggaguacaauggugcgaucuuggcucacugcaaccucuaccuccuggguucaagcaauucuccugucucagccuccugaguugcugggauuauaggcgcacgccaccaugccuggcuaauuuuuuuguauuuuuaguagagacgggguuucaccguauuggucaggcuggucucgaacuccugaccucaggugauccaccugccuuggccucccaaggugcugggauuacaggugugagccacugugucuggccacuguuuccuuuuaacagagauuuuuuuucaaaagugccaaaugcuuggauaccauugccuauauucuguucuccuaaucuuuuuucaacaaugguuauucuuuucuucucucugugcccugcgccccacaagagcuguuagccauacaggaaacuuguugaauugcuugaggagaccuccaguauguuuucuguccaucuagcucugucuuuuagcuuaggaccauuacuuggugguuuacagagcuaucauuuggcacagauuuggcagccacuugugcuagaugugccugguuugugauuuugguauccuguuguuccagucaccaugcauguacuugccugagcauggggccucaguuuugguacuggaaauaugguuugcauagauacgggccaucuagaaguguugccuacuuucuucaugauuuuuccccuuuugucuuuuucguguuuauguuuuaauaguugaggggaaaauagagaucaaaauuuggauauuagucuuuuuaaaaauccugauuauuacuaauuucagcuguugagacagcuaauuuagcaauuuaguaaaagauuuuaucacugaggcaucauaacuugcuacucaucugcuuggauaguaguugaugugacaauauuuggugaugcuauaaccuguugugucuuugguuuuugguuuuuuuuuuuuuggagacagagucuuguucuguugccugggcuggugugcaguggcgcaaucuuggcccacugcaacuuccccgccuccccaguucaagugauucuccugccucagccucccaaguagcugagacuaggcgcgugccaccacgcccggcucauuuuuuguauuuugguagagacaggguuucaccacguuguccaggcuggucucaaacuccugaguucaggcaaucugcccaccucggccucccaaaaugcuaggauuacaggcaugagccauugcgccuggcccucuguugugucuuugugaugaugaaaugauucuacuuaucagagauuuuuaaugaauucuucuguauguauauuuguaaguuguguuuuuuuugagaccgagucucugucugucacccagacugaagugcaguggcccaaucucugcucagugcaaacuccgccucccaaguuaaagugauucucgucucagccuucugauuugcugggauuacaggcaugugccacuacgccuggcuaauuuuuguauuuuuaguagacgggguuucaccauguuggccagggugguccugaacuccugaccucaagugauccgcccaccuuggacuccuaaagugcugggauuacaggugugggccaccaugucuggccuauucauaaguuucuaagaaauuuuuuuuuuuuuuuuuuuuugagauggagucucacucuguagccuaggcuggaguacagugaugcaaucuaggcucacuguaaacuccaccucccggguucaagcaauucuccuuccucagccuccugaguagccgggacuacaggcaugcaccacuaugcccagcuaauuuuuguauuuuuaauagagauggggguuucaccauguuggccaggcuggucuugaaguccugaccucgggugaucugccuaccuuggccucccaaagugcugagauuacagggcaugagccaccaugcccagccgauucaaaggauuuugauacaugauaccuuuagugguaaccucaagaauguuuuugccuuuugcugguuuuccuuuucagaaaauuaacaaaauuauuacauaaagcuuuggcccugaugaugcuuuuucuuuguucacuugucucucuggcauguaaggagccauacaguacucuaaaacauuauuuuggccuuaaauuuggcaauuuuuguguuagguuuguagaacgaguuaauauagaggacagaauuauaaacuuguccagaauuggcagguuauauccagaaccuucccaaguggaaguccagggcucuagauaacaauuguucaucuguuuacucugcgauacucaguaaauugauggauagcacucacagugcuuuggcuuggaggugggugccuuacccagugaggauuucugggugccaugcuucauuucucauuucccaauggccucugagugucugaccuuagcccgguaggcccuuaagcacaggcccaaggcuccuggacuuggcuucuuuuccaagaggguacagugguuuggcuagaguuaucugucaugggcaauuucaaagguuuuucguauacuauuggaauagauugaguuuuuuuuuuuuuucuguaggacugcacugccuuauaaauguuuugauagucucuauauuaguaacacuuauguuuuugaaguuauaauacguuuacuguagaaaaauauauaaguacaaagcacaaagaaaauaaaaacuauaauuccaucaaacagauaucauuguucuuaacguuuugguguguaacuugacuuaacaauuugauguauacaucuuucuguguuuuuuauuaaacguacguguguguauuuauuuauuuucaaaauuggaguugugguacauuaauauaguacugcucuuuuaacuaacauuuccccauguuccuuaauauucugagaauauaauuuuuaacagcuauguaguauucuguaauauguauguaacuacuuuguguaaccaauucccaaauggucauuaaggauauuuguaaauccagguacacaagucugauuauuauuuuagcuaauuuuauuucuaggaauuuauucuaguucaaagguauaaccuuuuuaguuuugacucaaauugccaucuccucccugaacucccaacaagaagggcaauuucaguuuauauuucugcuggcuguuaccgagaaugccuguucucaaaccuggcugcuuucagaauaguuugggggacuugaaaaaauauuuccuuguuuauuauuuuucccuguagaacaaauuaaacuuuuauuuguugaguauuuagguacuccuuccugcuuccagugaaaaccuaugugccuagugugugcuaggugcugggcaucccauaugaacauaguaugguggucucugcucuuuugagguccuagaagagagauauguacacaaauaaacuuaauuauaguuuuggaaucucuagagcuuucagaccuggccuuauuaugaaacagucacaauagaggacccucgauuuuuagugugaauuuuaaagaauguaauuuagggagaacauaacuaagaagcgguauuuccuaccaauagacaaaaacuccaaguagcucaggaacauaguagguggcuuguugaacugagcacagccuuuaccugauagagaaagcagagacccugguucuggguuggauaaucuuuauaguuuuccuguuaagcuuccaguuaucaguuuuuguuuuucuauagacaagacaucagcauuugcuggcaaacugaaccaggccucugaaaagcucugggucaguauagucaugcuggggauaaggacagagcaugaaggcauuuucuucgaacaccuuugucagaaagauugcuuuccagaauuuuaaggccaggcauggugacucaugccuacaaucccaauacuuuaggaggcugaggcaggaggauugcuugagcccaggaguuugagaccagccugggcaacauagggagacccuauugcuacaaaaaauaacaauaaaaaacuuagcuggguguggugaaacaugccuguggucccagcuacucagaaggcugagaugggaggaucgcuugggccugggaggucgaggcugcaugagccaugauugugccacugcauuccagccugggcaacagagagagacucugucucagaaacaaaaacaaacaaaaacccagaauuuuauuuucuagugacuuauucgucauaauaagggagauugcacugucuccggaauaauugaauuguuuuaaguuuaaggauugguucucaacucaguacagguggcuguugucaguggugcuuuguauaugugaucuggcguaugucuuguuuuaauuucuuuguuugucuucauaaguuuguaagaaacuccuaauuuuguauuugcaaguaaucacgaaguguuucaucgcuauuuugcucauuuuagaauauuguggguaaugcuaggccuaaagaaacagaucacaaaagucuuucaucaucuccugauaaacgagagaaguuuaaagaacagagaaaagcaacagugaaugugaagaaagacaaagaagauaaacccuuaaagacagaaaagcgacccaagcagccugauaaagaaggaaaguuaaucuguucugaaaaggggaaagugucagagaaaagucuucccaagaacgagaaggaagacaaggaaaacauuuccgaaaaugacagagaguauucuggagaugcccaaguggauaagaaaccugaaaaugacauugugaagaguccacaagaaaacuugagggaacccaaaagaaaacgaggcagacccccuuccauagcuccuacuggugaguuuuuuaagugggcucugcaaugggcaaugccagaguauucuucuguggcccuuugugguucuuuguaacuuguguacgucaaucguuuauuuuugugacugauuuugaauugucuuaugaucuggaaacaaguuguguucaugaagcugaauuuaagugagguacauauccaagugaaucuaaguugggaagcauguucauaacugaguuugcuaaaguagugguuaacuguugacuagauacuucagcuuauaugauaaaaccugauaaaccgaggccuuuugcuuaugcuuuuucaaaugaucucaguuuaagucagcuuaauagaaucuagaaucaggaaauagaguuuuaaugagacagacaugaaagaaaaguaauaguaaaaagguaugggcuucugaaggagauggggacaaaggaacauugaaacuagaaaagcaugggugcauuuugaaauugagcuccuuggagagugauuauugauuagaaauuuucacagucuaaauaaaaagccgagauggcuaauugguaagagucaagguuagaggguauagauuuagggaagaaugcaguuauuaaaaaacuuaaaauuuggaauucuucuagaauaaccaagaaugaaacaagcccugauuucuuccuaagccaaacacucguucuccaaaucaauucaauggcaugaagaggcccccccgguucucuggacugagccugccauugauuaauaugugcagugaccuucagacauucuugauugugcauucuuuauguguucaguugaaaaacugugaauccccuagcacguuuuaaagcaguauuuaucuuuuucucacaaguuuaaauagcugcaguggauacauuuaaaauacaaaacaugaaggcugagugcguuggugcauguuuguugucccagcuacucaggaggcugaggugggaggauugcuugagcccaagaauuccaaaccagccuggacaauguagugacaccccaucucaaaacacacacacacacacacacacacacacacacacacacacacacaaauauuuucaucaaaacuguggaacuacagagcaaaccuuuucauuauucccuaacgauguagagaaugcaaagccagucuuccuuaucaaaucagacuaucagacuuaauuucuguggaaaaaaauuuaacuuacuucacauaaguguauuaguacucauuguaagauaggaaauuauauaauagguugauuugucucuauaugaaauaagggaucuuucccuguagugcuuguaacuggguuuugcccucaagagcugagggugcugcaauugucuguaggccuaaauagggccuagaccucugcugucuaguaugguagccacuagcugcauggggcuauugacuacuugaaauguagcuagucugaauugagauaugcuguaaguguaaguaaaugcuagauuucaaauacuuaguucaaaaaaagaauguaacacaccucgauuuuaaaauacugauuacggcugggccuguaaucucagugguuugggagguccaggcggguggauuacuugagguuaggaguuugagaccagccuggccaacauggugaaaccccgucucuacugaaaaaauauaaagacaaauuagccaggcuugguggugggugccuguaaucccagcuacucaggaggcugaggcaagagaauugcuugaaacccaggaggcggagguugcagugagcugagaucgggccacugcauuccagcuugggcgacaaaacaaaaaaaaauugauuccauguugaaauguuuuuagaggcugggugcagugccucaucccuguaaucaugccagcacuuugggaggcugaugagggaggaucacuugaguccagaaguucgagaccagccuuggcaacauagugagaccucaucucuacaaaaaaugaaaaaauuggcugagagugguggcacgugcuuguagucccagcgauuccagagucugaggcaggaagguugcugagcccaguuuaaaaaaaaaauuuuuuuuaaaguacuggauuaaauaaaauaguauuuaaauuaacuuuuuaaguuguguuuuuuuuuuuuuuuuuuuuuuuuugacagggucucacucuguuaccuaggcuggagugcaguggcgugauuguggcucacuccauucuccaccuccuaggcucaagcgaugcuccuaucucagccuccugaguagcugggacuacaggcacaugccaccaugcccagcuaauuuauuucuuguagagacaggguuucacuauguugcccagguuugucucaaucucugggccucaagcaagcaauccugccuuggccucugaaagugcugagauuacaggcaugagccaccaugccuggcacuuaaaaaccaaacccucuuaugugaugaguaaaaaauucaaaauuggccaggcgugguggcucaggaauuugagaccaggcuggccaacauggugaaaucccgucuccacuaaaaauacaaaaauuggccgggcauggugguucaugccuguaaucccagcauucugggagaccaacaugggugggucaccugaggucaggaguucgagaccagccuggccaacauggugaaacccccaucucuacuaacaacacaaaaauuagaugagcgugguggcaugcaccuguaaucccaccuacuugggaggcugaggcaggagaaucucuugaacccaggaggcagagguuacagugagccgauaucgcaccacugcucuccagcuugggugacagagcgagacuccaucucaaaaaaacaaaaaauaauaaaauaaaauaaaauuacauguggcuugcacucuuaguauauuucuguuggacagcacugacuuuauguucacuggcuuucucaacugaguuuugggagagaagccacaauacccaaggcauccuugaucugugauggauugaccuuagugcauugagaaugguacuagcuguauaccacccuuaggaaaacagagaaaauauaucucuguucagauggggaaccccaguugagaaaaucuggaaguuuuaaaccuccaggcugagcaccauguuaagaugugggaugagugagaggcaggcccuuuuauguaaagugggagaagggcaguuaaaggcaguuauuauacaaggagagguggaaaauguaaacuggcagaaaucugacauguccuuaggcagaaaucugacauguccuuagcucaguuuaggaaagaguauguaugagaauugaguguuuugaaacuaauucuccuuuagguauucaugcccuggcuuauacccuccagaagguauguacagaaguaguuguaccccaacaagcagacugcuccuuugaagccacaugacuccauugagauaagaacaaggacauucaguuuuuauauuuuuauaaguguaggauuucauaaugaguaggauaaauuuaauauagaagggauguuuucuaaguuuaugguuaauccuugcccaaggcauuugugaaaacagauuccagccaugccucaguucuuuuccagucagacugucuggaugggaaucugggaauaugaauuguuaacaagcuucccagaugacuuauacuguaagaagaguuugggaaacacucaaguucuguacagucagcuccuauuuauauacgguaucaaagggaagaagacuugccaaguaucccauauauuguucacauccccuuaaaacauuacuuggaauaaguucauugauuuguagagccuuccuugagcacccuagauuguauagacuugauugggaacaggaucugagcuauuuagagaggguuguuuauauauauuuuaauuuuuauuuuuuugagauggagucuuacucugucucccaggcuggagugcaguggcaugaucucggcucauuguaaccaccgccuccuggguucaagugauucuugugccucagccucccaaguagcugggacuacaggcaugugccaccaugccuggcuaauuuuuuguauguuuaguagagacaggguuucaccauguuggcuaugcuagucuugaacuccugagcucaagugaucugccugucucugccucccaaagugcugggauuacaggcgugagccaccacacccagccuguuuguauuuauguuuaacuuggaaugugugggauuuccaaguucugccaguuggaacaaaauaauauuggcccauugggaaguuggaacacaggaagagccucagaguucaacagucuucucugguuugcuuccucacacuucaggccgugucuuguugagccauuugaccgaccugaagcuacaggucuuagaugagucuuuucugucccucuuccccucuucucaucuuucucccuucccuuccucuuuuccucccauuuacuucucuucuucccucuuccuuuccuccuuccucuucucucuccuccuuucacccuuccugagaccccuuagcucugccuuccugcccaacuucccaguuucuuucuucugccugccuuuucaauucucaucuuuucugauuugggguaagcuucuuaggugguagguuuaaaacaaaauaguaagggcugggcaugguggcucacgccuguaaucucagcacuuugggaggucaaggcaggcagaucaccugaggucaggaguucgagaacagccugaccaacauggagaaacccugucucuacuaaagauacaaaauuagccaggugugguggcgcaugccuguaaucccagcuacuugggaggcugaggcaggagaaucacuugaacccgggaggcagagcuugcggugagcugagaucgcaccauugcaguccagccugggcaacgagagcaaaacucuaucucaaaaaaaaguuaauaguaaauacuaugcugggcagguggcucacaccuguaaucucagcacuuugggaggcugaggcgggcagaucacuugaugucaggaguucaagaccagccuggccaacauggugaaaccccaucucuauuaaaaauacaaaaaaaaaaaaauuuugcuagguauggcaggugccuguaaucccagcuacagggaaggcugaggcaggacaaucacuugaacccaggaggcagagguagcagugagccgagaucgugccacugcacucuagccugggcaacagacccagacuucaucucaaaaaaacaagcaagcaagcaagcaagcaagcaaacaaaaucuaaauaguaaguacucuucaaaggcuuagcgucuguacugcuaaauuaugucagagcuggguuugcuggggaccagcagccuugccugaaacauugacuguuaacuagcauagucucccaagaauuuuuuuaggauuuuguuuaagaaaauacaaauucucggcugggucucauggcucaugcuuguaaucccagaacuuugggaggacgaggcagcuggaucacuugaggucaggaauuugagaccagccugaccaacauggggaaaccgugacucuacuaaaauuacaaaaauuagccggguguggugucgggugccuguaaucccaccuacuccggaggcugaggcaggagaaucguuugcaccugggaggcggagguugcagugagcagagaucgcggcacugcacuccagcuugggugacagagcgagacuccaucucaaaaaaaaaaaauccacaaauucucuuggacauuuuucuuguacccucaaaacuaggcccagugcuaagauaauuaauguagcaaguagagguugaaaacuggagcuggaucauagaaaagauucaggaggucaauuggcaagguaucaccaucuccuguaaggaaguaauuucucacucauuuuacuuuuuuucuuuuaucuuaaguaagaaugcccuuuugauggcccauuuauaaugcagugauuucugcauauauauauguauauauguuuuauuuauauauaaaaaugacagacacuaagaaauuauguaucuuuuuuugugugguuuuauaaacaugguagcuguggauucaaacucucaaacuuugcaaccaauaacauuggaacugagaagaaggaaaauaucaaaaggaugugaagucccauuaaaacguccucggcuugacaaaaauucaugugagucuacaguuuguuuauguguggcuagaauuugacguuguuugggucaacuuccucuauauucauccugucccccauucccuauaggcucuaauguuugucucuggucacaugagguaaugugaguuggaugcaguuggaucagaaggaguuuuugcuagaagaaaaauaaaucccaaagcacaaacuguacuaauguuggguucugugguaucaucuccauauccauaaaucacauuugauuuggaugccacuggaaauuuaauggcuuaggaagggauggguuucauaugcagagugaaacuuuaaaaauacuacuuauuggccuggcgcaguggcucaugccuguaaucccagcaguuugggaggcugagguggguggaucaucugaggucaggaguuugagaacagccuggccaacauggugaaacccuaucuuuacuaaaaauauaaaaauuagccggguguggccaggcgcgguagcucacgccuguaaucccagcacuuugggaggcugaggugggcagaucaugaggacgggagauugagaccaucuuggcuaacauggugaaaccccaucucuacuaaaaauauaaaaaauuagccggguguuguggcaggcaccuguagucccagcuauucaggaggcugaggcagaagaauggcaugaacccgggaggcggagcuagcagugagccgagaucgcgccacugcacuccagccugggcgagagagcgagacuccgucucaaaaaaaaaaaaaaaaaaaaaaaaaaaauuagccgggugugguggcgggugccuguaaucccagcuacuugggaggcugaggcaggagaauuguuugaacuugggaggcagagguugcagugagccaagacugugccacugcccuccagccugggugauagagugagacucuguccuauaaaaaauaaaaauacaaaauaaaauacuauuuauugauuuaaaaaaauacccucuggagugaguuggcucaaauguuuaaauaaauuuaaaauaaaauaguauccuguuggcuccaaaaaggauuugugauagcucuaaguaaggcucuuauaaaccuuuuuaagucgacuuugcaaguuaguacauuugggaagccccaaaauagaacauaguugucaagauucggacaugaccuagcacauguuuucagaccaugaauccuuaaagaagugaaauucuauccuggcagggacacuuuucccuuacuuaaaacuguaaacuaguaaaggguauuuccuuuuaucacuacucuaacauuccaguagucucucuguaaaguccuuuuagagacauccagcccugaaaucuguaguagcacaguuauuucuucuuguuggucucuugacuacaacucucuuaaugguuuaauagcccaggaaaagucaaaaaacuacucggaaaacacugacaaagacuuaucgaggagacguuccuccaggcuguccacuaaugggacccaugagauccuagauccugacuugguuguaucagauuugguugauacggauccuuugcaagacacguugucuaguaccaaggaaucugaagaaggugagucagucuguucaggaauugucuugccaaccugguuccuauuuagugagaaucaauguaaaucauuauguucugccuuccacaaguauuaaauugucuugaaaucaaacuauugaaugugcugcaguguuuuuauaauguauugcucuucacugaugauuuauucaauagacauacuuucuggaugcauuugugguugguuuugcuuaucuaccguucaguguuggccuggagguacacuguucgaagagcccugcuucucucucucugcugccaucucauucgugccuuuguguuuauacuuccagcuauuuuuccuuucacuuuaaccucuuucuuugagaagcucacaagccagccuguauguaugggaaccugugaauguaugcuuuuauguuuuagauuaauuccuuccucuaaaaagucccuggcuuucuuagacuguuguaggacuuuugauuucagaauuacauacauguauauuucccccaaacuuucuuuuuuucuucuaggucaguugaagucugcuuuggaagcuggccaggucucaucugcacugacuugccacuccuuuggggauggauccggggcugcaggcuuggaguugaacugcccaucaaugggagaaaacacgaugaaaacagaaccgacuucuccccuuguggaauuacaagagauuucgacuguggaagguucauauuuagaguuaaauuaauccucuuuuuauauacacuuuugcuuaugcuuugugaacuaaaaaaaaaaaaaugacuuuucuguuguuguuuuucaccuuuuauuaauauucccuuaucauuuuaauguuaugcuccuuucauuucugauuuugauaauuuguguucccucucuuaguaugacuagggcuuuaucuauuuuguuuucaaagaacuaacuuuuuacuucaauuuucucuauuguuuauuuuuaaaaauauaauugauuucuguuuugaucuugcuuucuuccuucaauuuuuucuagaacuuuaccuaauugauuuuagaucuuucuuccuuuuuuuuuucauuaccuggugaaaagaucuuucuuccuaauaugaguauuuaaaguuauaaauuucuggcugggcgcgauggcucaugccuguaaucccagcacuuugggaggccgagguggguggauugccugagguggagaguucgagaccagccuggccagcauggugaaaccccgacucuacuaaaaauacaaaaauuagcugggcaugguggcaggcaccuguagucccagcuacucgggaagcugaggcaggagaauugcuugaacccaggaggcggagguugcggugagccaagaucaugccauugcacuccagccugggcagcagagcgagacucagucuaaauaaauaaauaaauaaugaaauuauacauuucccacugagaacugcuuuagcagcauccuacacauuuugauacguuguguuuuuauuuuuguucaauuuaauauaucuugugauuuauuuguugaccauggguuacuuagaaguauguuguuucaguuugaaguauuuuauguuuuuguagauaccuuauugcuauugauuucuaauauaguuuuacuguggucagagaacauacucuguaggauuucaaucuuuuuauauuuguugcgauuuaauuuaugguccagcauaugaucuguccuggugaauguuucauaugcacuugaaaagaauguguauuuuaccguugucauguguuuguucuguaucugucaguuagaucaagguaguugaugguguuucucugauaaauugauuuuugugggguuuuuuuccuuuuggucuaguucugucaauuucuaagagaagguuguuagguuguuaaaaucucuguuauuguggauuuguucauuucucccuuuaauuuugucauuuuugcuuuguguauuuugaagaucuuuuagaugcauacacauuuauaauuuuuuuuuuuuuugagacagaaucuugcuuugucacacaggcuggagugcagugguugaucuccacucacuucaaccucugccuccuggguucaagcaacucucaugucucagccucccgaguagcugggauuacaggagugugccaccacgcccagcuaauuuuuguauuuuuaguagagacagggucucuccguguugaccagguuggccucgaacuccugaccacaggugaucugcccaccucggccucccaaagugcuaggauuacaggugugagccacuauuucuggccuaaauguaauuguugauaugguugguuuuuaggcuaacauuuggcuguguuuugucuguuuuuuuguuuuuuuuuuuuuuuuuuuuaagacagagucuugcucuaucgcccaggcuggagugcaguggugcgauuucugcucacugcaacgucugccucccggguugaagcgauucaucugcuucagccuccugaguagcugggauuauaggcacccaccaccacaaucggcuaauuuuuguauuuuuuaguagagacgggguuucaccauguuggccaggcugguugucuguuuauauuauuuguguuuuguuguuuuguuucuuguuuuuuagguuaacugauuuuuuaagaauuucauuuuaauucaucuguuagcuuuuagcuguauuucuagcauuuugaaagagguuacucuauggauuaugguauacauccuuaacuucucacaguucacuuagaguuaauauuuaaccacuuuauguaaaaauguuccauuaaccucccccauguuguaguugucacaugaauuauaucuguauaugcuauaaauuccuuuuuaaaaaauuuuuuauuuacauauuuuuuugagauggcauuucacucuuguugcccagguggagugcaauggcacgaucuuggcucacugcaaccuccacuucccagauucaagugauucuccugccucagccucccaaguagcugggauuacaggcaugugccaccacgccuggcuaaauuuuuuuuguauuuuuaguagagaugggguuucaccauguuggucaagcuggucuggaacuccugacgucaagugaucuacccgccuugacuucccaaaguacugugauuauaggcgugagccaccacaccuggccugcuauaaauuucauaauguaguauuauaaguuuugcuuuacacaauuauguauguuaaagacgauaaggcaaaaagcgacagucauauuuacacaugccuauuuccaauguucuuuauuucuucgaagauuucuuuucagcaugaagaauuuccuucagauuuucuuauagguuccugaugacaaauucuucugguuuuuguuaaaacuugacuuuuuuuuuuuaaagauagagucucacucuguuucccaggcuggagugcaguggcacaaucacagcucagagcagccuggaccuccugggcucaagugauccuccugucucagucacuugaguagcugggacuacaggcgugugccaccauguccagcuaauuuuuuuucuuuucucaacuuuuaguuaaaaaacaaacaaauaagacugugugucuauagaauugucuacuuuuuauuuggauaacuuaaaaaauuuuuuuuugaauaguuuuuuuuuuucuuggccagaugcuauauaguuaacauaaauguaguagagcagcuguuugaaaauagugaaucucagcacucugggagguugagacuggagggucacuugaggccaggaguucaagacucgcuauauugaaggccuugcaucaacauagugagacccucccucuucaaaaaauaaaaaaauuagccuggcaugaugguucaugccuauagucccagcuacuugggaggcggaggugggaggaucacuugaaccagggaggucgaggcugccuugagcugugauuguaccacugccagccugggugacagaggaagacccuaucuccuaaaauauuuuaaaaaauuggccaggggugguggcucacgccuguaaucccagcacucucggaugccuaggcgggcagaucauuugaggucaggaauucgagaccagccuggccaacauggugaaaccccgucucuacuaaaaauacaaaaauuugcugggcuugguggcgcacgccuguagucccagcuacucuggagauugagacaggagaauugcuuaaacccagaaggcagagguugcagugaguugagaucgcaccacugcacuccagccugggugacagagugagauuccaucucaaaaaagaaaaaaaaaaaauuaaaagaguaccgaaguauucauuccuagcucaucucggcggcuguucucuuaguucucugucuagcuucguccauaguguugugcuucagccucgagggcuugucggggcaagggaucuuccuuuuuuugcuacuccuccucuuagugucagggcucuuuucuucccagccugcucuucugacauguggggcaaauuacuaaaguucauauguaaaugagguggaaauuuaaucucggaauuuaguugucugucuuggcagggagaacucuagaugacagccacauccccugugacucagcagacuaagcuuuuaauuauguugucuuaaggguagugguauguuagacgucacuugaaauuuguaguuaauuguuccuacaccacuaggaaacacgccaugcauauaagugaggagacuagauuagaagcuaacuccagugccuuuuguaaaguuuacguauuuuauggggucuugggcuauacuuuuucccaaaauauacacauacauaauuucugucuuguguuagcuaaccuaauuauguuucuggauuguggagaggacagaaucaaguauaguaagggugggacaggugagucuaggggaaaaggaugaugaugagauuucaugucgucgucugcauccuuacaaaggucucacaguagccuuucuaagggaauaauuuugaaaccauugcaacugauugaagcacuuaucuauuuuccaagaggguuaauaguaaggguggaggucaaauuacuuugagcuugagccaagaggaauaaauauagcauggaacccauuacuguauuuuuuuuuuugaaugagguauuugcuuuuugcuuuagugacuuaaaagccagaagagauggccgggccugguggcucaugccuguaaucccaggacuuugggaggccgaggugggcagaucacuugaggucaggaguucgagaccagccuggccaacauggugaaaccccaucucuaccaaaaauacaaaaauuagccggguaugguggcaggcgccuguaauccuagcuacucgggaggcugaggcaggagaguugcuugaaccugggagguggagguugcagugagccgagauugcgccccugcacccagcuuaggugacagagcgagacucuaucucaaaaauaaaaaaauuaaaaagccagagacgaaugcaguugugacuguuguaauugggcaagcauucauuuaugcaguaaaacagaaguuaguaauuccccuagaaguuuagaggucucaggcugggcgugguggcucacgccuguaauucuagcacuuugggaggccaagacgggcagaucaccugacgucaggaguuagagaccagccuggccaacauggugaaaccccaucucuacuaaagauacaaaaauuuggccgggcgcagugucucaugccuguaaucccagcacuuugggaggccgaggcaggcggaucacaaggucaggagaucaagaccauccugucuaacacggugaaaccccgucucuacuaaaaauacaaaaaaauuggccgggcgugguggcuggcgccuguagucccagcuacuugggaggcugaggcaggagaauggcguaaaccugggaggcggagcuugcagugagccuagaucaugccacugcacuccagccugggcgacagagugagacucugucucaaaaaaaaaaaaaaaaaaaaaaaagauacaaaaauuugcugggcaugguggugggcgccuguaauccuggauacuugggaggcugaggcaggagaauugcuugaaccugggaggaagagguugcaguuugccgagaucgugccacugcucuccagccugagagacuccaucucaaaaaaaaaaaaaaaaaaaaaaaagagugagacuccaucucaaaaaaaaaaaaaaaguuuggaggucauauuauuaucugaaaaugggcugcugcaaauauuuagcaagugccuaguaagugccaaugccagacccuauucuuuucuuucuuuucuuuuuuuucuuuuuuuauuuuuauuuuuuauuuuugagacagucucacuguguugccuaggcuggagugcaguggugugauuucggcucacugcaaccuccgccucccagguucaagugauucuccugucucagccucccacuuucuuuuuuuuuuuuuugaagguggagucucacucuuuugcccacgcuguaguacagugguaugaucuuaggucacugcagccucuaacuccuggucucaagugaucuccugcuucagccucagacccuauucuaagcugucucauugguugauacucuacaagaagcacagaauaaacaagagagaaaaacaaauagaaguacagguccauucaguuaaguucuuuuuacuaaauaccugguagaagugggacacuuugccacaggauccagaucagugauucuaacccaugaaaucuugcuguguuuguuguuaguuauaaaacgaaugaauugucacugaaguaucaaaaauuaacagaugauuuacuuauaaauuaacuaguuaagauuuagcaugaugacuauaauaguuuuugcaaauuauuuacuuuuaaauuaaccaguuaagauuuaguguaaugccuauaguauuuuagcuuuaaugaauuuguguucucuaugguuucuugagcaggagagucauagaucuacagccauuuuaguuugggaaauugugugugucuaugguuuuucauaucaucaaguauguauugugauggaaacugauagagaauucauuauucuggggguuagagagaugaaugcgacaucuguucuaggcccuuccaggucuuucuguccagacgaauggaugagacuucagauaccuaugauacaagaaaguaagaugaugucaugacaaacuuagaaugaaacuaugagaauagagagaagaaugacagugaaaaugugugccugcuacauagaaauggaccucuucagguuggcgugugcgagauuuucuugcucuagggagauuguuuaagcaaucacuaugucgacaaacacagauguuucccuuucugaauucauaugaugaagaucagggauccaaacuuauucaaaaagcuaaagaggcaccauucguacuuguuggaauagaagguuuugcagcaauuguugcauauggauuauacaaauugaagagcaggggaaauacuaaaaugucccuucaucugauccacauggguguggcagcccaaggcuuuguuguaggagcaaugacuguuguuauaucauguaucgagaauucugggcaaaaccuaagccuuagaagaagagacgcugucuugcucuuguaggaggagcuuguuuuaguuagacgucucauuauugaaguuacguauuauuguugaaaauaaacuaauuuguauggguuuagaugguaacacggcauuuugaauauuggcuuccuuucuugcaggcuugauuugccuguugacugaauuacuagugacuaguuuacuaacuaggucauucaaggaagucaaguuaacuuaaaagaaacaugucaccuaaaugcacuugaugguguugaauguccaccuucuuaaauuguuaagaugaacuuaguucuaaggaagauaacaggccaacccugaaguacucccaguuugcugcagaaucucacauauuuuggauguuauagaagaguccuauuugcccuaguuaauuuaacuuuuuuuuugccuguuuuguggacuggcuggcucuuuuagaacucuguccaaaaagugcauggacuauaacuuguaaagcuucccacaacugacaauauauauaugugcauguauuuaaaccaaaucuggaaaacuuacaauacagcugcauaaugguaguauuuauuaaagaaucacaauuguaaacaugagaauaacuuauggauucuaguuuaguucuuuaguaauugcaaauuauauuuuugcuguuguuauauuagaauaauuuuugaaugucaucuugaaauagaaauauguauuuuaagcacucaugcaaagguaaaugaacacuguuuaaaugugugcuuugcuuauuuuuucuguaacaaucguaaacauuaaacugaacaaauuaccuacaguaguuuugauuaaugaccuaagagcaagcugguuuggccagacaguguacccaaacuuuuauauaccaucgaauguuauuacacuugugaaauucuccugucuaaccugaauuuacauuccauggugguuacaugguauauguauuauuauuaaaguaagugagccaugucaaaaaaaaaacaaaaaaacaaauugaccucuucaagaccagccugggcaacauggugaaaccccaucucuccaaaaaaaaaaaaaaaacccuccaaaacaaaacagaauaaaaccccaaaaaaccaaauuagccgggugugguggcaugugcguguaaucccagcuacuugugaggcugaggugggagaaucgauugagcccaggaggucaaagcuauaauaagccaugaucauggcaacacugugcuccagagcugugacagagugagacccugugaaagaaggaaagaaagagagaaagagaaaggagagagagaaagaaauuaauugacuucaacucacuuacugagccuuuaccauaugccuaggacugcuaacuguugcguaugcaaagaugagugggcacucuuggacuuaguguucauuaacugcuauuuggauuugcuauuugccucuuggggagaggugauacuuagguuggugcuuuagcggcagggauggaagaaggcgguacuugcacgggaaccugaaggaugggcagcaguuaggcauuugaaaauggaggcaaagcagcuagcacagcaugaccauagggcgauuucugagacugucagguauguguuuugagguaauugcagacuuccugaaguggguuaaggugggguaaguugcugccaaacugagguugguugcuuugaggaauuuacugagaaacugaaaaaugcuucauuuucaggauagggagauagccuguguuggcaggauugcuuuccuuccauuuagcuauuuuguggccauaagguauuuuuucugcauauauuuuaaagaaguuuuuauuuugaaauaauuuguuauuaaaaauguuguuaaaaaaugguacaaagaauauaccuuuaaccaaauuccccaauugcuagcaauuuaccauauuuacuuuauuauucuacucuuuaaaguacuuuuucuagaugggaugcgguggcucaugccuguaauuccagcacuuugggaggcugacgcgggcagaucacuugaggucaggaguucgagaccagccuggccaacauagugaaacccuuucucuacaaaaauaaaaaaauuagucaggcgugauggcacaugcuuguaguccuagcuacucgagaggcugaggcaggagaaucucuugagcucgggaggcggagauugcagugagccaagauugugccacuguacuccagccuaaaugacagagcgagacucugucucaaagaaaacaaaaauuaaaaauuuuuuuuuagaaaguacuuuuucugaauuguuuaaaaauaaguuccagaccuuuaucucuaaauaccuuuuuuuuuuuuuuuuuuuuuucugagacggaguuucucgcucuugucacccaggcuggaguguaguggugcgauuucugcucacugcaaccuucgccuccuggguuuaagagauucuccugccucagccuccugaguagcuuggauuacaggcacgugcuaccaugcccgacuaauuuuuguauuuuuaguagaggcuggguuucaccauguuggccaggcuagucuugaacuccugaccucaggugauccacccaccuuggccucacaaagugcugggauuauaggcgugagccaccgcacccggccucccuaaguacuuuuuagaaaaucccauauuuaauuagcugggcaugguggugugcgccuguaaucccagcuacuugggaggcugaggugggcgaauugcuugaacccaggagguggagguugcagugagcugagauagcaccacugcacuccagccugggcgacagagcaagacucugucuaaaaaaaaaaaaaaaaagaaaaagaaaaaaauauuccauauuuccuaaagacaaggacauucuucuacauuaccacaguauaauuuucaaaaucaggaccuucuucagacuuuaucaguuuuugccuuucaccccauuuauggcagucaucuuguuuuuauucuauaugcuuuuuuugggcaauugaaaaaauauucauaaauuugaaaagaacuccagaaauauacaaggauaauucaacuaacauucuugucucccauagucccauggcccacuacuguuaguauuuggucaugagggccucagggccauacacuggccugcagggcccagcuucuucuggccaccuguugccucaccuuccuauugauucugcugcagccacauggccuccuugcuauccugcaggcauaacuuacggauucuaguugaguucuuuaguaauugcaaacuauauuuuugcugcuguuauauuagaauaauuuuuaaaugucaucuugaaauagaaauauuuauuuuaagcacucaugcaaagguaaaugaacacuuuuuaaauguguucauugcuuauuuuuuccauaagaauuguaaacauuaaacugaacaaauuacccauaaugguuuugauuaaugacuuaagagcaagcugguuuggccagacaguguacccaaacuuuuauauaccauagaauguuauuacacuugugaaauucucuugucuaaccugaauuuacauuccauggugguuacaugguauauguauuguuacacuccuaccucugggccuuguucaagcacacuuuuauugaguacuuuuuauccccagccagagcaaguagauccauugggaacauaucaguaaugugauggguaauauuuauuuauguauucauucauuuauuuguuugagaaggguuuugcucugucauccaggcuggaguguaauggcaugaucauagcucacugcagccucaaccuccugggcuuaagccaucuuuccaccucagccugcugaguagcuaggacuacagacauguggcaccaagccuggcuaauuuuuaaauuuuuuguggagacagggucuagauauauugaccaugcuagucuugaacucugggccuccgccuuggccucccaaaguggugggauuggaggugugagucacuaugcccagcccuaucuucuuucacaauuacauauaauuaggccaggcacaguggcucaagucuguaaucccagcacuuuuggaggccaaggcaggcagaucaccugaggucaggaguuggagaccagccuggacaacauggcaaaacccuguuucuacuaaaaauacaaaaguuuagccaggugcgguggugugugccuguagucccagcuacucaggaggcugagagaggagaauugcuugagcgugggaggcggagguugcagugagccaagaucacguuauugcacuccagccugggugacagaacgacacucugucucaaaaaaaaaaaaaaaagaaaaaagaaaaagaauauaauuagcuaggcauuguggcacacgccuguagucccagcuacucgggaggcugacaugggaggaucucucuaagcccaggcauucgguguugcagugagcuaugauccuaccacugcacuccagccuugacaacagagugagacccugucucuggaaaaacaaaaacaaaaacaauuacguauaauuuauuucauuguauggauguuccauaauuuauuuaccuagccccugcugaaagauauuuaaguucuuucuaacuuuucccuauuaauucucccuguuuuacagacaaagagccuaauauuuggcaugaaggagugaguuagcuagaguggcacacuuccuaauggucaguauuguagagguugguaaaauuaaauuaaauuuuuguuugagacagggucucacucugucauccaggcuggaaugcaguggcgcugucacggcucacugcaguguugacuuccagagcuucagugauccuccccacuguucagccuccuaaaucauugggaccacaggcacucgccgucacuccuggcuaauuuuuguauuuuuuguagagacaggguuuugccauuuugcccaggcuggucucaaacuccugagcucaaccgauccacuugccucggcuucccaaagugcuggaauuacaggugugagccagugugucuggcccagagucuguaacuguuguuuuccugcugagugccuaauuccaucugauaagaugcugggugcuauauaaaucaagugaaaugaacagagucccugccuuuaggggcauugcacaguaugugaugcaaacuucugcucucggggcacucauuaaagcaguguguacacucagaguaagaggcuuaguaggguggcuagauuuggaggguggugugugguacaagugaugucaguacuccaggacuggguggugccuuuugaauucuuugaguuguggaaaaugucuugaucuggaaacugaaugguguuucugguguuucuuuggaaacauagguuuaguggugugaguacaggacgauccagaaagauugcugggggaaagggagguuguugagaacucauucaccaggaauguauuaacguaaguaagcggaaauagggcgggaccaugaccaucuucagaagcauccagccaggucccuggaagcugggaugcugcguuagucacuguuuaguguugcuuuccugagucggugccauagucuugcguuuuuaaaccgagauggagucacaaucugagaaauuggugugaaggaggcucaugggcagcaggaggaggaggagcugggagggcaacacaucuagucuagggcuagcuguuccaaccuaacucuggcauuuggggcagcucugccaccuuguggaaugagugcucagugauuucugugggggcugagugcagagaucugcauuccaggggcuagccuugaaauguucaccaggacuauaugucggugugguuccuuuccuuccacuugaguauuuguggcuucaaaguauuuuuccuacguauguagaugcauauuuuuuccugaauauauuuuuaggaaguuuuuauuuugaaauaauuuagacuuauacaucuauguagcauggguuaaaagaaugacaaaaaauaauuucagauuuauaaaaaaguugcaaaaauagcaaaaagauuucccuuauaccuuucccuauguuggaaaauauagauuccccaauugcuagcaauuuaccauguuagcuuuauuauucucucccagauuuuauuuuauuucauuuuuugagauggauucucacucuuucgcccaagcuggagugcagugaugagaucuuggcucacugcaaccuccaccuccuggguucaagcaauucuccugucucugccucccgaguagcuggaauuacaggcacacgccaccacgccuggcuaauuuuuuuuguacuuuuaguagagauggaguuucaccauguuggucaagcuggucucgaacuccugaccucaagugaucuacccaccuuggccucccaaaguacugggauuacaggcaugagccaccaugcccagcccucucccagauuuuuuaauguaguuuuugaauuguuugaaaauaaauugcagaccuuuagcccugaauauuucaguguguauuuccugaaaacaaggacauccucuuucauucccacaauauaaucaaaaucaacaccuuuuaaaaacuuugccauuuguucuaauaauguucuuuguggaaaaaauggggguaaauuuuuuuuauuucuggucaagauccaauccagauacacacguugaauucagcugucauauuucuuuugucuucuuuaaucugaaacagaccuucagucuucuacuuuuuuuacuggagugggggacaggggaauaagcuuuuuuuuuuuuuuuuuuuuuuuuuuuuuuuuuacuuuuuaaaaaugagaucuucaguuuuugucuuuuaugaccuugacauuacauuucugaauaugauaucccucaauuuggguuuuucugauguauccucauaauuugauuuggguuauucacuuuccacagaaauaccacguaagugauguugugaccuuuucaggugcauucuaucaggaagcacaugaaaaccuguuugucccauuuacuggugacauuaacuuuuaucacuuaccuaagguaguaucuaccagcuuuuucuacuauaaagcuguuauuacccccuuuauaaugaauacauuucuugugagagaaacauugagacuauguaaauaucuuauuuccucaucaaacuuucacccauuauuuuagcaucuacugguauuucuugccugaaacaauuuuuacugugauggcugccaaauggugauaucuaacuuucaucauucuuucaacauguauuaguuuauauucugccuuagggggguuuaaucucacuucuuuccuuccuuuccuuguuuguuuaucugcaugggcucauggauucuuaugucguucuauggguuauaaucuguuucuaucauuauuuauuuuaaugccaaaaaauuauaaucuugagauuaugucaguaaauacuuuuuuuuuuuuuuuuugagacagagucucacucuguugcccaggcuggagugcacugaugagaucucagcucacugcaaccuccgccuccuggguucaagugauucuccugccucagccucccaaauagcugggauuacaggugcccaccaccaugcccagcuuuuuuuuuguagcuuuaguagagacugguccaggcuggucuugaacucuugaccucaagugauccgccugccucacccucccaaaguguugggauuacaggugugagccacugugccuggccuucgcuaaucuuugauugcuuuuugaugcuucaagcugaaaaaauuauuccuucauagacaugaaaaauauuuuauucauuauauuaugugaaauauauaucaaaaagguaucaaacugcugggccacauggcgugauugccgacaagaauagcaacuguguugggccuugguccugagggaacacaugacaaugagaaguggcucuuuuccccuggcuggagaagugacaaauaacaggauccaggagcagauguuaagugcugaugaugagguagagcagauagucauuuguggcaggaauugauggcauguggucccugagagccagggccaucuggaugucuuucuguuuguggagugagcugggucuggauggaagugaagacuuggcugagccagggaggaauggcaggaagagggcacaggccaagcaggggugugaacugcgagagcaugaagcaguugcuggagcaggagcugaggccuccuuauggaugaaugggaggugcguuuggaagcaagaugccacuauuggagugacgugggccuugaaugccagacugagcauugccagccagacggaauaucaccaucaucauaaucuaaucauagucauccaguugugaggucaucugauacuggcaauggguacacaaaauauuaaauaggauauuuauuucuaagccaaauuucagaaaacaauuuacaaacuuuuuuuaaaguauaaacauaguguaugcuuacuauaaaaggaaaaguauaaaacauuacucaaguauauauagaaaaugagugggcugcugaucccccucuauauuaucuauugcugugugacaguauuaccacaaauacaguagcugaaacaacacauuuguuuucucacaguuucugugggugaggaguucaagcauagcuugguccucugcaagcuuacaauccaaggguuggcucaggcuguauucucaucugagcacucuacuggggaggguuucaggcuuaccugaugguuggcggcauucaguccuucuagacugucagacugagggccuugguuuuugcuggugcacucaguuccuugcuucauauagaguagcucacaauguagcagcuuguuucacuaagacagcaaggaagaguguuuccuaguaagacagacacuguagucuuaccuaauacaaucaugaaagugacauacugucuccuucgccauauucuguuagagacagguuacagcuuugcccaguggcaguauccuagccaaugagguuuaucugaggcaugauuauuaaaauaauugaaaauuuucccaauacaccaaagugacaacuuacaacauagguuggcaauggcaauuuuugacaugucuacaaagacugaauuaaaaaaaaaaaaaaaaaaaagaagaaguuacagguucugcccacacucaagaggaagagauuauaucagggcgugaauaccaggaggcagggauuauuaggaaacauuuuaggguuuaacuccacacccucccccgaaaauagauaaagaaaacacugcuuaggguuaccuuuuuuuuuuuuuuuuuucugagacagaguuucgcucuuguugcccaggcuggagugcaauggugcgaucucggcccaccgcaaccuccgccucccugguucaagcaauucuccugcuucagccuccugaguagcugggauuauaggcuugcaccaccaugcccggcuaauuuuguauuuuuuaguagaaaugggguuucuccauguuggucaggcuggucuccaacucccgaccucaggugacccacccaccuugaccucucaaaguguugggauuacaggugugagccaccacgccuggccuaggguaaccauuauuaaaagcaaaauuuguggaccauuuuucucugcacauaccaaaguauaguaguaauuuaggaacaacaagagcaaagggugacuguugagauuuugagccuggaugcccaggagagagcucugugcuuuuucuugauuccuccuaacaauaauuuguuaaacaggagggagaggacagagcagguaaaugauaauaucaguaacuacuuggaaauagugauuuucauacugcuuuuaaaagaggaauaaacugguuucaguagaugaccuuaucccaagaguaauugaguucccccucacuuuugaaccagcaacuuuaagauuuaauuuacaauauuuucuucugggcaugguggcucaugccuguaaucccagcacucugggaggcugaggcaggaagaucacuugagccaaggaguuggagaucagccuugggcaacauagggagacccucaucucuuuuuuuuuuuuuuuuaauuaauaauuuacaugucuucugcccucugucucugaguaacugcucucauguugacaagaaccauauuaguaugcuaaggguggaugaugucacuuaguggugucaccagcugcugccauguauguucuaaaugaacuguccucccauaggggaauacauaccugugugugagacugggauuuauguagacuuuggcccagcaggcccauuugacaaccaguggcccucuuaguuucuuuuuuuuuuuuuuuuuuuuuuuuugaaauggagucucgcugugucaccuaggcuggagugcacuggcacaaucuuggcuuacugcacccucugccucugggcucaagcgauucuccugccucagccuccugaguagcugggauuauaggugcacaccaccacgcucagcuaacuuuuguauuuuuaguagagacgggguuuugucauguuagccaggcuagucucgaacuccugacuuugugauucgcccaccuuguccucccaacgugcugagauuauaggcgugagccaccgugccuggugcuauacauaauuuucuauuuugcucguaauauuuuggguuuuauuuuuuauuuuuauuuuuauuuugagacagagucucacucugucacccaggcuggagugcaguggcacaaucucagcucacugcaaccuccaccuccuggguucgagcaauuuuugugccucagccucccgaguagcugggacaauaggcacgcaccaccacgcccggauaaauuuuuggauuuuuaguagagauagaguuucaccauguuggccaggcuggucuucaacuccugaccucaagugaucugcccaucucagccuccuagagugcugagauuacacgcaugagccacugugcuuggccauauuuugaguuuuauuucgcauaguuauaccaugcauauucuguuucuuaauuaauuaauuaauuauuuuaaaauuauuuuugagacagggucucacucuguugcuuaggcuggagucucaguggugcaaucucgucucacugcaaccucuguccccagguucaagugauucucucaccuuagccucccaaguagcugggacuagaagcaugcaccaccaugccuggcuaauuuuuguauuuuuugguagagacaggguuuccucauguuguccaggcuggucuugaacuccugaccucaagugauccacccaacuuggccucccaaagugcugggauuacaggcaugagccaccaucccuggcccuauuuauuuauuuuugagacaguucugucucacuguugcccaagcuggagugcagugguaggaucauggcucacugcagcaucgaccuccuggguucagccuguccuccugccucagucuccugaguagccgagacuaugggugcaugccaccacacccaucuacuuuuuguauuuuuucguagagaugggggucucacuauguugcucaggcuggucuuaaacuccugggcucaaguuauccacccaccuuggccucccaaagugcuggaauuacaggcacgagccacuacaccugaccuauuuuaaaauguaggauauuuuugcugaaugcauaauuuuaauguuccuauugugauuuuauuaauuaucacuaauccuucauuguuugauuaauaaaggagggcaauuagauguuagaauuuugcagauuguaccagugacacauggucccuuggcuagaauuaugcauaacuuugauuguuuugagcaaacaacugugaggucagugacaacaauaaugacaaauaauauucaaguaaccucuugcuguuaauacuggguuuuguggccaggcacagugccucacgccuuguaaucccaacacuucaggaagccgaagugggcagaucaccugaggucaggaguucgagaccagccuggccaacagagugaaaccccaucucuacuaaaaauacaaaauaauuagccaggcaugguggcacacaucucuaauccuagcuacucgggaggcugagguaggagaaucacuugaacccggagguggagguugcagugacccgagaucguuccacugcauuucagccugggugagagagugagacucugucucaaaaacaaaacaaacaacaauaaaacaaaacaaaacuaaacaaaacuggguuuugucuuuaacugccucauggaaacauauaggagaguugugaaauaaguauucuuauucccauuuaacaaugaggaaacagucuuggagaggcuagcucccauguuugaugugacaguacacuaacauaaguaagagaaguaaagaaugcagcacauuccaggccggguacaguggcucaugccuguaaucccagcacuuugggaggccaagguggguggaucacuugcagucaggaguuugagaccagccugucguaaaugacgaaacccggucuguacuaaaaauacaaaaauuagcugggcgugauggcaggcgccuguaaucccagcuacuugggaggcugaggcagaagaaucgcuugaacccaggaggcggagguugcagugagcugagaucaugccacugcacuccagccugggcgacagagagagacucuaugucaaaaaaaaaaaaaaaaaggcagcacauuggguauuucaacauuuuagaaaaaggaauaaacaaaaccaacuguuauacaaauagaaagggaaggacuacaggauccauaaaauacuuacaggaauucuucgaggcaggacagaaucuuuucugcugagagaccggggugaaggcauugugcaaggaggugguauuugaaggaugagcaagacuugguuugcaugugggaacaacaugccaaauagagggaaccacauggccuagacuggcugaacuggcagccuuuauugugcauacagagggcuccuuuuggcugugcaaaaauuaggauaagguugugaagucuagaaaauauaauuuuucaugucucuaaauauuuggguucaaaaguaaaauaguccaauuugcaaaaccuucacgagaaagggacgauugcuuaagucuugguguuuaugugucuuuuuuguuauucuauuuuuuauauauuauuuauuuauuuauguacuuuuugagacagaguuugucacuguguugcccaggcuggagugcagugggcaaucuuggcucacugcaaccuccgccuaccggguucaagcgauucaccugccucagccuccugagaagcugggauuacaggcauccgccaccacccccagcuaauuuuuuuuguuuuuuuuuguuuuuuuguuuuuuuuaagcgggggacagucucguucuuucgcccaguuucaaguacaguggcgugauauugguucacugcaaccuuugccucccagguucaagcgauucuccugcuucagccucccgaguagaugggacuacaggcaugcaccaccacgccuggcugauuuuuuuuuuuuuuuuuuuuuuguauuuuuaguagagacgggguuucaccauguuggucaggcuggucuugaacucccgaccucaaaugaucugcccaccuuggccucccaaagugcuaggauuacaggcgugagccaccgcacccggccaauuuuguauuuuuaguagagaugggguuucaccaugcugcucaggcaggucucgaacuccugaccucaggugcuccaccugccucagccucccgaaguguugggauuacaggcaugagccaccacgucuggccuuuuuuguuauauuauaauuuaacauauccuaaacauuuucucaucauuaaaaaguuaacauaaacauuuuauucauauauaauauuuuuaucuacuuuuuuuucuuuagagcucuacuucuggaagaaucuacuuuuugauuugugguucugaaauuauagcaaauuguguaauuuaucauauuuuaucacaggcuaguaugcauuacugauucauacccuguuugcagcuuuucucacucugaugcuuguguugauuguuuuuuccagcagugcaggguagauuaucaacuggcuuauaaucagaagagcuugcuuguaucacagugaguuauacuucacugauuucacugggaaaucuuacuuccugaguuuccaugguuaaagauuuguaaugcucaaaucuucuuuugauguuuauuccaucagagaaaacagaaacuacuuugucuuaguguugccaaauugaaaagagccuuugguuuggccaggaucuuugugauaguggcaccuggcagugucuucccuccugaggagcauccgugcucacuugagccucucugauccuaguacugccugucagaggcagcugguccaccugagugccaagcuggcgcuccuuuggaguuucagcuguacuaacuuuugcuuagcugugaggaaucaaggauuuugcuuuugcagggggaauuuuuaaccuguaaacuaaacucgcuugcuuugaaagguuuacuagauuggcagauuauuagucugauuauuaguccagucauaucuaucuuucaacagauaguuuggccaugacuuuuuuuuuuuuuugagauggaguuucgcucuugucacccaggucaauggugugaucuuggcucauugcaaccuccgccaccuggguucaagcaauucaccugccucagccucccagguagcugggauuacaggcacacgccaccacagcuagcuaauuuuuguauuuuuaguagagacgggguuuugccauguuggccaggcuugucuugaacuccuuaccucaagugauucacccaccucggucuccuaaaguacuaggauuacaggcaugagccaccacucccagccggccauggcuuuuuucuuuuuuuguuuucagacagaguuuggcucuuguugcccaggcugcagugcaauggugugaucgcagcucauuucaaccuccaccuagcagguucaagugauucuccugccucagccccccgaguagcugggauuacaggcaccugccaccacgcccagcuaauuuuuuguauuuuuaguagagaugggguuucaccauguuggccaggcuggucuugaacuccugaccucaggugaucugccugccuuggcuucccaaaaugcugggauuacaggcaugagccacugugccccgccaacauguacuguuauuuauguuuuaaaaagauaaaacaauguucaguauuuugguggaacaagcuugguacuauccugcauuguauagaguauuacaaaagaaaaucuuuaggugucauaguaaaagaugucccaaaagguggagauaauaaucacacugaaaugugaauagucauacuaggaaccuugugguugguuuugaauuucacacuuucaggaggacguagacgaaaugaagugcuuucagggugauaugcgucccagccagggcauaugaagacugguugaagaaauguuucacacuugguugauaauuauaauagcugucuccagccauguuccagaaauaacauaagccugcuuaugauguauuuuauauuugaaaugauaauggcuuccauguguugaucaccuacuuugugccaaguacauacauuauccauaaccuuuucuccaaaucuuugaaauaggugguauucuucccuuaagaaucuggauaauuagacuagcuugcacagcuaauuuaugcugcuaaugaaagguagaccugggauuaaauguugugcuuuuuguacuauaccauacugccucuggcaugagcaugcagugaggcugugggugguggacacuuccccucuucugcuuaugaucagguuaauuccugaaauuuaaaaugacauugaauagucauaguagauaauauugagcacuuaugugccguacaccuuucuaagcucuuugcauguaauuuauuuaauucucacaacucagcgaaguuguuaccauuaucgucuccauccugcacaugaggaaacugaggcaagggguguagguggaagaacucgguuuugaaauaggcuguccagcugcagaacccacacuuagccccuguacuguuugauuuauguagaugaccauuguguauacacaagagugcaaguuuuuguuuuuguuuuugagacggagucucacucuugucacccaggcuagagugcaauggcacaaucucggcucacugcgaucucgaccuccugguucaagugauucuccugccucggccuccugaguaagcuggaucuacaggcgcgcaccaugcccagcuaauuuuucuucuucuuuuuuuuuugagacaaagucucgcucugucgcccaggcugggguacaguggcgugaucuugacccacugcaaccucugccuccuggguucaagcaauucuuccaccucagcuucccaaguagcugggacuacaggcaugugccaccaugccuggcuaauuuuuauaauuuuauuugagacaagguuuuaccauguuggccaggcuggucucaaacucuugaccucaagugaucugcccaccucagccucucaaagugcugggauuacaggugugagccaccgugccccgcuaauuuuuguauuuuaguagagaugggguuucgccauguuggccaggcuggucuugaacuccugacugcaagugaucugcccgccucaguuucccaaagugcuggaauuauagucgugagccacugcacaggguuccagccuuagucuuuuuuagccuacaaaauggcaaguuuauaugauuuaaccuaauauagaucaagggaaggauauuccaaaauaaacuauuuuuuguuuuaggaaagaauuggauguauuaaaguuuuguguuuugaacuucuccacugacauacuuuuccuguccaauuauuugucugagaaguguguauucuguuucacaucgugucacuuuugcuucuccuuuuuuuuuuuuuuuuuuuuuugagacagaguuucacucuuauugcccaagccagaaugcaauggcgcgaucucagcuacugcaaccuucgccucccagguucaagugauucuccugccucagccuccggaguugcugggauuauagaugcaugccaccacgcccagcuaauuuuuuauauuuuuaguggaaaugggguuucaccauguuagccaggcuggucuggaauucccgacgucauaugauccgccugccuuggucucccaaagugcuaggauuacaggcgugagccaucgcgccuggccaacuuuuucuucucuuaccugcaacuaauugaucuggcaucuuuuauaucucuuguuauagguagaaagugauuuuaaggcauuaugcuuugggauguguguguguguguguguguguguguguguguauagguuuuuguugguuuaaauuggcucuauaacagcauccuucagacaaccaaaccuaauuuugaaguguagaguauaauuuagaucaaauuuaagaguuuuaaaauuaccucugauuaugggaugacacuugaaaaaguaaucauaauacuuaccaaagguuuaacaggcuaccugcuuccaguggagauugugugauuguguuuacgaaaaaucugauuaacucaagaaagggccauucauugcauaccgaauuccuaauuuuuuaaaaaaagauccauuuaauauaauauauucuugggugaccaaaucuguagcauaggaaugacuuaaugugauuuuuuguuggugggaagacauucuaaagggaguccucaauaaacugcauuucuaacacacaagagguucuuguggccugggggcgguggcucacaccuguaauuccagcacucugggaggcugaggcaggcggaucacuugaagucaggaguucgagaccaggcuggaccagucucuacuaaagcuaugaaaaaaaaaaaacuggacgugguggugggcaucuguaaucccagcuacucaggaggcugaggcuggagaaucgcuugaacuggggagguggagguugcagugagccgagaucucaccauugcacuccagccuggacaaagagcaagacuccgucucaaaaaaaaaaaaaaaaaaaaguccuugugauggguuuacuuuuugucauuggugccugaccgacuauugccuucugcuuauuugucuuuuagggucaugcuuuuauugucucuuugaaauugaucauugaguccuaugaguccuccuuaugccuuccaccuccauuuaguuagcugguuuuucuugcagucucuggguccuuuuuguuguuguuuguuuugcauuuauuauuauuguuauucauacauuuuugagacagggucuuacuuuguugcccaggcuggagugcagugguacagucauggcucacugcagccucaaccugcugggcucaagggauccucccaccugagcuuucuggguagcugggacuauaggcacaugccaucaugccuggcuaauuaacaaaauuuuuuuuuuuguagagauggggucuugcugaguugucuacacuggucuugaggauccuggccucaagugauccucuugccuuggccucauuuauuauuauuuuuaauugacauguaauaauuuuacauauucaugugguacagugauauuuccuuacauguauacgauguauaaugauuaaaucaggauaauuggcaaaucugucaccuugagcauuuauuucuuuguguucagaacauucaaaaucugcuuuucuagcuauuugaaaauauacaauaaauuguuauuaauuauaguucccccauagugcuguagaaugcuagaacuuauuccuccuauucuggaucccuuuuuuuuuuuuuuuuuuuuuuucugagacggggucuugcucugucgcccaggcucgagugcagaggugcgaucucggcucacugcaaacuccgccuccuggguucaagccauucuccuguuucagccuucuggguagcugggacuacaggugcccgacaccacgcccgacuaauuuuguuguauuuuuaguagagacaggguuucaccauguuagccaggauggucucaaucuccugaccuugugaucugccugccucggccuccuaaagugcugggauuacaggugugagccaccacgcccgguguuuuuuuuuuguuuuguuuuguuuuuugagacagagucuugcucugucacccaggcuguagugcgguggugugaucuuggcucacugcaaccuccgccucccagguucaagcgauucuucugccucaaccucccgaguagcugggauuacaggcaugugccaccaugcccagcuaauuuuuguauuuuuaguagagaugggguuucaccauguuguccaggcugguccgaacuccugaccucaggugauccgcccaccucggccucccaaagugcugagauuacaggcgugagccacugcacccaccaaaucuggauccuuuugaucagacaaaguauauuguaaaacaaaguacguguugaaaucucaaagacucaauacuaaaaccuuuguaacuguuacacuuuccuugcacaaaaacugacguaaaaucucuuagguuucauagagagauacugaggaauguucccuauuuccguccacacagauagguaccaggaugguaguaaauguaagucugauccaacucauaagugcuagcuugagauccuugauuuuauuuauuuuauuuauuuuuuauuuuuuuugagacagagucuggcucuguugaccaggguggagcacaguggcaugaucucagcucacugcaacuucugccuucggguucaagcaauuaucgugccucagccucccgaauagcuagaauuacagaugugcuccaccaugccuggcuaauuuuuuuguuuguuuguuuuuuguuugagucaaagucuugcucuugucucccaggcuggagugcaauggcaugaucucgacuuacugcaaccuccgccucccggguucaagcaauucuccugccucagccucccaaguagcugggauuacaggcaccugccaucaugccuggcuaauuuuuguauuuuuaguagagacaggguuucaccauauuggccaggcuggucucgaacuccugaccucaggcgaucugccucccuuggccucccaaagugcugggauuacaggugugaaccaccaugcccagcccauuucuuuuguauuuuuaauaaagaugggguuuuaccauguuggucaggcuggucaugaacuccugaucucgagugauccaccugccuuggccucccaaaguacuaggauuacaagugugagcugcucugcuugaccugagauccuuuauuuuuauuuuuauuuuuaucuuuuuaaggauuuuuccuuaaaguauaugaaacccugaaaacuuguacgacuguuuaaaauaaacauguugauuucuucuuccuaaagaugaaucacaauugagucuuauuugaccugaaguuguuuucauucucucuaaacaguaauuugaggagguaauggcagucugaugucucaggcuacauuugcacgcuagucuuucacccucaguugucauguguuaaugcauguuuuguaauaacugggauaaauacaaggaaccuuugcuuuuguuuuuauuuuuuucaguaacaaauacuuuuaagaaaacagaugauuuugggucaucuaaugcaccagcugucgaccuagaccauaaguuuagaugcaaaguuguggacuguuuaaaauuuuuccgcaaagccaaacuguugcacuaucacaugaaguauuuccauggaauggagaagucacuggagccagaagagagcccgggaaagaggcauguccaaaccaggggcccuucagcuucagacaagcccagccaggagacccugaccaggaagcgggucucugccaguuccccaaguaaguaucuucauucuucauugugucauggauggcucaguugcuuggccacagugcuuguguuuucugacacacaaagcaggcauuagguuugucuguuccaguugaaucccacaggacugaacauauuaagugauccucugggcugugccacggagcuguggccuuccuacaggaagcaggaacaccuaacugagaauuaccuugaaaaaucgcuuagccucugaaggccuugcugcuuccaguaugaguggggacagucaagcaaagggaccuuauucagaagccagcaggagaacucgugcucagagcagcaugggugccaucgucccacucucccaaaccugugcguuuuccuugccagcagcacaaaagagcacgauaaccaaaaggugauaugugauucuacugcuggguccaaaugugaauccuguuucaucuuaagugcaacugaagauauuuauaauagcacuguuuguuuugcauagaaaccauaauagggguuaccauaaaaucucauuuuauaacuuauuacagagaaccuuuuaggaaauaucuucuaaagcuuacagaaauugaaaaauuacauguuuccaggggaauuucagaagaauuaauggauuuccaauaaauuauauaaucuucccagcuuuuuacuugcuauuguaauaucacuaccuacuucuuggcuuagagguuuucuauuaaaauguguaggucuuaaaugguauauggaacuccuaggacaucuggcaguguucccaguagaguauacaaucagguuucaggacaggggcagagccaugcagacuaaggugaacucugacccuccgaggggucaaccuucauuuaugcugucaagacuuuguaugugcuguauuauccauuaaaaauauaaugugaggccaggcacagugucucaugccuauaauuccagugcuuugggaggccaaggcaggaggaucaccugaggucaggaguucgagaccagccuuacuuaacauggugaaaccccgucucuacuaaauauacaaaaaaauuagccgggcuugguggugcaugccuguaauccgagcuacucuggagguugaggcaggagaauuguuugaacccaggaggcagagguugcagugaaccgagaucaugccacugcacuccagccugggcgacugagugagacuccaucucaaaacaacaaccaaauaagcuagcauaaacucaugcagauuguaugguucugcuuauauaaaguucaaaaaugaguaagaaaaauaaucuaugguauuugaggucaggacaguaguuaccuuugggaggagguggguaggacuggaaacugggcaggagggagucuucuagggcuccgaaauguucuguuuccugaucugcauggugguuauacagguguguucauuuaugaaaaaguauugguuuauguguuuauuuguguguacuuuucuguguauguuuuaugccucaauaaaaagcaugcuuaggcggacauaguggcucacaccugaaaucccagcacuuugggagguggaucgccugaggucaggaguucgagaccagccuggccaauaugaugaaaccccgucucuauuaaaaauacaaaaauuagccaggcgugguggcaggugccuguaaucccagccacucaggaggcugaggcaggagaaucgcuugaaccuaggaaacagagguugcagugagccaagaucgugacacugcacuccagcuuggaugacagagcaaaacucugucuaaaaaaaaaaaaaaaaaaagugugcuuaaaacauauacuuggaaaugguaaaaaugcaguaagaauguaagaaacugcagagagauaccaagauaaaggauugggcuuuuuacuugaaauaaugaauguaauugagaggauuuuaauguuuguuuguuuccuuuuaucugacuuaccuccaaauuaaucuccuuuucagucccauggcacuaaucuagguuucuucucuugcccugguuguuguggucauuucuuaaucaguuuuccucccaucauucuuuacucacugugguuauccaucauuuugccaucggaucgaucuuuaagaguacagaccugauuauaucacucucuugcuaaauaauauguaaggacagaaugaugcuucugcaaagcauaaguuuuggagcugggcacauggguugugaaucccaucuguugccucagucacuguuggacucucuucaggucuccagaccucacugucucugaguguaaaccugaguucuugugauuaguuugugagcuaaucuuuuuaauaagccuguguaaaccugaguucuugugauuaguuugugagcuaaucuuuuuaauaagccuguuucaaggccugguguggggaaguggauuuccuucuuccccuugcuuucuagaauuucauccuucucauccagccauauguggcugaguuggguacauuugugugagcucucuagcuggauucugagugcuguuggggaggaauuauguugagucaucuugagucacuacaguaucccaugggcucugcagcacuguagaaacaaccagcacugaaggacuggagauuauguugaguaaauggaggucauugaggugucaggagccaguagaaauagcaggugcuggauaucguaauggauugacaucugggcaggaugaggguacaacacuggaaguagagugcagccuaccccagacagcacaaagccaccagaguuagguuguuccaaaggcuaaggcuugacaggcaggaggccauugagggacccauggaaguccugcuugccugaccaucguggugugugcucucugugcuaggacauagugccucugccucucccuguucaugguaauugucugaggagggacuuugcucaguauaaugcaccugagcguggggcagguauuccuggccagaugcugaucuaccaccuggcuuugggauucuugguuaacuguacuugcaugacuugguuuauguugaguaauaugugucagcucaccugaguuugaauacaggcucuaccgcuugcuugcuccaggaccuugggcagagaacuugcgaaacuucaauuuucccaucugugaaauagagauaauaguacuaccuaccucauaacuuuguuacacuaaaugacccaaggggaaaugcuuuguaaaaugucuggccuauaauaaacucugaauacacagucucuuuaucucagugaaagcauuuacccaggcagucagagaucugaguucugaacucagccaaccacugaugagcuacaaaaccaauagacaagacauugccauuuugguauaauuaagaagccugagugacugauuuucuuuucuuuuuucuuuuuuuuuuuuuuugagugauuuucguuuccuuuccuuuccuuuccuauccuuucuuuuuuuuuuuuuuuuuugaguaauugauuuucuacuuucaugucucccucuugggucucaugcauuauacugaccugggauuuuauucucucuguuaauacugaaggauccuuuucaaugggauuuggaaauuucuuggugaauuggagauuuuuguuuaccaguuuuuaaaaauaaggccugcuguauacucacuagacuaguaggguuggacaauuauaaaaugcuuuaagggaaacaagagucuuuuaaaucccuaugcuuuaacuuguugccaaaagguuuuuuaaguccuuauguuuuaauuuguuuaaagugguccuuuguaaaauugaucaauuuagcagcagaaugugccacacagaccacucacccacuguuugaucauuucuguacccucucagugagggcacagucugaucauuucuguacccucucagugagggcaggauuugugcagccaggaaggaauguacccccauccacaugucaaguggacacagccuccuagacaacauggcgauuacccaaauguaucucccaugccucauugcugauacguuuagcaguuaccagaccgaaggaacuagaccauccaucuugcugugauccagauggaaaauugaaagccuggccaccagcccugacugugccacuaaccagcaagagccucgguauuaucauauguggauggggcucaguagacauguucaguguuuaucacguagcuggcuaucaaugagagugaacauaguaguguaugcugaagauucuguaguguggcugccuuauucugcugcagcucuccagaaggcaccccuguuccaggcaucaccccuuaccuuucucccaucaaagccuugccccaguuugucaggguuuuacuggauacuugacuaaucugauaaccaaaaauuugaaagaauagaaccaacuuaauaguauugugguuucaccucaggcuucugagaaugcucuuaucaggguggaauuucagacaguguggggaguucaguuggggagacguuucacugggagacguuucacagugggacucugauaccaggcagccuguguuuuaguuuacaggcagugugaacuugacauucugcuuaagugaaaaacagaauauuauaggauuugugcugcgugauaauaguaacuguaaaaaaguacccccuuuaugcugaaugcucugauuuuuuuuuuuuuuuuuuuuuuuuugagacagaaucucacucuguugcccagccuggagugcaguggcgugaucuuggcucacugcaaccucugccuucgggguucaagcaauucuccugccucagccucccaaauagcugguauuacaggcauucaccaccacacccagcuaauuuuuguauuuuuaguacagaugggguuuugccauguuguccaggcuggucuugaacuccuggccucaaguggucccgaacuuggguucucauggauuucucugauggagauuccuggggcuuccagcaaaaccacugggacucgaaaguacccugcagagauuucuuggcuuuggacuccucaauaucuggguugguaagguugggcagaaguaguaguucuggucugagaguccguagacugaucuuaguagcaaccugccacuguucccuuugugaucucaggcaggucucuucacagaucugauuucuuuucuccuuccuuccuuccuuccuuccuuccuuccuuccuuucuuuucuuucuuucucuuucuuuuuuuuuguuuguuugagaugaaguuucacucuuguugcccaggcuggagugcaauagugcgaucuuggcucaccacaaccuccgccucccggauucaaaugauucuccugccucagccucccgaguagcugggauuacaggcgugcaccaccaugccuggcuaauuuuguauuuuuaguagagacugggcuucuccguguuggucaggcuggucucaaacucccgaccucagaugaucugccugccuuggccucccaaagugcugggauuacagagaugagccaccgugccuggcugaucuccucauuucuaaagugaugauguagagcuagguaugcaugagaccaggcccuuucauguggggagaaaagcucauaaacaacgugagaaagcuaaguucuguguuaggaacauguaaagugcugugggaacacagauucagauuuugccuguaggguaggagcuggacuguugagaggagaaggugacauuugaguuaggccuugcugugaauugaauuguguccugccuuccucccuaaaauucaucuguugaaguccuaacccucagugugaugguauuuggcaauaauuaaguuuaaaugaugucaugagguuggggccuucaugaugggauuaguggcauuauaggaagagaucagagcucccccuauccccccaugugaggauguagcaagaagauggccaucugcaaacugggaagaggggccucacugggaaccaaauagucuggcaccuugaucuuguaguuuccaaccuccagaacugugagaaagaaauaucuguuguuuaagccacauauaacauaauguuuuguuauaacagccugagcagacuaacccacgccuuaaggagugaggcuagauaggaauuggaccagaagccgggaagaggaaaagcaucccugugccaggaauaggcauagcaaggguucagaggcaucaaggggaauaaaccaaucaucugucccuaaggugccccuucugaugccagccuucuguaauccugucacucauaugguucuucugcucucagccaagccuuuaguugcaaaaugaauuuagaaggucaguuuagauuugcuuuuccaaaugagguuucucaguauaccagagucacuuaauaaauucucuuccaguagccagcucaggcucccuuggguuucuuucuacuuaggugaguucaguccugaauacagguuaggcucagaaagaauuuucuagugucaaagagggccucuccugugcuuauuauuacuuauugcuacaucuguuugagucgugcucucacccuggguaaaccucaguuuuaggccaaagugagccuuggggcacuggagugggcaccucuucauugccauccacaccuuuucucaugggacuacacuggccuuaucgcaggaacauguccuccuccccuuaaaacaaaaagagcagugugagcuuaauuagaauauggauuauagugccauaacagagagaacaacauagcuggcuaaaaucagagaaguuuauuucccucucaggaugaacugcaaguuacccaugguggcugugcucaggcucugaagguccccgggccuugcuuucuccccauuguuccaccaggcucuaaaggucccugggccuugcuuucuccccguuuuuccaccaggaucugaaggucccugggccuugcuuucuccccguuguuccaccaggcucugaagguuccugggccuugcuuucuccccguuguugccccaggugcugcucuucuuugguguccaaaauggcucccugccuugcuuaucuuucagcugcugggaagggaagugaagggaaaguaugcuccuuucuuuuaaggcacaacccagaagugccacacaucacuucuuguauccgauaggcagaacaucugccaccccucucucaagggaacauggaacaugaacucuuccuauggaagaaguggagaaauaguguugggaagggcacugcagccuuuaccacaugagcuaagaagaaugcagggcuugaggagggagggguuauuggagggccauccuggguugguaucugggugggacucaugguaggggacugauaggagaugagauugggaagguagacauggugaaaugacaguggcagacccugacuaccacuucucugauaggcagagagaaccccuccaagcccauaucugcuucugucugcccuugagcuaccacccccuugugcagaucagaacaugcucuggucagugcuugucccagccucguggcugagcucugugguguacaagcaguuaccccauaggugguggugaugcuauucuuuucccuccuggaagcggcggucugaugacaguugucccucugcucucauaaaucagugacuggauggaauacucaagagucagcuguauggaggagcaagagggccucugguauuucuccugauggacaccugcagcuuggggagaggacaaguggccauccuggaggaaagccucacccugcuuaggugacaagcugcucucugauccagagccuggcaggaagucacucuuuguccaaccuagucagggcagccgggaggaagcuccacagccaguacaugcucugugggucauggaacaauugguaaagcuguccagagagagaguugacagcagaccagcgaccagcacugcuuuccagggaaagaauauugcaagcaagauaauaacagcugacauuugaguacuucaugugcugggcgcuguuccaaguucguuacuuguauugucuuauuuaguuaucagaacaaacccucugaggugggugcuguuaugccuaauuuaugcaguuauuccacuguggucucagagugugguugauaugauuucaaugauuugaauucacugauacuugguuuauggccaagcauguggucaauuuuagauuauuugccauuugcagauggguggaauguauaguuugucauugcuggauuuaaguccaguauuucuuuguuuuuugccucgaugaucuuucuaaugcugugucagagggguguugaagucccccacuaaaauuaugugacuaagucuuucuuuaggucuggaaguacuuguuuuaagaauuuggaugcucuaauguuggcauauuaggcaucuauaaugccuaauuuauagauuagaaacuaaggugcagaugagauggauuaauuugaaccaauauuuacagcucuagcaggugguggagccaugauuugaaucuguugugaagcccauacucucacuuugaggcucugcugucuuuuaugauuccagggaagagugccugucccaggcccuggagugggagauaggagugccucccugcaggagacuuccugugcaccuggcagucuggggauuucugccuguugucaccuugucuacuccuguuccucagggacucaccugccuuagcucaguccuugcugggcaauucucugugucuuuucuagggccugcaaguucugccacuggaguuuacaaaugaccacuaucuuuagccagauaaccagguaugcccuagcauugggcaguuuuccucuacaucuugcccucucugucucaaggauuuaggaccuagauuauguugcugcuucaggcaguucugcugcugacaagauaaauucuguuagcauuucacuaagcugauggguauaauuacuuuaguuggaggucacuaaaaccugaauuuacaaauaaaaacuggaucagggagcagucuguguguguguuguggaggagugugggugaagguacaacagauaauaucccuccuuugcugagauccuuccaguggcucccuaaaucacucauaguaaaagccaacuuccucacagggcccuucaucauguucugcugcuagccuccaucugcuucuuucccuuacucaaccuaauucuaauuucaguuccauuggagccauacagaucuccuugcuauuucuuuauuucaaauuccaguuauucauugcuggcauauagaaaagcaauagauuguuguauauuaacuuugugucuuguaaccuugcuguaagugcuguucuggcagucuuuguuuugaucaauucuuugggauauucuacauagacagaucaucugcaaacaaagauaguguuauuucuuccauuucaaucuguagagcuuuuauuuccuuuucuggcuuauuccacucgcuaagauuuccaguaaaauguugaauaggaguagagagagaggcaccuugcuuuguuccugaucuuaaggggaaagcauccaauuucuuaccauuaaguaugaaguuggcugcaaagaaguucuuuauccaguugaggaaauucccuccuauucauaguuugcugccccaucagcuuuuuagguuggugcaaaaguaauugugguuuuugcugugacuuucaguggcaaaaacagcaauucuuuugcaccaacugaauagaauguagcucugugagggacaggggguguuaucugucuuuguucauugcaauaucccuccucccuagaaugugccuggaacauaguauaugcaugguaucuguugccuaaaugaauugaaaccauggcuaauaauacggugguagucaaacuguguaaaaaugaguuuuguuuuuauguuuggggaagacccuguucucaggaucaaugaaaaguaaaaaugacugauagcuuuuuugaaauucagaaggcaucugaccauguuuugccagucugcugucuuugggccuuggguuuuugguuuuaaaaaugagugcuuuuacaaauuggucuaaguucucuccagcuuucauguuuguugacuuucuuucuaguugcaggguauuuuaaaaguuaaggagcucaaauacccuuaaguccuauguucucuagccaguagaucaacucugccuauagauuccaggcuugccagccaguaggcacagcccacucuuccuuucugaugguuaccaagugcuaauuugggagaggggccuggguugcagaggagacauggugcuggagagucagaccaauuugcuuuuaaauaccuaugugaugucaggugggugauuucaccucucugagcuucaguuucccggccuguaaaaugggaaugauauacacacaaguuguuguaaggauuaaaugagauauuugugguuuccuugcacacaagugcuuaguuaaaauggaaucugauugucuacccugccucacaccugcuuuguggauaucuugauuccauaucagaaucacuuggaaaguuuuaaaaauccugauauccuugaaaacaucaugcuaaaugaaagaaaccagacacaaaaggucacauauuguaugguuccauauuuaugagauauccagaguagauaagcccauggagucagaugcagguugguggggcugaggggaagggcuuaggggaggggaaaugcugcuuaaugguaaaggguuuuacuuuggagugauggaaauguucuuagaacuauaucaaaguggucguacaacauugugaauguacuaaaugcaacugaauugguuguuuuucuuuacagcuguaucgagacuuaauuguacaaugaacuacacauauuuaaaugguauaauuggugagauuugacauauguuuauacccaacuaucaccacaaucaagauaguaaacauauuccauucccucccaaacuuuccucaugccccuuuuuaguuccuccuucccaccucuccccucccccugagcuccaggcaaccacuauucugcuuacuguuacuugugguguguuuucucucuuuuuucuucccccccgagauggagucgcuguguugcccaggcuggagugaaguggcacgaucucaacucacuacaaccucugccuccugggcucaagcgauucuccugccucagccucccaaguagcugggauuacaggcaugagccaccacacccagcuaauuuuuguauuuuuaguacagaugggguuuuaucguauuggucaugcuggucuugaacuccugaccccagcugaucugccuaccuuggccucccaaagugcugggagugagccagcaugcccagaugguuuguuuucauuuugcagacuauuguagaaauggaauccugcagugcgcacuuguuuugucuggcuccuuucacccagcauacuuugagauucacuuauguugcuguucguaccuuuuuuucuauuuuuauuuuuugagacggagucuugcacugucgcccaggcuggagugcaguggccagaccucagcucacugcaagcuccgccuccuggguucacgccauucuccugccucagccuccccaguagcugggacuacaggcgcccgcuaccacgcccggcuaauuuuuucuguauuuuuaguagagacaggguuuuaccauguuagccaggauggucucaaucuccugaccucgugauccgcccgccuuggccucccaaagugcugggauuaccggcaugagccacugcgcccggccugcuguuccuaccuuuauugcugaaaagucuuccauuguguggauacaucaugaauuauuuguacauucacuugauggacauuugggcaguuuucaguuuggggcgauuacaacuaaaacugcuaugagucuucauguauaagucucuauguggacguaagugaugcuuucucuugaaugaauauguuguaguggauggcaaggucauaggauauauguacguauaaacucuuguugauaucuaaaaaguaaggcauggugaauuacuugaaauccuauaaauauauuugguaagagaagaagaaacgacuggauuuuuuuguuuguuuguuuuggagacagauucccacucugucacccaggcuggagugcaauggugcgaucugggcucacugcaaccuccgccuccccgauucgagcaauucuucugccucagccucccaaguagcugggauuacaggcaucugccaccacgccugacuaauuuuuauauuuuuaguagagacgggguuuugccaugugggccaggcugaucucaagcuccugaccucaggugauucaccugccuuggccucccaaagugcugggauuacaggcaugagccaccgugcccggcuacgacugaauuuuucuuucuuucuuuuuuuuuuuuuucuuugagauggagucucgcucugucgccaggcuggagugcaaugacaugaucucggcucacugcagccuccgccucccguguucaagcgauucuccugccucagccuccugaguagcugggauuacaggcacacaccaccagacccagcuaauuuuuguauuuuuagagagacgggguuucaccauguuggucaggcuggucuugaacuccugaccuugugaucugcccgccugggccucccaaagugcugggauuacaggcgugagccaccgcacccagcaaugacuggauuuuucaauggugaagcuauuaauuuugaaaacugaucucaguagagugguaggugggaagcuuuuuagaauguaauuaggaaaaacugugaagggagaaguuuggacagggaggauugacaucuuaaggaguuuuguuguagaguagagaggauaaaguuuugguauuuagaaggcaugaacuguucauuuaaaaauaauuuuauguuauaugaaugguaccucaauuuuuagaaaaagaaugaaacaagcaacagaauccuggcuggaugcgguggcucacaccuauaaucccagcacuuugggaagcugaggcggcuggaucaccugaggucaggaguucaagaccagccuggccgaaauagugaaaccccaucucuacuaaaaauacaaaauuuagccaggugugguggcgugugucuguagucccagcuacucuggaggcugaggcaggagaaucgcuugaacccgggaggcggagguugcagugagcugagaucgcgccacugcacuccagccugggugacauggcgaugaaaacaacaaaaaucagauccccaggugauuccaguauguagccaggguugaggagcagugaucuaaguagaguuuugcaaacuugucuguaaagggccagauaauaaauacuuuucaaccuugggguugaaaggucucuguccucacuuuucagcucugcuguugaagugugaaagacacguaaccaaugaacauggcauguuucacuaaaauccauuuacaaugacgggccaugggccagagugugcugagcuggacugaaaggcuaagugauggaggcguggcucugccuccagacuggagcaaucugcuccagacuucccaggcagagccagacccaucggacaugcuugcuuaggagaagaauaagcaccccagcauugaaaacaaaauguuaaaaugccaacauuuguguuuaauucuagcuacaaaagacaaggaaaagaauaaagagaagaaauucaaggaguuugugagagugaagccaaagaagaaaaagaaaaagaaaaagaaaaccaaaccugguaauuuuuuuuccugaggguuucacuuagguuuccuuacuaugaauggggagggguugcuuucucccauuauggccucugggccugcgcugagcagaggaaggaccaauagucucuuaccagggcuugugggcucaaccuaguaugggcccuggaaggggaggcauccacucacccagguguuacaaaguccugcuggcauugaaaagccuucucacuugcugccuuggccagugugcccugcugcaggaugguacagaugaaggcaucgaaguguaagcagaugugcaggugaaugaugguauuuguucacacacacgacucuuaaaacacaucuuugagcccucuugagaaaggauucccuucuuaaaaacugugucuagcccucacaaaaauguuuagaaaaaucuauauauucugacuugggacuuaaaggaugccacguuuuauucuugguguaucuucuagcuuagaaaaacaaucuuaucagaaaaagaggagagggucaauacuuaagaggagguguuugggccccuucaucugcucuccacaccucuuuuugguugaauugucccugagccuuugugcugcuugaaaaggaggcuuguugguuggaugagauugauucuagaaugcaccaguguuaacuaggguuauucauuccuuccugauccuguucuuccagaaugccccugcagugaggagaucagugacaccucccaggaaccuucuccacccaaggcauuugcuguuaccagguguggguccucacacaagccagggguccauaugagcccgcagcuucauggcccagaaucuggacaccacaaagggaaagugaaagcauuggguaaggaggcucuucuguccugaucauuugcugaucauuuauuggaaaauacaagcauaccugggagauauuauggguuugguucuaggccacuacaauaaaacaaauaaagcuagucagacauaauuuuuauuuucccaguguuuacaaaacuuauguuuauacuauauuguagucucuuaaguguucaguagcauaugucuaaaacaaugcauauaccuuaauuggaaaauauuguuguguugagaaaugucaaguuuuuuggaguaaguccucaaaagcauagacaauaaauaaagaaauggacaagugggauugcaucaagcugaaaagcuuaugcacagcaaacuaaacgauuaauagaaugaaccgaaaaccuacugaaugaaagaaaauauuuguaaacuauucaucaacaagagauuaguagcuggaauauauaagaacucaacucaauagaaaaauuauucaauguaaaaauugguggccaggcgcgguggcucacacuuguaaucccuacacuuugugaggugaggcaggugggucacuugagcccagaaguuugagaccagccuggccaacauggugaaacccaucucugcaaaaauacaaaaacuuagccaggcgugguggugucugccuuguaaucccagcuacucgggagguugaggcaggagaaucguuugaaucugggaggcagagguugcagcgagccaagaucaugccacuucacuccagccugggugacaaagccagacuccgucucaaaaaaaaaaaaaaaacaguaaaauauguuauauauauacauauacauauauauauguauauauguaaaaaaaaagguaaaauguuuuauauauauauauauagauauacacacacuuacacacauauauauaugugcucaaccuaauaugggcccuggaagggaggcacccacucacccagguguuacaaaguccugcuggcauugaaaagccuucucacuugcugcauuggccaguguguccugcuacaggaugguacauaugaaggcauugaaguguaaguggaugugcaggugaaugaugguauuuguucacacacacgacucuuaaaacauaucuuugagcccucuugagaaaggguuuauauauauaauuuauauuuuaaaauauauauauauauuuuguuuuguuuuguuuuguuuugcuuuguuuuuguuuuugagacagagucucacucuguugcccaggcuggagugcaguggcgcgaucuuggcucacugcaaccucugccuccuggauucaagcaauucuccugucucaaccucccaaguugcugggauuacagguguacgccaccacgccuggcuaauuuuuguauuuuuaguauacacaggguuucaccauguuggucaggcuggucuugaacuccugaccuugugauccacccacuucgaccucccaaagugcugggauuacaggcaugagccaccgugccuggacuguuacauuucuuaaaacuuucuuugaaauaaaauuaguuuaguuauuccauauguccugaaaaaugugacauauguguucauuagaucaaucuuguuuugauguaauguucaaaaauuugaacuagcaauacauuucauuauguuaacugacaauuuaaaaaaugaaagcugggugcaaugucccacaccuguaaucccaacacucugggaggcugaggcggguggauugcuugaccccagaaguucaagaccagccugggcaacauggcaaaccuugccucuacaaaaaauacaaaaaaaguuagccgguuguuguggcaugcaccuguaaucucagcuacuuaggaggcucaggugggaggaacaccucagcccaggaggucaaggcugcagugagcugugaucaugccacugcacucugggagaaagaaugagacccugucucaaaaauaaguaaauaaaauaaaaauaauaaaaaguaaaacaauauuuuauugcuuaaaaaugcugacagacacaaaguauuugcuuuugcaauaauggugucaguagacuuucaggguugcugccacacaccuucaauuuguaaaauaauauacaauaucugugaagugcaauaaaauauuaauaguuaugccugacuuagaacaguaucugcuucagaacaagcgcuuaguaaaaguuagcugugauuauaacuaaucaggcaucaagugauucugccucugauuaucccuggaaucuuccucuuccucauuccucacugucuauagaguuuuuguuuuugauuuuuguuuuugagacggagucucacucugucacccaggcuggagugcaguggcgugaucuuggcucacugcaaccucugccuccuggguucaagugauucuccugccucagccuccccauagcugggauuacaggcgcacaccaccacaccuagcuaauuuuuuuguauuuuuaguagagacaggguuucaccacguuggccaggcuggucucaaauccuaggcucaagugaucggcccaccuuggccuccuaaagugcugggauuacaggcgugagccacugugcccagccuguuugucuuuugagacaaagucucacgcugucacccaggauggagugcaguggugugaucauagcucacugcagccucaaacucgcaggcucaagggauccuccugccucagccuccucaguagcugggacuguagacgugcaucaccgugcccagcuaauuuuuuuuuucuuuuaguggagaugggguuuugccauguugcccaggcuugacuugaacucuugagugcaagcaauccuccuccuucggccucccaaaaugcugguauuagaggcaugaaccaccaugcucagccuuuguuuacagaguuuuaaagguagcucuggauacagacagacuguaagccagguccugacuggauggagugaggcugaagaacauguuagaguugucagggaugguggccugugugguucauggggaguuguagcuccucugccacugaguucuaugaucuugaguagccacugccguugggcuucauucucucagugaaaugaggaaguggaguugaguucacugccaggcagcaugcuucguuugggcuguuacuaaaugacagauccaaggacagauuggcauccucguuuccuugcccuaugaauguucuuguuuggagguaugggacuauaaugucauuuuucauucuugacaaucaaagguuuuuuaauuuuauaaccuaaaauaguaacuguuguuuucccuuuccucguagaggaggauaauuugagugaguccucuucugagagcuuucucuggagugaugaugaguauggccaagauguggaugugaccaccaacccagaugaggaacuugauggggaugaccgcuaugacuucgaggugguccgcugcaucugugagguccaggaggaaaaugacuucaugauucagguaggcagagcuuccaggaaacaggucuagagaagcacaaacugguccuuggagggaauuuugaggccagcaacaauggcaagucauagcagagccccagaaacacagcacgaacggcagcagacugagcuucucuuuuucguuuggcuuccucagaguuccaggcugccauacauaguccauugauggaguaagagaggacuuuagggaucacugagucuaaaccucucaugcucugcuugaggcagcugggacccgcaaaugggaagggccuugccuguggucacaaagugaggaguugaacagcagggacugaaaucuuuggaguggcaguuuaaucuucccauggacucuuaucuucucuuugagguaaauuuucuuuaagauccaaagucaugcaggcuggcuuuauaacuucuauguuucuuuuucuuuauuuuccugacauuugagucugucaucuucaucucugagaugugccuguggugggugggaccuccuuaccugcuuggggaaaccaugccuggccagcaccugccugcccugucccuugucuguaaauugcaguucugggagagguggcgcuggcuggcuggcuccuaagggugucacaaguucccugggugucuugacagcugcccaacuggcuugggaagcugaguuuuuaaaagucaugguuauauugguuaggauuuuuuuuuaggggcaaguacaaauauuguugggaaaauagacuggguccuagggcucagaggcagggcugcuuucaggcucagaaccuggaauuccaucuugagggccuuggucugccuuguuuccugcuucucuggaguccuuuugguucuuuuuuauuuuauuccuugcuuauuuucuuggaaaaugcaaaauggccaccuuuggccucgccccaauuuuacauuuuuguguucaagaggcuagguagaccaaggucagaaucuuagucccaguucuaaauuucugaguaaguaauuccagccaaauuuagaucagauauuaguuuuuggaacagucaccuguggccagaggggaaagagguuuguuauggaucaaaugcucuccccuggucuaguugucugaucuggugguaguagagcuuacagauuaucgacaggggcaaaaagacugccuggggcccaccuguguuauauuauagcguuaauggggguucagggauuguucccaguaaaggggguggcugcccauuguccaauaagaaucuguauagccuauugagauuaugagaaacaggcccagccccuuuggcuugcuuucugugauagaauauuauuuccuugcccuuucaguacuguagguuggcauggcauggguuugguuuuuuuuuucuuuuugagacggaguuuugcacuuguuucccaggcuggagugcaauggcgcgauuucggcucaccaccacccucugccucccagguucaagcgauucgccugccuccacugcccgaguagcugggauuacaggcaugugcuaccacgcccggcuaauuuuuguauuuucaguagagaagcgguuucuccauguuggucaggcuugucuggaacucccgaccucaggugauccaccugccuuggccucccaaaguauugggauuacaggcgugagccaccgcgccuggcaaaauauuuuuguuaugguaauuuuuuuuuuuuuuuuuuuuugagacggagucucccucugucacccaggcuggagugcaauggcgcaaucucggcucacugcaaccucugccucccggguucaagcgauucuccugccucagcccccugaguagcugggacuauaggcgccugccaccaugcccggcuaauuuuuguauuuuuaguagagacgguguuucaccauauuggcuaggcuggucuugaacucuugaccuugugaucugcauggcauggauuuuugaaauucacuuuuggaucuugacuuaauauacaguuacauuuuuuccucucaucuuugaauuuguugucuuuauacucaacaauccccuuuccuuuuauuucuugaaacauugggacuuuuccguagcucuuuaaacuuucagaacaacuagagaugaguagauguauuugcuuuuuugccuuuuauuuucccagggcuuuuagaaaacacuuuuauuuugaaauaauuauagauucacaggagauuguaaagagguguacaggagagucccaugaauuccucugcuggucuuccucccauggcaaaagcccauaaacccacaguaggauaucaaaacuacaaaaccauuugacauuggcauaaucacuagagcuuauucagauuuuaucagugauauacacauacucauuugugugugcauauagcucugugugcuuucauuacaaguacagccuuguguaaucacucccgcaaucaagguacugagguauacuaagaccaugagauucccuccugguacccauacuuuguagccauacuuaucccuaacccuggaaacacuaaacuguuucaacugucuauaauuauguaauuuaugauucuugguuaauggaaucacgugguauguaucuuuuugagagaggccuuuuuuacucuguauaauauccuugagauucauccauguuguuguguguuucaguagucauuuauucuuauuguccgguaguauuccaugcuauggauguaccacagucgugcucuuuuuguuaauagaacuaaagcaacucuauggagcuaagguaacuggguacagcugaguagugauuuaaaguuucuggaguguuuucagaaauaccaucucaccucuaacaaggcgaucucaagucacuuauuugggaaaacaaaauuacgaagauaugauuucuuucauuguuguagaaccauuaaauaagucaucagauuaugauuugaacccagggcacccagucaagugcucuuucccuaugcggccuuagcuacggggauuuacauuuacaguugagaagugaaacaagaaaaauuuguuuuugaaacauaauaguaccaucuagccuggcugaccaacccuuccccagcaccaccaguggacaugcgcauguacauacacacauacauacccacacuuuaggcugagggagagucuugucuuuuugaauagccuucauaguaaccucugggauucaaggguaccugauauuuaagaccuuuauuaaaccuugguucagugguuuucaaacauuuuugaauaucagaaccccuuuuccuaauggacuguuucauagaaccccaaaauguguaacagguaacagcaauaguuuugaaaguucaaaauggauaaucuuuacuugugaggucggacaugugaauggugggcauauucccaugauucuaauaugcugucagaauuaugagugacagacaguugcugacuuggagcacuucaguggcucauuuguuuuucucuauuugguuauacaacagugagacaagcgugaugcacauggccauugucagggugacuuuuccugaacagcaugcuguguaguuacuuugauuaaucagagaugggaggacaagcuccguuuugaggucaacauaauacugagcuauccuagcaauacaaaauuaugugugguggcgggcuucauugucuuaacauauggcuuggaacauguuugagugugcaucuuuuuuuuuuuaauuguccuaccuuaaaaacacacacauuuugcagacucucugaagcccuguggacuacuauuagauaauuguugguugggcaugcuguaaucccagaauuuugggaggcagaggcgggaggauugcuugagcccaggaguucgagaccagcccuggaaacauagcaagauccuaccucuacaaaaaaauuaaaaaauuagcugggcauggugaugcaugccagcagacccaacuacuccagagacugaaguaggaugaucacuugagccugggaguucaaggcugcagcgagcccugguuauucuguugcacuccagccugggugacagaaugagacccuguccccacccucccccccaaaaaaaagaaaagaaaaaaaauguuauauaacaugaagacuaucauuuuuuaguagauuuuuuuuaaguuuguuuuuaaaaggauguugaagaucuuuaguuucuacucugucauccuugagcauaugcucaguuccaggccuuguuagucugacagauuugcccuuuaucugccuguuaaaaucuucagugggugaguaaugaaugucccuccuggcagggcuauucugucuaacaguauguaacccauuucugauccacucugguacuuucucuauugacuuuucuauaaguagcaaggaucuugguguguuugaggguagagguuaauaugccauuaugugcuauaugaagaaacuaauuucggggcaauuggggccaccaugagcauggcagagucaggagccaacuugaucuccugcuucccaggcuccacaagaccuugugucucaagcucacuucagagcuucuuggcuuuuguuccagaggacuuuucugugcuguccaccugaaccaagagugcccaccuggcuuuguguuaaggagggacgguuucugacuguccugucacugugagcaacguaccuuuucuacucaauaacuuuaucaaaaggcauaaguuuagagggagcuagcuagaacaaauacaguuuaaacuuuuaaaauguauucaccaucuaauuaggaagacaggaauaaauuuuucuuaaaucuuuaccuuaaauugauauuuugaauaacccuagaauacauuuagaguguguuuucuagaagugcauguauuacuauagagaaauaacuuuuuggaucauugucauuauaugaguaguaucaacauuguucauguauaucacuauuuuaucuuauuuaccagugcuaauuuaaaucacuggaagguuaaaauccuacuuaauaaauacgguauuugagaaaucuggcuaccacauaaaaaugaacaggaaauacauuugauauuuaaauuauuuuaaucgcuguagagcauguuuuguuaagcuuuuucuuaaauggcuagauaauaaauuuuuagguuuugagggccauauggccuuguugcaccuacuggauucuucuuugagcagcuguaggcaauauguaaaacaaauuuucaccuguaugguuggcugcaguggcucacaucuguaauacuagcacuuugggaggcugaggugggcagaucacuuuaggccaggaguucaagaccagccugggcaacguggcaaacccugucucuacaaaaaauacaaaaauuaguuaauugugauggugcacacuuguagucccagcuucucaggaggcugagguggguggaucacuuaagccugggcagucaaggcugcagggagaugagauuguaccacugcacuacaaccuguucaauagagugagacccugucucaaaaaacaaacaaacaaaaaccccuaaacaaaugcguauggcuguguucacauaauacuuuauuuacaaaacaagucaagcuggcauuggcacaugggcuguaguuugcugaccuuugcccuacaacaacaaguauuaauauguauuaaguguccaacuccaguaaagauuuuauagcaguuuuaaaaagaagcccauuuuaauggccuagcacuguggcucacacccguaauccuagcacuuuggaaggcugaagcggaaggaucacuugaguccaggaguucaaaaccagcuugggcaacauagagagaccccguuucuacaagaaauuaaauaaaaauuaaguaaauaaaaauuuaaacaaagaagcccauuugaaaguuuugguuauuuuaaaauucauauuauuuguugguaccuaaugcacugacauaauucaaaguccagaaagcacacagagaaauaccuuauccccaccuuauccccaacuacccauuccguagagucagcccuuaucaguuucuuguauauccuuccagaaacauucuauggcuaaacaaacaauagcaaauguauuguuuccuuuuaaaaauuuuuugguaaaauacacauaacauuaaaaguuacccuuuuuauuuuuauauuuuccuauuuugagacaggaucuugcuuugucacccaggauggaguacagaggcacaaucacagcucauggcagccuccagcuccugggcucaagugauuguuccaccucagccuucuaaguagcugagacuacaugcacacaacaucacaccuugcuaauuucuuuaauuuuuuuuuguagagauggaaucuugcuauguuuuucaggcuggucucaaacuccuggccucaaaugacccuuccuccucagccucccaaagugcuaggauuacaggugugagccacccugcccugccuaaaaguuaccauuauaaccauuuuuaaguaugcaagucagugauguuaaguacauucacauugcuuugcaaccaucucuuugucuaaaugcaaauguuugcauuuuauguauaguauuuucuuuucuuuucuuuucuuuuuuuuuuuuuuuugcgauggaguuuugcucuugucgcccaggcugggguagugcaauggugugaucucggcucacuacaaccuccaccucccagguucaagugauucuccugccucagccucccgaguagcugggauuacaggcaugcaccaccacgcuuggcuaauuuuguauuuuuaguagaggcaggguuucuccauguuggucaggcuggucuugaauucccgaccucaggugauccgcccaccucggccucccaaaguucuggaauuacaggcauaaaccacugugccuggccgcauguauaguauuuuuaacaucuuuuuucauuuagcaauauguaaauuaaaaaccauuuuauuuucugcauaaugguuggaucacauuuuauuuuacuuuauuuuauuuuauuuuuuugacggagauucgcucugucacccaggcuggagugcaguggcaugaucuugguucacugcaaccuuccucuccuggguucaagugauccuccugccucagccuccugaguagcugggacuacagguguguaccaccacaccuggcuaauuuuuuguauuguuaguagagaugaggucucaccauguuggccaggcugaccucaggugaccaacuccugacuucaggauauccucccgccucggccucccaaagugcggggauuauagacaagagccacugcgccuggcccauuuuucuuuuuuuuaagcuauauaaauauuugauccaccugaaauuuugccagguauauagugagaacuauggcuccccauuguacuaauaccauaccucacuguuugaaaugccaccuuuauuuacuucauuucuaaaugcauuugaauccuuuucugguucucucuuucagcgauucaucugucuguauauuugcucguacaauucuauuuuaauuauuguaccuuuauaauauuuuuaaaauaucugguauggcuagugucuccauauugcucuuucuuuuucacacauuucccagcuguuaauuuuagaauuuuuucuaguucugaagcuauuaauuuauuauuuuauugagacuuuuuuuuuuuuuuucugauauggaaucucgcucuguugcccaggcuggaguguaguagcgugaucuuggcucacugcaaccuccgccuccuagguucaagcaauuuugaaccugcuucagccucccaaguagcugagauuacaggcgccugccaccaugccucccuaauuuuuguauuuuuaguggagaugggguuucaaacauguuggccaggcugaucuugaacuucugaccuuaagugauccccccgccucggccucccaaagugcuggcugggauuacaggcaugagccacugugcuuggccgggacuacauucuuuuuauaaauuaacccaaggauaauugauauccauauguuaacucuugcuguccaggaacagggugcacuguacauugacuuaagucucuguguguguucuucaaauaguauuuacauuuuuuuuuuuuuuagagaggcaauacaugcuuaugguuauucuuagguauuuuaucuuuuaguuuguuuauuauucucauucauuucuuaauuuaaaggaauaauguguuuuagcuacacgcacauggaaaaaguuaucauuggccaggcgcgguggcucaugccuauaaucccagcacuuugggaggccgaggcaggcggaucaugagguuaugagaucgagaccauucuggcuaacacgguaaaaccccaucucuacuaaaaauacaaaaaauuagcugggcaugguggcaugugccuauagucccagcuacucaggaggcugaggcaggagaauggcuugaaccugggaggcagagguugcagugagccgagauugucccacugcacuccagccugggugacagagugagacuccaucucaaaaaaaaaaaaaaaaaaaaguuaccauuuugaaacugaacuguauuugauucauuuuuggugaauccugguuuucaaaacaugaagucauuggugagacagacuuucauuuuuuuuuuuuuuuuuuuuuuuuugagacggagucucgcucuguggcccaggugggagugcaguggcgcaaucucggcucacugcaagcuccgccucccagguucacgccauucuccugccucagccucccgaguagcugggacuacaggcgcccgccaccacgcccggcuaauuuuuuuuguauuuuuaguagagacgggguuucacuguguuagccaggauggucucgaucuccugaccucgugauccgcccgccucggccucccaaagugcugggauuacaagcgugagccaccgcgcccggccgacagacuuucauuuuuaauuguuagucuguuuucugcuacugaccgccuuuuugucacuuuacauaucuucucugagccuuaguuuccucaucuguaaauugaagaaucuaaaacagauaucuaaagccugucuucccgcucugcccacauugauucugaugugauuaacuuccuagaggccuuauaucugcucagggaagcccucuugaugccaggaccuaugugacucccagugguugaggaccaucugagcucuggauuucuagucccuuguggccaggcuggugggccaccaucaaggucaugucaggaagcucacuguccaccuucuagggcuaauuuguuugguuggguaguuaaagguuuaggguccugguuuggaauugcuugaagugcccuaguaucuccucgggaguucgccuuuccuuuucauucccuccucuggacccuuagcucucagaccuacuauccucaggcuguccacaugucucccagugcaacccucauugucaacucccuccuuucccucucugccuucuggcccucucccccuguccccucaauacucagggaaggaaguggagccuuggguugaaagaacugguuuagcaacgagucagguuauguucuuauccaccuuugccuuucaauagcuaugugaucuuugguaagguuuagagagaauaaaugcaaaguacuaacccaugauuacuccagcaggggucuuagugaauugguuugcucauuagugguuaauaguauuaauaguagcuuauuacauaaagcuaugugcugggcucuguaauaggagcuuuuacauaugacccauugaaucuucacaaacagccccaggaggaggguaggaauuguguaucccauuuugcagauggggaaaauaaagcccaggagaacuaaccugugcaaagucacacagcuaaugagugucugagccauaauucaaacucagcuuuaagaugucacucgugggacugaggaacugaauuuuuagcuuaccuuguuaauuucaauguagagccacauguggcuaguggcuaccauacuggacagugcaguuccagauguguggcagcagcucaguuccacguuagucaggagggagugcuccuuccuccccucuccuucuauccucccaugccccuccccucagcaggugggucuuacuuuuggauggagaacaccuucugaguuuaauuuuuguugcuucuuuaauucuaacagugugaagagugccagugcuggcagcauggggucugcaugggauuacuggaagaaaaugugcccgagaaauacaccuguuauguuugccaagacccuccagguagagauuucuggagucagggauauaacaguauguagccuuuuccuuggcacagcuggcugugacacauucuaaaugucugcggucuugagacucauuucuucagcaucggcuagacuccagcuccuccucgccucuguugcuauccugccuuguggccagcuauccugaacguagcaauaagagcacacgugugaaggggcccaccuaguggaaggccuggccuugagcuagaacuuuuccuuuucuuuaauuaugguuuaaaaaaaaugcaugaggccgggcgcaguggcucacgccuguaaucccagcacuuugggaggccaaggcgggugaaucaacugagaucaggaguucgagaccagccuggccaauguggugaaacuccaucucuacuaaaaauacaaaaauuagcugggcauggugacaggcgccuguaaccccagcuacuugggaggcugaggcaggagaaucacuugaacccagguggcggagguugcagugagccgagaucaugccagugcacuccagccagggcaacaagagcgaaacuucgucucaaaaaaaaaaaaaaaaaaaaaaaagcaugagaucuacccucaacaauacaguauuguuguuaauaacuauaagcacaaugucguacagcagaucuccagaacuuucauccugccugauugaagcuguguagaaaaauguagaaacuucacaaguuugagugucauccuuguguaggggccaugcuaaucuucucuguauuguuccuguuuuaguguaugugcugccgaaguggcaccuuuuccuuuucuugaggacucaugaggaugggcgugugggcucugucuuuggcuuuugggggcuauuggaggguuagaaacuugccuuugcccccuguggcaacaucugcccuucaucacaucacugccauccugaagggagaaaugcccuugaggggaaggaggaaggcaugguuggguagagccuguugccacccugagcagugacuuaauuccuuagcaggaucaguuaguuccauggcuauaggggucaccuguggcucuugauugcuccuuucuagaagggguggauuguaaauaugcaguucauugucuugguuuccaugggauggugacauugucucccauuaccacuuguaagguucucccucagcucuaguccccugauuccuuuagagcuagacagugcuugagagccucugcuuccguuacuccuuucuguccgauaaggugggccugguucuccuacucccaguuuugcuuaugaggaagaaauugauccuugaggauacaguugacuuuccucauaaagcaaauuggaauuagaacugguuugcagagccagaucucuugauuuuguugguugucuagggagggacuggccaccaguucauuuaacagcaugcagguccccucugggccugaaggccucuguugugacacugucuccuuguacuagaagcaucugccuccacuugucccuuuaucccaaggaaagaauagucagaagauuugacaggugaacaaacacaaguccagaagggacaugacuggcccaagaucacgccaccagcuaaugccagacaggcgaugagaaccaguugucucauaccuuugccuuguaaaacagguagugcagcucugaauccugcugcucuaggcacugccugcagcagcugccucugggguucccccauauauuccugaaggcuccuuagcauaccuuuuaaaaaucuuuuuuucccuacugugucuuucucucuacuuuuccuucuuuagaagucacacacaccaucuucaucaaauccugugcacuuacugaacuucuacgacuuuaaucgccaauacugugaauagacucuuccuugaacugagcacagcaugucugccacagggucuaccuuuauagacugacucugcagagggcuggaccaaaaguuuaacagauucguuuuuuaaaggcuacuuaaaaauaguuuuaacagaaucaagguguauccccaccauguguauuaguaaagccagaaguagcucaaagaccuuaauaggaaucaccuggguguuucaagguuuuuauagauauugacagucgaacaacagucugguagaaagcuuuucccugggacuuuggagcaggucauguugauaagucacaugugcuuuuguuuucaguccuuccuaaggagcccuguaacaaauaggauggcugaagccauccaguuccuauguuguucuaaugaauggauaacagguacagagaagggaaggggccugaucaucuguugaguuaggugguagaagguacauuugcagggggacuugaggcaucuuuccauucauuugauaaguccauucaagaugccuuuugccaggcacuggggauacaaccaugaacaagauaguuccuacucuuucggcucuuaauuggguugggagccagaaacagaaguuaaaacaaguuaaguaaacaagacuguguaagguagugaugaaugccgugacgggaaaauugauaagacgacuugaggcacugaugaugcucucaacuuugggaaguagcagaaggccccacuccugggcaacauggcaaaaccccaucaaaaaaaaaugaaagaaagaaagaaaaauuagccaggcaugguggugcacaccuguagucccagauacucgggaggcugaggugggaggaucaccugagcccagggaggcugaggcugcagugagccaugaucaugccacugcacuguagccugggcaacagagugagacccugccaacaaagcaggaaaaaaauaaaagccuuucugaggaggugguaaggagccaacccugcaaaggcuuagggaauagugcugcagacagaagggaugcgcaagugaaggucuugaggcuggaaagaguuugauguguuucagaaacugaaaugaggccaguguaaagguauggaggggaagacaggaaggaacuggguccugugggccucaguaagccagaguuagagaguuggggcuuuggguauucuccuuugagcaguaggaggcaguggaagguuuuaaguaggggagagaauauuaugauauaaauuuggagauaaucuaggugcccagcucaccucuggccaguuccaggaaaugaggaaguacaugccuuauucacuaccuuauccccacuaccuaauagagagcccagcauaugguaggugccaagaaaauguacacuggaugaauaaaugaacaaaaugaguauacuaaucuguucuuccaguaguugguaugauaauugugugagagugaugaaauggccuggguuuccuucaggccuuguuuuaacccucuuguugucacugcuguaggucagaggccuggcuucaaguacugguaugacaaggaguggcugagcaggggacauaugcauggccuggcauuucuagaagagaacuacucccaucagaaugccaagaagaucguggccacccaccagcuucuuggugaugugcagagagugauugagguucugcauggccugcagcucaagaugagcaucuugcaguaaguguggcaccugcagugcugggagcagucuguuuggcauggucugggggcugaguaaaucugagaaauuggaaagcuaccaaagcaaucaaaucauaaaacugaguuugagaccuuuacuaaaaauuaucaguuucaggauaaacauucuuuaaaaaaaaaaaaacuuuauugaguaauaucuuacauauaauuagguucauccacuuuaagaguucauugaggccgggcaugguggcucaugccuguaaucccagcacuuugggaggccgagguaggcggaucaugagguaaggaguucgagaccagccugaccaacauggugaaacccugucucuacugaaauuacaaaaauuagcuaggcgugcuggugugcgccuguaaucucagcuacuugggaggcugaggcgggagcaucgcuugaacccgggaggcggagguuguggugagcugagaucgugccauugcacuccagccugggcaauaagagcgaaacuccgucucaaaaaaaaaaagaguucauugaauuuugacauuguaugcagccgugaagccaccaccagaaucaauacaugguguguguauuuugguuuguuuuuuguuuuggcauacaguucugaguguuuuuuuuuuuuuuugagauggagucucacucugucacccaggcuggagugcaguggugagaucauggcucacugcagccuccaccuccuggguucaagcgauucucccacuucagccucccaaguaguugggacuacaggcgcaugccaccaugccuggcuaauuuuuuguguuuucuguagauauaggguuuuaccauguuggccaggcuggucuugaacuccugaccucaagugauccacccaccucgggcucccaaagugcugggauuacaggcacgagccacuguaccuggcugaguuauuuguuuuuaauugcuguaagauauacauaauauaaaauuuaccaucuuaaccauuuuuuuuuuuuuuuuuuuugagacagagucucgcucugucgcccaggcuggagugcaguggugugaucucggcucacugcaacuucugccucccagauucaagugauucuccugccucagccuccugaguagcugggaauacaggcgcacgccaccacacccggcuaauuuuuguauuuuuaguagagacaggguuucaccauguuggccaggcuggccuuaaacuccugaccucaggugauccacccaccucggccuccgaaauuucugggauuacaggugugagccacugcacccggccccaucuuaaccauuuuuaaguguacagcucugcacaguugucauucauguuguuuuacaaccagucucuaaaacccuugugaaacugaaguucuauacccuuuaccaacagcucuccauuucccuuuccccaaagccccugacaaccaguauucuacuuucugccucucugaauuugacuucucuagagaccucauguaaguggagucauauaguguuugucuuuuugugacuggcuuauuucacuuagcauaguguccucaaaguucauccguguuauagcauauguaagaauuuccucccuuuuuaaggcugaguaauaacuuguuuuauguguaugccacauuuuguuuaucccuuucaugcuaaauauuccuuuuuuuuuuuuuuaacaagagauggagucuugcuuuauuucccaggcugaagugcaguggcuacucacaggugcgaucaucaagcacugcagccucaagcuccugggcucaagcaacucagcucauucuuuuuuuuuuuuuucugagacagagccucgcucugucacccaggcuggagugcaguggcgugaucuuggcucacugcuaccuccaccuccuggguucaagcgauucuccugccuuaaacuccugaguugcuaggauuacaggcacaugccaccacaccuggauaauuuuuuuuuuuuuuugagaccgagucucgcucugucacccaggcuggaguccaguggcaugaucuuggcuuacugcaagcucugccuccuggguucacgccauucuccugccucagccucccgaguagcugggacuacaggcgccugccaccacgcccggcuaauuuuuuuguauuuuuaguagauacaguguuucaccguguuagccaggauggucucgaucuacugaccuugcgauccaccugccucagccucccaaagugcugagauuacaggcaugagccacugcgccuggccuaauuuuuguauuuuuaguagagaugggguuucaccauguuggccaggcuggucucgagcuccuggccucaacugaucugcccaucucggccucccaaagugcugugauaacaggcgugggccacugugcccggucggucucuuggcuguuauaaccuacccuacuuuaccaaauacagcaacagggccuugagugggguaggccucuuccaugguuuccauggguggagccuggacuagaauccaaauccuggcucugucagguacuuuucgaacugucucucuaugugauacugcaugaccuugugagcuuucuuuugguuuuaguauagucugugucagggacugcuuuuauuuaaguuguaaacaguggcagacuagugcgaugagugaguuaagacuugauaggcugcuccuggauaggauuuccuuugugcugaucaggccuagaggaggccuggugucaggcagaguggaguaucaggacccugagauggugagaugggaaucugcuuccucuugugcucucuggcacacagaggccuggcuucaagaucugcgugacaaaggugguggaggagggaacauugggucugcguugguuuggguaaaagcugaggugcuauaacaaggaccccccacauagaggcucaaacaaaacagaaguuucuuucucauauaaaugaaugguucaaggcuaggcagggaucuaggcuagguaggagaccuuucuccaggauuccauccguuggguugggaacuuuguuuccuucugucuuacggcuccagcauucucuuaggguuccccuuaucugcauggucuuagguuccuuuugucuuauugcucuggcauucucuugggauaccccccauuugcaugguugaagcaguuucaccugcauuucagcucuaccccaguccccaggagggggaaaagagagaaagaagagggagggcaaauaguuucauggacaggccuaauggcagggcaggcugggcagguggccacaggcccugcuuauacuuagaaguagggguggggguggggauaaaaggaggagagguuggaugcuggggcaauuagcaguugcuguggcagaaucuguugaggugaacugaaccaaaugacggcccuggauaggaugucagagacuagcuauuuccucacauuucauaaaacaggaaaacguaaccccauguaaaccaaaugaauuuguuuuuaaugagauggcagcaauuaaaugaaguagguggauggugguccacgugagugccugggaaaccucaggggcugcuccugauuguaaacuuagcuauauuucuuuaaaaaaaaauuuuuuuuuuuuaagagauggagucuuucuguguugcccaggcuggucaagugaucuaccugccuugcccucccaaagugcugggguuauagguguaagccacugugucuggcucauauuucuuuuauuuuuauuauuuucuucucgacagucuuaauagggcugaacuuuuuaaaaauaauaauuguuauccucccaccucagccuccugaguagcugggacuauaggcgccugcauuucuuuucauuugaggguucugucagaugcuguucucuuuuuucuuacagaaaugccaguguuccuggcccuggcccauauucugaagccuugcccuuucuuuuuuuauguuuuugagacaagggucucacucugucacccaggcuggagugcagugguaugaucgcggcucacuacaacuucugccucccgaguucaagcgauucuuaugccucagccuccccaguagcugggauugcaggcauguaccaccgcaccuggcuaguuuucauauuuuuaguagagacuggguuuugccauguugcccaggguggucucgaacuccugggcucaagugcuuugucugccucggccuccuaaagugcugggauuacaggcaugagccacugugccuagccccuugucccuucugaauccucaucuagauccuccaucuuuagagaaauuacuuuguuuguaguagaauuaaaucugucuucuagcaauucagaagagggcauaggaagaucuugguacuucuuacaaauggagaaaagauccugggaaaggggaagguggccccaguaugucucuguauucauggauggucucuguugucaugggcucugggucuuuauucucagaaauauuguuccccagugaccuggugaauuuauuuucgaagacaaacaauaaaacugggaguaacuucagagcaucugucaucauaaaaaacauggccuggauggcugugcuuaccuucuucaugacugacagggcuuacaaggaaauggcagggucaugcuugcgagaaguagcaccuucagaucgcaguuggaaggaugaaaauuguaggugggaggaagcagagacuuuaaugguuuuuuuaauaaagagcaggucuguacuaugguucguguguuccauguuaacagguaguggaccugaaaguuaacaaugacucccauuuccccugagcaguuuuaguggugugucuggguccuggguaggcuccugggacaggcugauacccugucuggagguaucccaaacaauugaugccaauuguuuccccucuuccuuaguggcuagcagugguaugggauugcuggagugggagagcugagacgggauaguugcaggcccuugggagcagaauuuuaguucuguaacaucgcucuaugccuucauguauaugaccacuuccacuuucacaggaagguacaggaaggcauccacagcauuuuaugugcacauacauggaggcacagcuuucaguagaugcucacaggagucuggcccuaaaaaggauaagaaucccuguucuuuucuuuaauaacaaacuuuuuucuuuggaauggugcgaauaaauuuucagaauaauuuuuagaagcuuuaucauuaaugaccuauacauaaaggacaguugauuuuauuuuuuuaaccccuggguaaucauugcauuuuuguaaucaaaugccauuacaugcugggaucauugugacuguuuauuaauaaguuaagguuauuuuuaguaagucacauuugaagagcacuuuaccaccauuaauucacuuaauuguuaugaaacucaguguuugaugguguuggcaaaaagagucaaauucuguaaaauacuugaagauauuuauucugagccaaauaugaggaccuugacuugugagacacccucaggaaguccugagaacaugagcccaagguggucaggcuacauacagcuuggucucacacauuuuagggagacauaagacaucaauacauauaagaaguacauuggcuggguccagaaaggcagaccaacuugaggggugggugggcuuccaggucauagguagauucaaagauuuucugauuggcaauugguugaaagaguuaaguuauuaucuaaagagucaaguuauuaucuaaaggccagucgccaggcuugguggcucacgccuuugggcucccagcacuuugggaggucgaggugggcggaucaccugagguugggaguucgagaccagccugaccaacauguagaaacuccaucucuacuaaaaauacaaaauuagcugggcauggugacgcaugccuguaaucccagccacuugggaggcugaggagggagaaucgcuugaaccugggagguggagguuguggugagccgagaucgcaccauugcacuccagccugggcaacaagagcgaaacuccgucucaaaaaaaaaaaaaagaaagaaagaaaggagugucuggguuaaaauaagggguuguggagaccaagguucuuaccauguagaugaagccuccagguagcaggcuucagagagaauagauuguaaauguuucuuaucagaccuaaaaaggugccagacucuuccuuaauuuucuccuggaucaggaaaggaccuggaaaggaaaggagguucucuauagaauguagauuuccccacaagagacagcuuccagggcuaguucaaaauaugucaaagaaauauauuuugggguaaaauacuuugauuucuuucaguaccugcuaucuguuauguugguaucuuaauugcuacagucuguuuugucagucugagggucucuauuuuaauguuuuguuguuguuguuguuuuguuuuguuuuguuuuuugagacggagucuugcugucgcccaggcuggagugcaguggcgcaaucuuggcucacugcaagcucugccuccuggguucacggcauucuccugccucagccucccaaguagcugggacaacaggcacccgccaccacguccagcuaauuuuuuuuguauuuuaguagaggcgggguuucaccguguuagccaggauggucucgaucuccugaccucgugauccuccugccucggccucccaaagugcugggauuacaggugugagccaccgcccccggcccguuuuaauguuaaugcuggucaguugugcaugaauuccaaagggagaaggguauaauguggcuugucugacucccuucccaucauggccugaacuaguguuucaguuuaauguuggaaugcucuuggccaagaggagggguccauucagguugguugaggggcuuagaauuuuauuuuugguuuacaauagcagacagaucagacagauaauuagcccaguuucacagaggaggaaguaggaaugaugcugguugagugaguugucccagaguugaaauccagucaggucuucugacugagaguccagucccacucacugugugugaccacagugggagcucacuaaggaguggucuccuaggagaccacggauucacauucgcucuuguuuagcaaaugguaguguguggucagauggcccagguggagcugcugucccuacugggagaguauuuaggaauugagaaccccugcaauggugccaguuacuccaaagcccauguccucuuuguccucucaacagaagccgggagcauccugaucugccgcuguggugccagccuuggaaacagcacucaggggaggggagaucucauuucagaaacaucccugucacugacaccaggagcaaggaggaagcuccaagcuauagaacuuugaacggggcaguggagaagcccaggccccuggcccugccccugccgcguucuguggaggaauccuauaucaccagugagcauugcuaccagaagccccgcgccuauuacccugccguggagcagaagcuggugguggagacgaggggcucugcccucgacgaugcggucaacccccuccaugagaacggcgaugauucccuuuccccgcgccugggcuggccucuagaccaagacaggagcaagggggacagugaccccaaacccggcuccccaaagguauguggcugccuuguacuuguucuucauucauugcgugaaugcuugcaaguuauccuccuaguuugaaugcucuauggaagauauuuauuaauaaaacuguauuuaaauuugcuuaccauagauauguuuugguuugccaaaaugggugcaaagucaggagagcccacuuaagccaaagauccuugguuccaggaagcacccacaaaauggcauagucaaguguggcacgugggguggggggcgcgggugcagagggagggagaggugggaaguagcaaggagauauggauuagcaaaacucaucuuuucuuuaaggcaguuugcauuauaauugcaccuagauguuaauucuuagcaugagcaaacaaugagucaaauguuuuguuaggcagaauuuuuucaauccaguuguaugauagcuuuauuuugacuuuuaacuuugaagcccugugguaaaaaugguacacuuugucaaaauauugcugguuucaucaguuuucccaagagccacuuuugguuuuuuguuauucaagucauucucuucuagaacccccuuguaucaccucguugccgguguuuucaucucuaacugcucacuaggcucauugugcccuguccucaguugucagugaggcuuuguaugauuugagaguuucucugucucaucauccuuacuucccagacuuucuccugcagguuggugucaccaguguuaaauacauugcugcauggugccaaggggauccuagauuacaagccccucaagggaggggauuguaucucaugcauccuugugcccuugacuaugucuaaacgguguugggcaaggugguaagaacacagucuuuugagacagacgcaguuucaauucugagcucagccccuuacugugugauucugagcggguuacuucacuuuccugaucagaccuguuuucucgccuguagaauggggccagugaagcccccucaguuacuguggaacauauuugugaaaaucccucaguaaaaucccucaguuuugcacauaguaaguacuaaauaaauauuggcuagaaucuauuucauuucaaauggaugaaugaaagguugaguuaccaaauccuagaaaagguuugugguccuguggaucaggcagguuuccuagagguaucuggcacauaaaacaaagccaggaaauacugggccucagcaaagcaaccagggcuaacagucuuuuccauugaugguaagcugacuguaagcuggccuugcuuuuaugugccuuacccuauuucauccucaugaaccuuccaaauagguuuuaguacccccauccucccaccgagaaagcagaggcucagagacaugaaguaguccauccagacucgcacauucgcaggagauggagcugagacuugaaacgcguuggugugacucccguguacuaacccuugucugcacuagcccugcucuaaucaccucucagggcucuggaagccauucugugaggcuuacuuuaggcuaggacauuggcccagucaguaggaagcagcuguggguccccugagcuagagugcuacccugagguaguuggaauugguacagugggcaagcuccugcccaguuccuaagugggaaauaggaaagggagguagggauuuggaguauugaaacugcagcuaguauuucagguggcuggaaaugcuggcugguugaaaaaugggccaggggcuaucuccauucaguaauuuccaugccauugcauccccaggugaaggaauaugucuccaaaaaggcccuaccagaagaagccccugcucggaagcugcuggacagagguggagaggggcugcugagcucccagcaccaguggcaguuuaaccugcugacccauguggaaucucuucaggaugaaguuacgcacaggauggacuccauugagaaggaguuggaugguagggcuccuucauuggcccccugugcauuggcaugcagucgagcacccccagacgagcugcuuucugaaccccccagucugaguuuacagggaccgcuguacucuuugcuucucuucuuuucagccucuccccaccuccauucuccccucaggauggaugagccuuacuuuuaguauuuaucaggugcaagaucugcaugauguuggguccugccucacuugucugaucccuucuguaaaguugaguaugcagagagagggcaacuggcaguccugcuugcaggaaauaugugaucuaagccaaucuuuacaaacaaguucugugagaaauuaaaauuuugacuugaguuuuaggauaucugaggauuuaaucugaaaaaccucuuauuccaaucuuugauaaaaucuaaaaugaagcuuucuccucguaagccaguagagauuugagaauuugccugagucauuuguauagcccugaguauuccuuccagauauuggugguuacggacaggccuggaggaucaaaccggugaugaugaacaugaucaaguucagucucucuccaggaaguugacgguuuugguuguugaaauauucccuaauuauuuguuuucauguugaaaauggagcccaguuaaaaaagaaauguuguuugaggauucuggguacagucuggcuaugauuuuuuacuguaacugggaauauaaaacauacaugaaauaacucaggagaaaaugccaucuguuauacaagugaugccaugagguguggccgggacacauguggcugaugucaaugcagaggaggagagugcuaauaggagggcuuccuaaaacuccugagacugaaguugagcuuuaaggagagugaugguguuuccuacuggagaggacucaggguggaugaucuggcuagacuggaaaaagaguugcccuguuggaggacagugagagagacagcaagaccuaggcugggugugguggcucacaccuauaaucccaguacuuugggaggucaaggugggaggauugcuugaggccagccugggcaucacagucucuacaaaaaaauaaaaaacuagccaaguguagggguguagucccagcuacuugggaggcugaggcgggaggacugcuugagcccaggaguuggaggcugcagugagcugugauuaugucacgguacuccagccuguguaacacagacccugucucuaaaaaaauaaacuaaaaaaaagggauuguaacugaugccacugucugugaaaaacauauuauuagagagcugaaggaggauauaauguuagacaaaaaaguguagcucuugagagaauggcaguaggaguggcucuguagucccugaaaagaggauuagcaccauggaaacagggugaauguucgguuguugccacagggaccuucccugagggagaaguuaaagucuacucacaucuuacuuccuuaauccucucuucagccagguuuggccucucuagcccugccgaaugggcaguguggcaaggaugguaggccugaacccccuucuuuggccucacagaugaccucuugugugucuugcuaauucagagccacauauucuguacauuucuaagacucuaggcccugagagagauaacaagaaagcauuaaaauaaaugauaaagcuuaaagauuuuauuuagguaaacagacuuuugcauaguauuuaagauuaaucaaaaucccuuuuuauggaaucaacucuuuauuuaaacaccaagauaaacuaagcuuucuuucuuucuuuuuuuuuugagauggagucucgcucuguugcccgggcuggagugcaguggugccaucucagcucacugcaagcuccgccucccggguucacgccauucuccugccucagccucccgcguagcugggacuacaggugcccgccaccaggcccggcuaauuuuuuauauuuuuaguagagacaggguuucacuguguuagccaggauggucucgaucuccugaccucaugauccgcccaccuuggccucccaaagugcugggauuauagacgugagccaccguacccagcccuaaacuaagcuuucauaaccaaguuuuaaaauaggaauuuggauguaacauuccuuuuuuaaaaagccggccugcuuagcugggugugguggugcacacguauaauccuagcuacuugggaggcugaagcagcagaaucuaggaggcggagguugcagugagcugagaucauaucacugcacuccagacugggcaacagagugagacucagucugaaaauaaaaaauuuaaaaaaauuuaaaagcugaccuggcgugguggcucacacuuguaaucccagugcuuugggaggccaaggaguucaagguuacagugagcuaugaucgugucacuguacuccagccugggugacagagcaagaccccauuucuuuaaaaaaaaaaaaaaaaaagccuaguaagcuauuauaugaaauauauauauauauaugccauuguuuuacaauuggccauuauuuaauuauuuauguaguuauaugaauaguacuuuauuuauuuauuuauuuauuuauuuuugagacggagucucggucuguugcccaggcuggagugcaguggcacgaucucggcucaccacaaccuccaccuccuggcuucaagcaauucuccugcuucagccucccgaguagcugggauuauaggugcacaccgccaugccuggcuaauuuuuguauuuuuaauagagacgggguuucacuauguuggccaggcuggucucgaucuccugaccucaugaucugccugccucgggcucccaaagugcugggauuacaggugugagccacugcacccagccugaacaguacuuuaaaacuaaaagacaaaggauauuuaaugaccaugaaaaguaaaaaagucuuuuggcauuagagagauuauuuucuuaaauaaaaaauguugccuuggugagcaguggucucuauacacaugaucuuaguguauuugaacagaauuuuuuccucuguaaccuucugucuugcuagcaaccacuaugcuaguuggaagcuguucugcaucuuuaaaagagacacuugggauggugcagcacaugguauggagaggguggccugcuggaugcugggguccagaggagaugcuguugacuucccacaguccuggcuuuguucuucagccuaacagaccuagacagacagcuuccaucucaggaacuccacacacuccuguuaaccaagcucaggcacuacugaguggcuuagacucuuccagucugagcguuggugcgcuuucacacugugcaugccuccugggccaccguaguaucgggaugucuuuggugagccuggaacuagauccaagguaguuagggugaccuuaagaggggccucucagcaacuguaggaucaucuugcaaaagauugacugacucucuuugcuguuggagugacccauccaguccugacugccuuuuguccauuuauuuauuuuuauuuuauuuuauuuuuuuaagacggagucuugcucuuucucgcccaggcuggaguacaguggcaugaucucggcuuacugaagccucugccucccagguuuaagcgacucuuccuuccucagccucccaaguagcaggcagaugccugccaccacaccuggcugauuuuguauuuuuaauagagaugggguuucaccauguuggccaggcuugucuugaauuucugaccucaggugauccaccucccuugaccucccaagguguugggauuacaggcgugcacguccggccucuccauuuauucuucugccuguuugcugaacaguccccugucuccuucuaguuuuuuuuaaagacuuacugguguuuugaaacuggucacuauccaguuuucuugcucagcaggccacuaguuccucucacaugacugaucuuuuacuaaugguuuucaagcuuaagucugaggagguggucuuauuuuucuuauuuccaaguccuuguacuugcuggaauuaggaagagagaggguuccuccuucuuggaacccccaaauaccaacaagaaauaugauggaggaggauaaacuacauagggcccagagcaauggguagggcgcuuugcuggaccacacauuccuucucucgcuguguuuguugcaggcuugccacauuucagacacaggugaguguuagggauauaguggcaagcaaggcagacucagccuuugcccucguggaacuugaucuagugggagagacauauauuaaacaaaucaucccauuaccuguaaugacaaaccauaguaaaugcucaaaggagaacaugugauaucauagcaccuguaacacaaggaccagauucaggguauaggguuggggaaggcuucccuaaagaauagcucacaagaaacagaggauuuagaaagguggagaggaagguagggcugcaucugaggacaggagaggauugcgcaguagguugcaggcugcuugaugaagagguacugggugggccuuucuuuugcugcacuccaggguccagaaggugcucaguacagguuggugcauggacuagaaaggcuacaggcaggcugggauagcacaggggcuaccugcagggggugguucuugucaaaggugcaggguucccagauggucucuccccaaaugccagagcuuuaggggguagcuuagggaagaacaaacaucuuucuguagagaaauacuuguucucacaagcaagacagcuuucuagauauugaaccaaugaugauaauguuaauuaauaccugaaaucuuacauuaaauauuuaaagggguccugcauggugguucaugccuguaauccuagcacuuucaaaguggccaaggcagguggaucaccugaggucaggaguucgaggccagccuggccaacaugaugaaaccccaucucuacuaaaaauaacaaaaauuagccaggcgugguggugugugccuguaauaccaucuccucaggaggcugaggcaggagaaucgccuguacccgggaggcggagguugcagugagucgagaucauugccauuguacuccagcccaggcaacaagagcgaaacucugucucaaaagaaaaaaaaaggccaggcccaguggcucaugccuguaauccuagcaguuugggaggccgagguggguggaucaccugaggucaggaguuugagaccaaaauacaaaaauucgccgggcgugguggcacaugccuguaaucccagcuacuuuggaggcugaggcaggagaaucgcuugaaccuaggaggcagagauuacagugagcugagauggcgccacugcacuccagccugggcgacacagugagacuccaucucaaaaaaauaaauaaauaaguaaauaaauaaagggagaaaauaauaacagaguauucugugccacugaugauugcguaucaaucaggaauuaauaugaagcaaaucagaguuuaugauauacaaauagaccuuuucaagacccuauagauuuucauuuuucuugacaggaugcuaaaacaccaggcucucugauuuucaacaugggaaagcuuuuuauuuuuuauuuuauuuuauuuuauuuuauuuuauuuauuuuauuuuauuuuauuuuauuauuuuauuuauuuuauuuuuugagauggagucucgcuuugucgccaggcuggagugcaguggcacgaucucggcucacugcgaccuccgccucccggguucaagcaauucuccugccucagcuuccugaguagcugggacuacagacgggcaccaccaugccuggcuaauuuuuguauuuuuaguggagaugggguuucaccauguuggccaggauggucuugaucucuugaccuugugaucugcccgccucgaccucccaaagugcugggauuauaggcaugugccaccgcgcccggcugggaaagcuuuuuaaagagugagugguaacacucagaaaggugcuuccuuccaagacuucuagacucugguaacaguagccucuggcaauguguggcuguuuaaccaaaacugaauaaaauuuaaaauucaguuccucaguugcauuagccauguuuccagcgcucaauagcugcauaaggcuaguggcuacuguauuggaugacacagacuuggaccauugaucaucgcagaaaguucuuuuggacugugcugcucuaaagcauuuguguuuuguccugggaguaccacuuuguagagcagguguugacacagugcuggcugaaauggcccuuccucccuugccccauggaggcugaaauggcccuuccucccuugccccaugucugauggaauaaggugcugaaaugcuugcugauguucuugcaaaucaaguguugggaguucacuaggucucaucucucucuucugccgacaguguuggagagcuggcuggacuacacuggggaacuggagcccccugagccgcuggccaggcuuccgcagcucaagcauuguaucaagcagcugcugauggaccugggcaaggugcagcagaucgcccucugcugcucaacaugaaacugggcacccaaaacucaugggggcacaauccuggggcaccugcaggaggagcuucgcauauuuaaauaaauaaaccuagcaugcugaaugcacgugacaccgacugacuucagggaucugggccaggagugugguggacauuggacaaagaggccauuuuggcugcgggaggacacucugaucucgaagccugccauaaagguagcaaauagacucuugggauuccccucuucugugcacaucguugaaugaagagagucuuuuugcacaaacuucacuugaaauugugccacugaugauaaacggaaugagagccaaaaaaguuuaguuggagacaguuguaaauucaauuuggaguuuauuuaauugacuuuucuaucacguuggggcacaugccaacucccugguuucuuccuggcaugguguuugggcagcaggcaucauuuuccuuuucuagcuucauaggaauauugugagcucaccaugcuguggagguugggaaagagcagagucuuggcugcccugcuuucuccuuaggacucuucacuuuucucaccacaucucuugcaugacuucaugguacuggggacaaguuuguaugccuucaccccagagcuggcuggguuauggcuuuuguagcagagcccauacagccuauggaagaacuagaaucucacucacaguaauaagaaucuaggaggaauuccaaaccgaagcaggcagggucuggaacccaaaggacagcauuuucuacccacuucuuaauauugacagcuuccccguucuauuuaauguccaaaaauguuucccaaaauuucaaacucuuucacuguaaagauuuguuacaaagaaugugguuuggggaauuaccuuauuuuauauuguuguaaacaaacuucaaauucuacaugugcgacuuuucuccuuccugaaggguguuuaguagucagcguuuucagaauuguuuuguuacuauacuuuaacauuuuacauuuccuguuuguauuauuuugugagagcaaggugaucaugcugcuuaagguccagguacaaccuauuuguaccuuuugagacaauauuuguguuacuuuugcagguuacgguuccacauguaauugcuauauuuuguuuuguuuuuccuuacuaggcaaaguuaaaauguuccaugcuuugaggagugacccauuucacuacuuuguuuucuuaucacuaaaggcaaaaaucaaagcacaguuguccauuaacacuuauaaguuaauuauggguuuaugagucuguaauguuauaugcugcaaacauuuacuauguaaacgugaaguagccaauaauaucucaauaguaguaacaguaucuuuagcgaccuuuggaauaguuaagcacaggucauuguggacaugaauucaggccucuguacuaaaaucuauuucagggaauguucugucuagugauuugcucaccauuugauauauaaugaauuauaggacaaguauaagcugaucugcuauagcuguccaucagagagaauacacguggcuauaacaucuauaacaaaacgacgauuccucuacaagaggcuguuucucacugcuaacguugguguuucuggcgugggaagaaaugcacaggcgugcauggcaugcacguucagacagcugcauuguaagaguucugucaugcagucugaaaagggaagaaacaggauggcuuucuguagccacaccugugaggcgugaugauuguuguauuauuagauuacugauuuuucuuuucugaaaauacauuugaguuuuaaucacaucuguggaagcuguaacuuuuaagguagucaauuucaugucuuguucaacgauguaagcagaaacugaauugcccuaauuuugccaacuggccauuauugggauuauuguuuaaauuuuugguaaaggaaguaaucuccuuucauucauugugacuuuuguucuuagggaagcagagaagacuccccaaguucuuauaaccucauugugcuucccuaauuuaaagccauguugaggggcuccauucccaauuccugggucaaggugaauuaacccuauguuggagcacuggaaaccguuauuugcaaacauugcuguuaccauuuagaaauaugugcacuaucagcugggugcaguggcucacgucuguaaucccagcacuuugggaggccgaggcagguggaucaccugaggucaggaguucgagaccagccuggccaacagggugaaaccccgucucuacuaaaaguacaaaaauuagcugggcgugguggcggacgccuguaaucucagcuacuugggaggcugaagcaggagaggugcuggaaccugggaggcggagguugaagugagccgagauugcgcuauugcacuccagcucgggcgacaacugcaagacuccaucucaaaaaaauaaaaauaaaagaaaagaaagaaauaugugcacuaccuaaguuuugucuuuagaaaaacuauccaccuauaaaaaauuaccuugacaaaaauaguuccgguuugacuaaucauuuuguuucuuuaagugguaaguguaugcaagguggauccuugaugagccaacauugcacuguggauacauaucuauguuuacgcgcuauuagaacagaaggcgcuguauauagaaauguugcuuugaagcaauauuugcaaaacacgcagacuucuguaucuguauuuggaaaaaauaaaacagguucuuguu
